United States Patent
Brown et al.

(10) Patent No.: US 9,243,244 B2
(45) Date of Patent: Jan. 26, 2016

(54) METHODS AND COMPOSITIONS FOR THE SPECIFIC INHIBITION OF BETA-CATENIN BY DOUBLE STRANDED RNA

(71) Applicant: Dicerna Pharmaceuticals, Inc., Watertown, MA (US)

(72) Inventors: Bob D. Brown, Millington, NJ (US); Henryk T. Dudek, Wellesley, MA (US)

(73) Assignee: Dicerna Pharmaceuticals, Inc., Cambridge, MA (US)

( * ) Notice: Subject to any disclaimer, the term of this patent is extended or adjusted under 35 U.S.C. 154(b) by 94 days.

(21) Appl. No.: 14/300,754

(22) Filed: Jun. 10, 2014

(65) Prior Publication Data

US 2014/0288292 A1     Sep. 25, 2014

Related U.S. Application Data

(60) Division of application No. 13/718,525, filed on Dec. 18, 2012, which is a continuation of application No. PCT/US2011/042820, filed on Jul. 1, 2011.

(60) Provisional application No. 61/361,776, filed on Jul. 6, 2010.

(51) Int. Cl.
    *C12N 15/11*     (2006.01)
    *C12N 15/113*     (2010.01)

(52) U.S. Cl.
    CPC .............. *C12N 15/11* (2013.01); *C12N 15/113* (2013.01); *C12N 2310/14* (2013.01); *C12N 2310/321* (2013.01); *C12N 2310/343* (2013.01)

(58) Field of Classification Search
None
See application file for complete search history.

(56) References Cited

U.S. PATENT DOCUMENTS

| | | |
|---|---|---|
| 2003/0064384 A1 | 4/2003 | Hung et al. |
| 2004/0175703 A1 | 9/2004 | Kreutzer et al. |
| 2008/0113351 A1 | 5/2008 | Naito et al. |
| 2009/0156533 A1 | 6/2009 | McSwiggen et al. |
| 2009/0176725 A1 | 7/2009 | Morrissey et al. |
| 2009/0203137 A1 | 8/2009 | Worm |

FOREIGN PATENT DOCUMENTS

WO      2007031091 A2      3/2007

OTHER PUBLICATIONS

Sun et al.; Asymmetric RNA duplexes mediate RNA interference in mammalian cells, Nature Biotechnology, vol. 26 (12), pp. 1379-1382.
International Search Report for corresponding International Application No. PCT/US2011/42820, dated Apr. 23, 2012, 6 pages.

*Primary Examiner* — Tracy Vivlemore
*Assistant Examiner* — Kate Poliakova-Georgantas
(74) *Attorney, Agent, or Firm* — Mintz Levin Cohn Ferris Glovsky and Popeo, P.C.; Christopher R. Cowles

(57) ABSTRACT

This invention relates to compounds, compositions, and methods useful for reducing β-catenin target RNA and protein levels via use of dsRNAs, e.g., Dicer substrate siRNA (DsiRNA) agents.

12 Claims, 32 Drawing Sheets

Figure 9
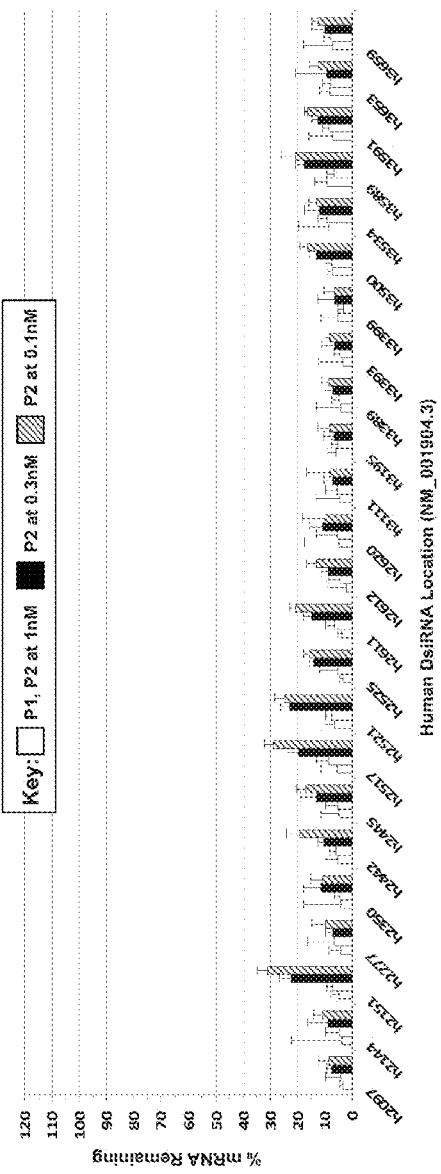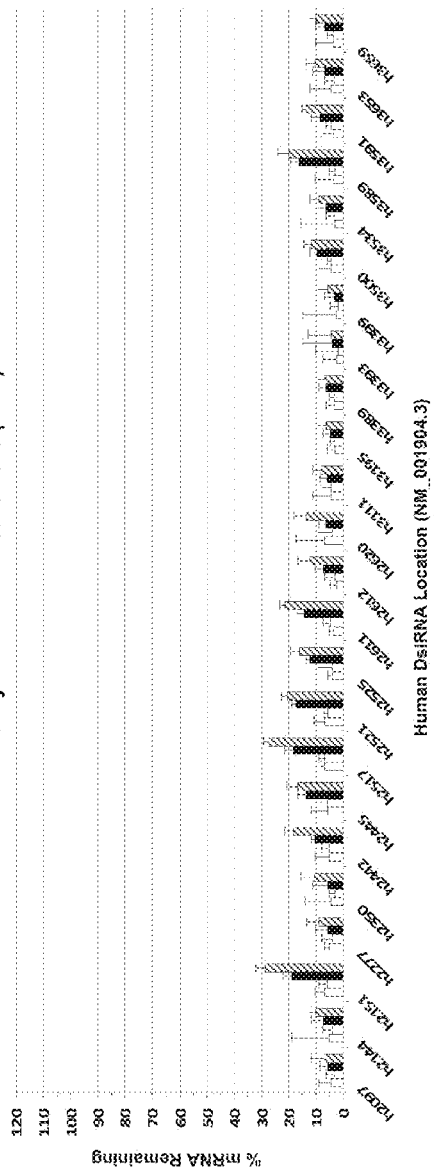

Figure 10
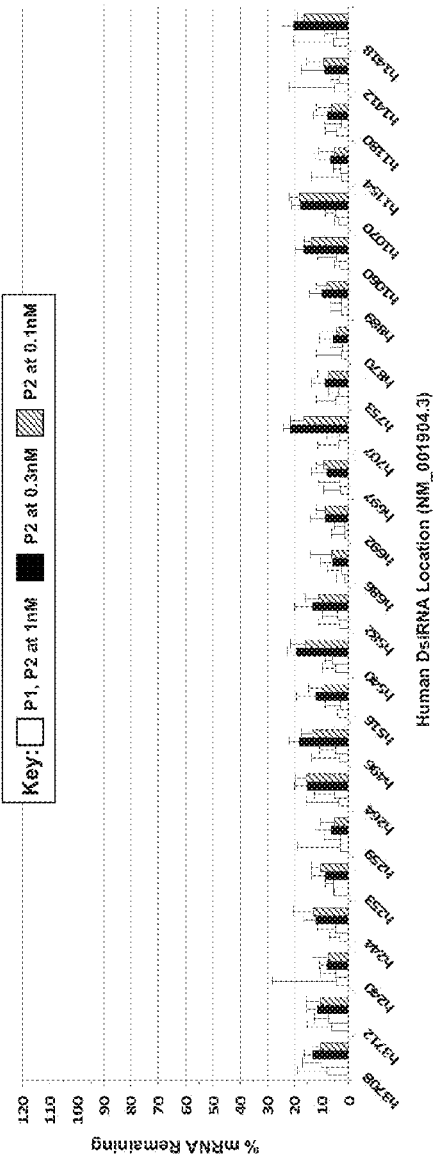
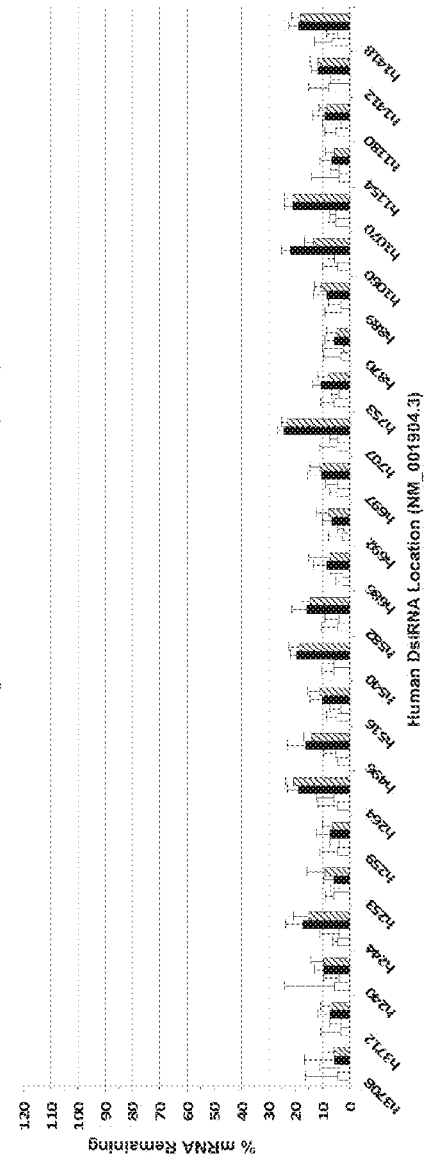

Figure 25
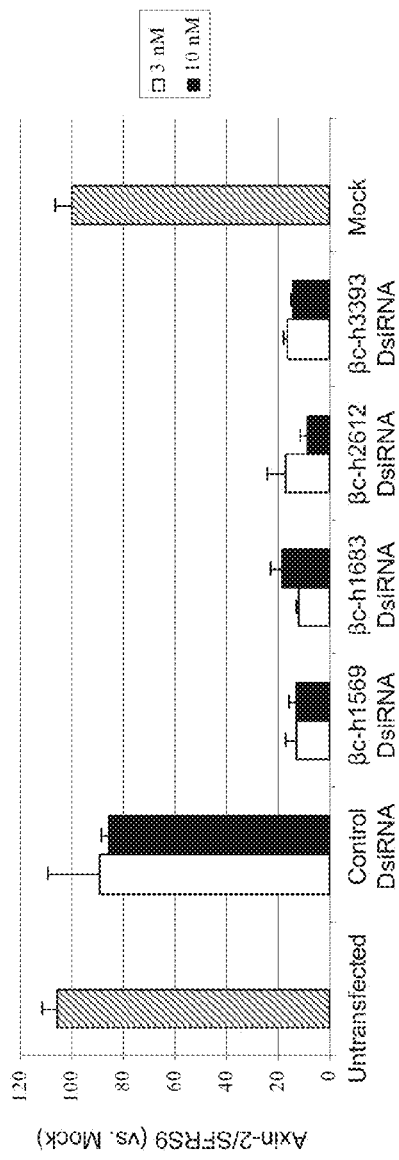
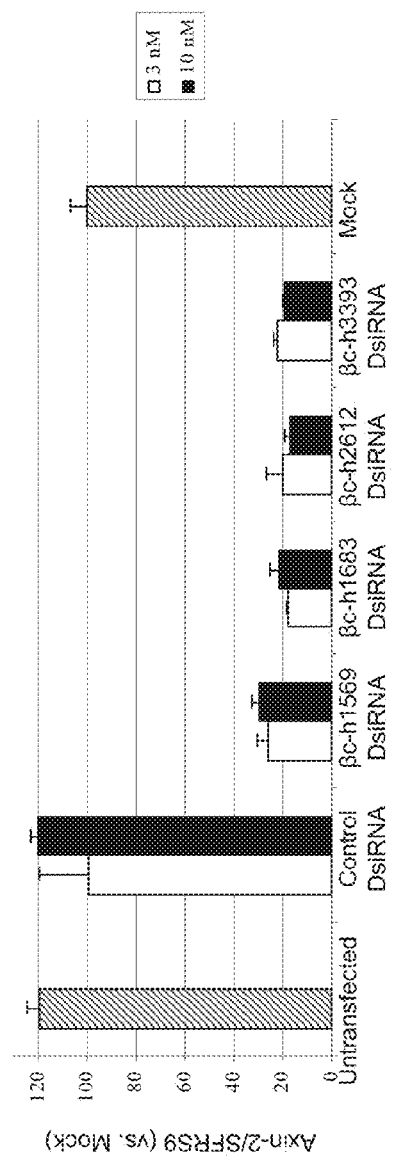

METHODS AND COMPOSITIONS FOR THE SPECIFIC INHIBITION OF BETA-CATENIN BY DOUBLE STRANDED RNA

CROSS-REFERENCE TO RELATED APPLICATIONS

The present application is a divisional of U.S. patent application Ser. No. 13/718,525, filed Dec. 18, 2012, allowed, which is a continuation of PCT international application Ser. No. PCT/US2011/042820, filed Jul. 1, 2011, designating the United States, which claims benefit under 35 U.S.C. §119(e) of U.S. provisional patent application No. 61/361,776, filed Jul. 6, 2010. The entire contents of the aforementioned patent applications are incorporated herein by this reference.

FIELD OF THE INVENTION

The present invention relates to compounds, compositions, and methods for the study, diagnosis, and treatment of traits, diseases and conditions that respond to the modulation of CTNNB1 (β-catenin) gene expression and/or activity.

BACKGROUND OF THE INVENTION

Wnt pathway signaling mediates development, regeneration, cellular proliferation and stem cell formation (Fuerer et al. *EMBO Rep* 9: 134-8). Abnormal Wnt pathway signaling has been associated with a wide range of diseases, including cancer (Moon et al. *Nat Rev Genet.* 5: 691-701). Mutations in β-catenin (encoded by the CTNNB1 gene in humans)—an oncogene that is the key mediator of Wnt signaling—have been specifically associated with colorectal, desmoid, endometrial, gastric, hepatocellular, hepatoblastoma, kidney (Wilms' tumor), medulloblastoma, melanoma, ovarian (endometrioid), pancreatic, pilomatricoma, prostate, thyroid (anaplastic) and uterine (endometrium) cancers (Polakis P. *Genes Dev.* 14: 1837-51; Samowitz et al. *Cancer Res.* 59: 1442-4; Iwao et al. *Cancer Res.* 58: 1021-6; Mirabelli-Primdahl et al. *Cancer Res.* 59: 3346-51; Shitoh et al. *J Clin Path.* 52: 695-6; Tejpar et al. *Oncogene* 18: 6615-20; Kitaeva et al. *Cancer Res.* 57: 4478-81; Sparks et al. *Cancer Res.* 58: 1130-4; Miyaki et al. *Cancer Res.* 59: 4506-9; Park et al. *Cancer Res.* 59: 4257-60; Huang et al. *Am J Pathol.* 155: 1795-801; Nhieu et al. *Am J Pathol.* 155: 703-10; Legoix et al. *Oncogene* 18: 4044-6; Jeng et al. *Cancer Lett.* 152: 45-51; Koch et al. *Cancer Res.* 59: 269-73; Wei et al. *Oncogene* 19: 498-504; Koesters et al. *Cancer Res.* 59: 3880-2; Maiti et al. *Cancer Res.* 60: 6288-92; Zurawel et al. *Cancer Res.* 58: 896-9; Gamallo et al. *Am J Pathol.* 155: 527-36; Palacios and Gamallo *Cancer Res.* 58: 1344-7; Wright et al. *Int J Cancer* 82: 625-9; Gerdes et al. *Digestion* 60: 544-8; Chan et al. *Nat. Genet.* 21: 410-3; Voeller et al. *Cancer Res.* 58: 2520-3; Garcia-Rostan et al. *Cancer Res.* 59: 1811-5; Fukuchi et al. *Cancer Res.* 58: 3526-8). Many such mutations in β-catenin are believed to impart increased stability to the β-catenin protein, making β-catenin an attractive target for development of therapeutics that inhibit and/or reduce levels of the β-catenin protein. Given the role of β-catenin in the development of cancer and other diseases and/or disorders (e.g., proper β-catenin activity is important for hair follicle/epithelial stem cell function, meaning that certain inhibitors of β-catenin possess depilatory properties), there remains an unmet need for therapeutically effective inhibitors of β-catenin.

Double-stranded RNA (dsRNA) agents possessing strand lengths of 25 to 35 nucleotides have been described as effective inhibitors of target gene expression in mammalian cells (Rossi et al., U.S. Patent Application Nos. 2005/0244858 and US 2005/0277610). dsRNA agents of such length are believed to be processed by the Dicer enzyme of the RNA interference (RNAi) pathway, leading such agents to be termed "Dicer substrate siRNA" ("DsiRNA") agents. Additional modified structures of DsiRNA agents were previously described (Rossi et al., U.S. Patent Application No. 2007/0265220).

BRIEF SUMMARY OF THE INVENTION

The present invention is directed to compositions that contain double stranded RNA ("dsRNA"), and methods for preparing them. The dsRNAs of the invention are capable of reducing the expression of a target CTNNB1 gene (encoding (β-catenin) in a cell, either in vitro or in a mammalian subject. More particularly, the invention is directed to Dicer substrate siRNAs ("DsiRNAs") with structures and modification patterns which act as effective and highly potent β-catenin inhibitory agents, and also may possess extended duration of inhibitory effect. A number of such DsiRNAs possess target-specific inhibitory potencies and efficacies that are significantly enhanced relative to 21 nucleotide siRNAs directed against the same target RNA.

In one aspect, the invention provides an isolated double stranded ribonucleic acid (dsRNA) comprising first and second nucleic acid strands and a duplex region of at least 25 base pairs, wherein the first strand is 25-34 nucleotides in length and the second strand is 26-35 nucleotides in length and comprises 1-5 single-stranded nucleotides at its 3' terminus, where the second oligonucleotide strand is sufficiently complementary to a target β-catenin cDNA sequence of SEQ ID NOs: 2226-3334 along at least 15 nucleotides of the second oligonucleotide strand length to reduce β-catenin target gene expression when the double stranded nucleic acid is introduced into a mammalian cell. Optionally, the second oligonucleotide strand is complementary to a target β-catenin cDNA sequence of SEQ ID NOs: 1-3 and 5-6 along at most 27 nucleotides of its length.

In one embodiment, starting from the first nucleotide (position 1) at the 3' terminus of the first oligonucleotide strand, position 1, 2 and/or 3 is substituted with a modified nucleotide. In certain embodiments, the modified nucleotide residue of the 3' terminus of the first strand is a deoxyribonucleotide, an acyclonucleotide or a fluorescent molecule. In a related embodiment, position 1 of the 3' terminus of the first oligonucleotide strand is a deoxyribonucleotide.

In an additional embodiment, the 3' terminus of the first strand and the 5' terminus of the second strand form a blunt end.

In another embodiment, the first strand is 25 nucleotides in length and the second strand is 27 nucleotides in length.

In one embodiment, the second strand includes a sequence of SEQ ID NOs: 1117-2225.

In another embodiment, the first strand includes a sequence of SEQ ID NOs: 8-1116, 3335-3822 and 3823-4443.

In an additional embodiment, the dsRNA includes a pair of first strand/second strand sequences as shown for a DsiRNA agent of Tables 2-4, 6, 9 or 11.

In one embodiment, each of the first and the second strands has a length which is at least 26 nucleotides.

In another embodiment, the nucleotides of the 3' overhang include a modified nucleotide. Optionally, the modified nucleotide of the 3' overhang is a 2'-O-methyl ribonucleotide. In a related embodiment, all nucleotides of the 3' overhang are modified nucleotides.

In an additional embodiment, one or both of the first and second oligonucleotide strands includes a 5' phosphate.

In another embodiment, the modified nucleotide residues of the dsRNA are 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino or 2'-O—(N-methylcarbamate).

In one embodiment, the 3' overhang of the dsRNA is 1-3 nucleotides in length. Optionally, the 3' overhang is 1-2 nucleotides in length. In a related embodiment, the 3' overhang is two nucleotides in length and the modified nucleotide of the 3' overhang is a 2'-O-methyl modified ribonucleotide.

In a further embodiment, the second oligonucleotide strand, starting from the nucleotide residue of the second strand that is complementary to the 5' terminal nucleotide residue of the first oligonucleotide strand, includes alternating modified and unmodified nucleotide residues. In another embodiment, the second oligonucleotide strand, starting from the nucleotide residue of the second strand that is complementary to the 5' terminal nucleotide residue of the first oligonucleotide strand, includes unmodified nucleotide residues at all positions from position 18 to the 5' terminus of the second oligonucleotide strand.

In another embodiment, each of the first and the second strands has a length which is at least 26 and at most 30 nucleotides.

In one embodiment, the dsRNA is cleaved endogenously in the cell by Dicer.

In an additional embodiment, the amount of the isolated double stranded nucleic acid sufficient to reduce expression of the target gene is 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less in the environment of the cell.

In a further embodiment, the isolated dsRNA possesses greater potency than isolated 21mer siRNAs directed to the identical at least 15 nucleotides of the target β-catenin cDNA in reducing target β-catenin gene expression when assayed in vitro in a mammalian cell at an effective concentration in the environment of a cell of 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less.

In another embodiment, the isolated dsRNA is sufficiently complementary to the target β-catenin cDNA sequence to reduce β-catenin target gene expression by at least 10%, at least 50%, at least 80-90%, at least 95%, at least 98%, or at least 99% when the double stranded nucleic acid is introduced into a mammalian cell.

In a further embodiment, the first and second strands are joined by a chemical linker. In a related embodiment, the 3' terminus of the first strand and the 5' terminus of the second strand are joined by a chemical linker.

In one embodiment, a nucleotide of the second or first strand is substituted with a modified nucleotide that directs the orientation of Dicer cleavage.

In another embodiment, the dsRNA has a modified nucleotide that is a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, or a locked nucleic acid.

In an additional embodiment, the dsRNA has a phosphonate, a phosphorothioate or a phosphotriesterphosphate backbone modification.

In one embodiment, the invention provides a method for reducing expression of a target β-catenin gene in a mammalian cell having contacting a mammalian cell in vitro with an isolated dsRNA as described in an amount sufficient to reduce expression of a target β-catenin gene in the cell.

In one embodiment, target β-catenin gene expression is reduced by at least 10%, at least 50%, or at least 80-90%. In another embodiment, target β-catenin mRNA levels are reduced at least 90% at least 8 days after the cell is contacted with the dsRNA. In a further embodiment, β-catenin mRNA levels are reduced by at least 70% at least 10 days after the cell is contacted with the dsRNA.

In a further embodiment, the invention provides a method for reducing expression of a target β-catenin gene in a mammal by administering an isolated dsRNA as described to a mammal in an amount sufficient to reduce expression of a target β-catenin gene in the mammal.

In one embodiment, the isolated dsRNA is administered at a dosage of 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In another embodiment, the isolated dsRNA possesses greater potency than isolated 21mer siRNAs directed to the identical at least 15 nucleotides of the target β-catenin cDNA in reducing target β-catenin gene expression when assayed in vitro in a mammalian cell at an effective concentration in the environment of a cell of 1 nanomolar or less.

In an additional embodiment, the administering step includes intravenous injection, intramuscular injection, intraperitoneal injection, infusion, subcutaneous injection, transdermal, aerosol, rectal, vaginal, topical, oral or inhaled delivery.

In a further embodiment, the invention provides a method for selectively inhibiting the growth of a cell by contacting a cell with an amount of an isolated dsRNA as described, in an amount sufficient to inhibit the growth of the cell.

In one embodiment, the cell is a tumor cell of a subject. Optionally, the cell is a tumor cell in vitro. In a related embodiment, the cell is a human cell.

In an additional embodiment, the invention provides a formulation which includes an isolated dsRNA as described, where the dsRNA is present in an amount effective to reduce target β-catenin RNA levels when the dsRNA is introduced into a mammalian cell in vitro by at least 10%, at least 50% or at least 80-90%, and where the dsRNA possesses greater potency than isolated 21mer siRNAs directed to the identical at least 15 nucleotides of the target β-catenin cDNA in reducing target 3-catenin RNA levels when assayed in vitro in a mammalian cell at an effective concentration in the environment of a cell of 1 nanomolar or less.

In one embodiment, the effective amount is 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less in the environment of the cell.

In another embodiment, the invention provides a formulation which includes an isolated dsRNA as described, where the dsRNA is present in an amount effective to reduce target RNA levels when the dsRNA is introduced into a cell of a mammalian subject by at least 10%, at least 50% or at least 80-90%, and where the dsRNA possesses greater potency than isolated 21mer siRNAs directed to the identical at least 15 nucleotides of the target β-catenin cDNA in reducing target β-catenin RNA levels when assayed in vitro in a mammalian cell at an effective concentration in the environment of a cell of 1 nanomolar or less.

In one embodiment, the effective amount is a dosage of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In an additional embodiment, the invention provides a mammalian cell containing an isolated dsRNA as described.

Another embodiment of the invention provides a pharmaceutical composition which includes an isolated dsRNA as described and a pharmaceutically acceptable carrier. A further embodiment of the invention provides a kit having an isolated dsRNA as described and instructions for its use.

In an additional aspect, the invention provides a composition possessing β-catenin inhibitory activity consisting essentially of an isolated double stranded ribonucleic acid (dsRNA) comprising first and second nucleic acid strands and a duplex region of at least 25 base pairs, where the first strand is 25-34 nucleotides in length and the second strand is 26-35 nucleotides in length and comprises 1-5 single-stranded nucleotides at its 3' terminus, where the second oligonucleotide strand is sufficiently complementary to a target β-catenin cDNA sequence of SEQ ID NOs: 2226-3334 along at least 15 nucleotides of the second oligonucleotide strand length to reduce β-catenin target gene expression when the double stranded nucleic acid is introduced into a mammalian cell.

In another embodiment, the invention provides a method for treating or preventing a β-catenin-associated disease or disorder in a subject by administering a dsRNA and/or dsRNA-containing composition of the invention and a pharmaceutically acceptable carrier to a subject in an amount sufficient to treat or prevent a β-catenin-associated disease or disorder in the subject. In a related embodiment, the β-catenin-associated disease or disorder is colorectal or hepatocellular cancer. Optionally, the β-catenin-associated disease or disorder is melanoma.

In another aspect, the invention provides an isolated double stranded ribonucleic acid (dsRNA) comprising first and second nucleic acid strands and a duplex region of at least 25 base pairs, wherein the dsRNA comprises blunt ends, where each of the first and second oligonucleotide strands consists of the same number of nucleotide residues and is at most 35 nucleotides in length, wherein the second oligonucleotide strand is sufficiently complementary to a target β-catenin cDNA sequence of SEQ ID NOs: 2226-3334 along at least 15 nucleotides of the second oligonucleotide strand length to reduce β-catenin target gene expression when the double stranded nucleic acid is introduced into a mammalian cell.

In one embodiment, the dsRNA is capable of reducing target gene expression at a concentration of less than 1 nanomolar in the environment of a cell. In another embodiment, each of the first and the second strands has a length which is at least 26 nucleotides. In a related embodiment, each of the first and the second strands has a length which is 26-30 nucleotides. Optionally, each of the first and the second strands has a length which is 27 nucleotides.

In certain embodiments, the second strand of the dsRNA includes a sequence selected from SEQ ID NOs: 1117-2225. (Optionally, the second strand is a sequence selected from SEQ ID NOs: 1117-2225.) In related embodiments, the first strand of the dsRNA includes a sequence selected from SEQ ID NOs: 5553-7770. (Optionally, the first strand is a sequence selected from SEQ ID NOs: 5553-7770.) In a further embodiment, the dsRNA includes a pair of first strand and corresponding second strand sequences selected from Tables 7-8 or 12-13.

Another aspect of the invention provides an isolated double stranded ribonucleic acid (dsRNA) comprising first and second nucleic acid strands and a duplex region of at least 25 base pairs, where the dsRNA comprises a blunt end, where each of the first and second oligonucleotide strands consists of the same number of nucleotide residues and is at most 35 nucleotides in length, where the ultimate and penultimate residues of the 3' terminus of the first strand and the ultimate and penultimate residues of said 5' terminus of the second strand form one or two mismatched based pairs. where the second oligonucleotide strand is sufficiently complementary to a target β-catenin cDNA sequence of SEQ ID NOs: 2226-3334 along at least 15 nucleotides of the second oligonucleotide strand length to reduce (3-catenin target gene expression when the double stranded nucleic acid is introduced into a mammalian cell.

In one embodiment, the first strand includes a sequence of SEQ ID NOs: 5553-6661.

In an additional aspect, the invention provides a composition possessing β-catenin inhibitory activity consisting essentially of an isolated double stranded ribonucleic acid (dsRNA) comprising first and second nucleic acid strands and a duplex region of at least 25 base pairs, where the dsRNA comprises blunt ends, where each of the first and second oligonucleotide strands consists of the same number of nucleotide residues and is at most 35 nucleotides in length, where the second oligonucleotide strand is sufficiently complementary to a target β-catenin cDNA sequence of SEQ ID NOs: 2226-3334 along at least 15 nucleotides of the second oligonucleotide strand length to reduce β-catenin target gene expression when the double stranded nucleic acid is introduced into a mammalian cell and the second oligonucleotide strand is complementary to a target β-catenin cDNA sequence of SEQ ID NOs: 1-3 and 5-6 along at most 35 nucleotides of its length.

In another aspect, the invention provides an isolated dsRNA molecule consisting of a sense region and an antisense region, where the sense region and the antisense region together form a duplex region consisting of 19-35 base pairs and the antisense region includes a sequence that is the complement of a sequence of SEQ ID NOs 4444-5552, and the isolated dsRNA further includes from zero to two 3' overhang regions where each overhang region is six or fewer nucleotides in length. Optionally, the duplex region consists of 25-35 base pairs. In a further aspect, the invention provides a siRNA molecule consisting of a sense region and an antisense region, where the sense region and the antisense region together form a duplex region consisting of 19-23 base pairs and the antisense region includes a sequence that is the complement of a sequence of SEQ ID NOs 4444-5552, and the isolated dsRNA further includes from zero to four overhang regions, where each overhang region is six or fewer nucleotides in length.

In a further aspect, the invention provides an isolated double stranded ribonucleic acid (dsRNA) comprising first and second nucleic acid strands, wherein the first strand is 15-35 nucleotides in length and the second strand is 19-35 nucleotides in length, wherein the second oligonucleotide strand is sufficiently complementary to a target β-catenin cDNA sequence of Table 18 along at least 19 nucleotides of the second oligonucleotide strand length to reduce β-catenin target gene expression when the double stranded nucleic acid is introduced into a mammalian cell. In certain embodiments, the isolated dsRNA possesses a duplex region of at least 25 base pairs. In one embodiment, the second strand of the isolated dsRNA includes a one to five nucleotide single stranded overhang of the first strand at the 3' terminus of the second strand. In another embodiment, the first strand is 25-35 nucleotides in length. In an additional embodiment, the second strand is 25-35 nucleotides in length. Optionally, the second oligonucleotide strand is complementary to a target β-catenin cDNA sequence of GenBank Accession Nos. NM_001904.3, NM_001098209.1 or NM_001098210.1 along at most 27 nucleotides of the second oligonucleotide strand length.

In one embodiment, starting from the first nucleotide (position 1) at the 3' terminus of the first oligonucleotide strand, position 1, 2 and/or 3 is substituted with a modified nucleotide. In certain embodiments, the modified nucleotide residue of the 3' terminus of the first strand is a deoxyribonucleotide, an acyclonucleotide or a fluorescent molecule. In a related embodiment, position 1 of the 3' terminus of the first oligonucleotide strand is a deoxyribonucleotide.

In an additional embodiment, the 3' terminus of the first strand and the 5' terminus of the second strand form a blunt end.

In another embodiment, the first strand is 25 nucleotides in length and the second strand is 27 nucleotides in length.

In one embodiment, the second strand includes a sequence of SEQ ID NOs: 1122, 1126, 1216, 1239, 1282, 1368, 1165, 1509, 1536 and 1552.

In another embodiment, the first strand includes a sequence of SEQ ID NOs: 13, 17, 107, 130, 173, 259, 56, 400, 427 and 443.

In an additional embodiment, the dsRNA includes a pair of first strand/second strand sequences as shown for a DsiRNA agent of Tables 2-3, 6-9 and 11-13.

In one embodiment, each of the first and the second strands has a length which is at least 26 nucleotides.

In another embodiment, the nucleotides of the 3' overhang include a modified nucleotide. Optionally, the modified nucleotide of the 3' overhang is a 2'-O-methyl ribonucleotide. In a related embodiment, all nucleotides of the 3' overhang are modified nucleotides.

In an additional embodiment, one or both of the first and second oligonucleotide strands includes a 5' phosphate.

In another embodiment, the modified nucleotide residues of the dsRNA are 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino or 2'-O—(N-methlycarbamate).

In one embodiment, the 3' overhang of the dsRNA is 1-3 nucleotides in length. Optionally, the 3' overhang is 1-2 nucleotides in length. In a related embodiment, the 3' overhang is two nucleotides in length and the modified nucleotide of the 3' overhang is a 2'-O-methyl modified ribonucleotide.

In a further embodiment, the second oligonucleotide strand, starting from the nucleotide residue of the second strand that is complementary to the 5' terminal nucleotide residue of the first oligonucleotide strand, includes alternating modified and unmodified nucleotide residues. In another embodiment, the second oligonucleotide strand, starting from the nucleotide residue of the second strand that is complementary to the 5' terminal nucleotide residue of the first oligonucleotide strand, includes unmodified nucleotide residues at all positions from position 18 to the 5' terminus of the second oligonucleotide strand.

In another embodiment, each of the first and the second strands has a length which is at least 26 and at most 30 nucleotides.

In one embodiment, the dsRNA is cleaved endogenously in the cell by Dicer.

In an additional embodiment, the amount of the isolated double stranded nucleic acid sufficient to reduce expression of the target gene is 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less in the environment of the cell.

In a further embodiment, the isolated dsRNA possesses greater potency than isolated 21mer siRNAs directed to the identical at least 19 nucleotides of the target β-catenin cDNA in reducing target β-catenin gene expression when assayed in vitro in a mammalian cell at an effective concentration in the environment of a cell of 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less.

In another embodiment, the isolated dsRNA is sufficiently complementary to the target β-catenin cDNA sequence to reduce β-catenin target gene expression by at least 10%, at least 50%, at least 80-90%, at least 95%, at least 98%, or at least 99% when the double stranded nucleic acid is introduced into a mammalian cell.

In a further embodiment, the first and second strands are joined by a chemical linker. In a related embodiment, the 3' terminus of the first strand and the 5' terminus of the second strand are joined by a chemical linker.

In one embodiment, a nucleotide of the second or first strand is substituted with a modified nucleotide that directs the orientation of Dicer cleavage.

In another embodiment, the dsRNA has a modified nucleotide that is a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, or a locked nucleic acid.

In an additional embodiment, the dsRNA has a phosphonate, a phosphorothioate or a phosphotriesterphosphate backbone modification.

In a further embodiment, the dsRNA contains a morpholino nucleic acid or oligonucleotide, or a peptide nucleic acid (PNA).

In one embodiment, the invention provides a method for reducing expression of a target β-catenin gene in a mammalian cell having contacting a mammalian cell in vitro with an isolated dsRNA as described in an amount sufficient to reduce expression of a target β-catenin gene in the cell.

In one embodiment, target β-catenin gene expression is reduced by at least 10%, at least 50%, or at least 80-90%. In another embodiment, target β-catenin mRNA levels are reduced at least 90% at least 8 days after the cell is contacted with the dsRNA. In a further embodiment, β-catenin mRNA levels are reduced by at least 70% at least 10 days after the cell is contacted with the dsRNA.

In a further embodiment, the invention provides a method for reducing expression of a target β-catenin gene in a mammal by administering an isolated dsRNA as described to a mammal in an amount sufficient to reduce expression of a target β-catenin gene in the mammal.

In one embodiment, the isolated dsRNA is administered at a dosage of 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In another embodiment, the isolated dsRNA possesses greater potency than isolated 21mer siRNAs directed to the identical at least 19 nucleotides of the target β-catenin cDNA in reducing target β-catenin gene expression when assayed in vitro in a mammalian cell at an effective concentration in the environment of a cell of 1 nanomolar or less.

In an additional embodiment, the administering step includes intravenous injection, intramuscular injection, intraperitoneal injection, infusion, subcutaneous injection, transdermal, aerosol, rectal, vaginal, topical, oral or inhaled delivery.

In a further embodiment, the invention provides a method for selectively inhibiting the growth of a cell by contacting a cell with an amount of an isolated dsRNA as described, in an amount sufficient to inhibit the growth of the cell.

In one embodiment, the cell is a tumor cell of a subject. Optionally, the cell is a tumor cell in vitro, e.g., a hepatocellular (e.g., HepG2 or HuH7) or colorectal (e.g., HCT116) cancer cell, or a HeLa or other cancer cell. In certain embodiments, the cell is a mammalian liver cell. In a related embodiment, the cell is a human cell.

In an additional embodiment, the invention provides a formulation which includes an isolated dsRNA as described, where the dsRNA is present in an amount effective to reduce target β-catenin RNA levels when the dsRNA is introduced into a mammalian cell in vitro by at least 10%, at least 50% or at least 80-90%, and where the dsRNA possesses greater potency than isolated 21mer siRNAs directed to the identical at least 19 nucleotides of the target β-catenin cDNA in reducing target (3-catenin RNA levels when assayed in vitro in a mammalian cell at an effective concentration in the environment of a cell of 1 nanomolar or less.

In one embodiment, the effective amount is 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less in the environment of the cell.

In another embodiment, the invention provides a formulation which includes an isolated dsRNA as described, where the dsRNA is present in an amount effective to reduce target RNA levels when the dsRNA is introduced into a cell of a mammalian subject by at least 10%, at least 50% or at least 80-90%, and where the dsRNA possesses greater potency than isolated 21mer siRNAs directed to the identical at least 19 nucleotides of the target β-catenin cDNA in reducing target 3-catenin RNA levels when assayed in vitro in a mammalian cell at an effective concentration in the environment of a cell of 1 nanomolar or less.

In one embodiment, the effective amount is a dosage of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In an additional embodiment, the invention provides a mammalian cell containing an isolated dsRNA as described.

Another embodiment of the invention provides a pharmaceutical composition which includes an isolated dsRNA as described and a pharmaceutically acceptable carrier. A further embodiment of the invention provides a kit having an isolated dsRNA as described and instructions for its use.

In an additional aspect, the invention provides a composition possessing 3-catenin inhibitory activity consisting essentially of an isolated double stranded ribonucleic acid (dsRNA) comprising first and second nucleic acid strands, wherein the first strand is 15-35 nucleotides in length and the second strand is 19-35 nucleotides in length, wherein the second oligonucleotide strand is sufficiently complementary to a target β-catenin cDNA sequence of Table 18 along at least 19 nucleotides of the second oligonucleotide strand length to reduce β-catenin target gene expression when the double stranded nucleic acid is introduced into a mammalian cell.

In another embodiment, the invention provides a method for treating or preventing a β-catenin-associated disease or disorder in a subject by administering a dsRNA and/or dsRNA-containing composition of the invention and a pharmaceutically acceptable carrier to a subject in an amount sufficient to treat or prevent a β-catenin-associated disease or disorder in the subject. In a related embodiment, the β-catenin-associated disease or disorder is hepatocellular or colorectal cancer, or, optionally, renal, breast, lung, ovarian, cervical, esophageal, oropharyngeal or pancreatic cancer.

In another aspect, the invention provides an isolated double stranded ribonucleic acid (dsRNA) comprising first and second nucleic acid strands, wherein the dsRNA comprises blunt ends, wherein each of the first and second oligonucleotide strands consists of the same number of nucleotide residues and is at most 35 nucleotides in length, wherein the second oligonucleotide strand is sufficiently complementary to a target β-catenin cDNA sequence of Table 18 along at least 19 nucleotides of the second oligonucleotide strand length to reduce β-catenin target gene expression when the double stranded nucleic acid is introduced into a mammalian cell.

In one embodiment, the dsRNA is capable of reducing target gene expression at a concentration of less than 1 nanomolar in the environment of a cell. In another embodiment, each of the first and the second strands has a length which is at least 26 nucleotides. In a related embodiment, each of the first and the second strands has a length which is 26-30 nucleotides. Optionally, each of the first and the second strands has a length which is 27 nucleotides.

In certain embodiments, the second strand of the dsRNA includes a sequence selected from SEQ ID NOs: 1122, 1126, 1216, 1239, 1282, 1368, 1165, 1509, 1536 and 1552. In related embodiments, the first strand of the dsRNA includes a sequence selected from SEQ ID NOs: 6667, 6671, 6761, 6784, 6827, 6913, 6710, 7054, 7081 and 7097. In a further embodiment, the dsRNA includes a pair of first strand and corresponding second strand sequences selected from Tables 2-3, 6-9 and 11-13.

Another aspect of the invention provides an isolated double stranded ribonucleic acid (dsRNA) comprising first and second nucleic acid strands, wherein the dsRNA comprises a blunt end, wherein each of the first and second oligonucleotide strands consists of the same number of nucleotide residues and is at most 35 nucleotides in length, wherein the ultimate and penultimate residues of the 3' terminus of the first strand and the ultimate and penultimate residues of said 5' terminus of the second strand form one or two mismatched based pairs, wherein the second oligonucleotide strand is sufficiently complementary to a target β-catenin cDNA sequence of Table 18 along at least 19 nucleotides of the second oligonucleotide strand length to reduce β-catenin target gene expression when the double stranded nucleic acid is introduced into a mammalian cell.

In one embodiment, the first strand includes a sequence of SEQ ID NOs: 5558, 5562, 5652, 5675, 5718, 5804, 5601, 5945, 5972 and 5988.

In an additional aspect, the invention provides a composition possessing β-catenin inhibitory activity consisting essentially of an isolated double stranded ribonucleic acid (dsRNA) comprising first and second nucleic acid strands, wherein the dsRNA comprises blunt ends, wherein each of the first and second oligonucleotide strands consists of the same number of nucleotide residues and is at most 35 nucleotides in length, wherein the second oligonucleotide strand is sufficiently complementary to a target β-catenin cDNA sequence of Table 18 along at least 19 nucleotides of the second oligonucleotide strand length to reduce β-catenin target gene expression when the double stranded nucleic acid is introduced into a mammalian cell.

In another aspect, the invention provides an isolated dsRNA molecule consisting of a sense region and an antisense region, where the sense region and the antisense region together form a duplex region consisting of 15-35 base pairs and the antisense region includes a sequence that is the complement of a sequence of Table 18, and the isolated dsRNA further includes from zero to two 3' overhang regions where each overhang region is six or fewer nucleotides in length. Optionally, the duplex region consists of 19-35 base pairs. In certain embodiments, the duplex region consists of 25-35 base pairs. In additional embodiments, the duplex region consists of 25-30 base pairs.

In a further aspect, the invention provides a siRNA molecule consisting of a sense region and an antisense region, where the sense region and the antisense region together form a duplex region consisting of 19-23 base pairs and the antisense region includes a sequence that is the complement of a sequence of Table 18, and the isolated dsRNA further includes from zero to four overhang regions, where each overhang region is six or fewer nucleotides in length.

In certain aspects, the invention is directed to Dicer substrate siRNAs ("DsiRNAs") with structures and modification patterns that act as effective and highly potent β-catenin inhibitory agents, optionally possessing extended duration of inhibitory effect. A number of such DsiRNAs possess target-specific inhibitory potencies and efficacies that are significantly enhanced relative to 19-23 base pair double stranded nucleic acids (e.g., 21 nucleotide siRNAs) directed against the same target RNA. In certain such embodiments, such a DsiRNA is more potent at reducing β-catenin target gene expression in a mammalian cell than a 19, 20, 21, 22 or 23 base pair sequence that is contained within it, when suitably formulated at a concentration of 1 nM or less.

The present invention is also directed to compounds, compositions, and methods relating to traits, diseases and conditions that respond to the modulation of expression and/or activity of genes involved in CTNNB1 gene expression pathways or other cellular processes that mediate the maintenance or development of such traits, diseases and conditions. Specifically, the invention relates to small nucleic acid molecules that are capable of being processed by the Dicer enzyme, such as Dicer substrate siRNAs (DsiRNAs) capable of mediating RNA interference (RNAi) against CTNNB1 (β-catenin) gene expression. Such anti-β-catenin DsiRNAs are useful, for example, in providing compositions for treatment of traits, diseases and conditions that can respond to modulation of β-catenin in a subject, such as cancer and/or other proliferative diseases, disorders, or conditions. Efficacy, potency, toxicity and other effects of an anti-β-catenin DsiRNA can be examined in one or more animal models of proliferative disease (exemplary suitable animal models of proliferative disease are recited below).

BRIEF DESCRIPTION OF THE DRAWINGS

FIGS. 8-11 show histograms of human β-catenin inhibitory efficacies observed for indicated DsiRNAs. "P1" indicates phase 1, while "P2" indicates phase 2. In phase 1, DsiRNAs were tested at 1 nM in the environment of HeLa cells. In phase 2, DsiRNAs were tested at 1 nM, at 0.3 nM and at 0.1 nM in the environment of HeLa cells. Individual bars represent average human β-catenin levels observed in triplicate, with standard errors shown. Human β-catenin levels were normalized to HPRT and SFRS9 levels. Expression levels were assayed with probe amplicons positioned at both positions 1297-1397 and 3506-3659 in Hs CTNNB1. (It is noted that the histograms of FIG. 8 reflect phase 2 values obtained for a subpar transfection.)

FIG. 25 shows that assayed DsiRNAs targeting human β-catenin (βcat-h1569, βcat-h1683, βcat-h2612 and βcat-h3393) effectively inhibited expression of Axin-2, a downstream target of β-catenin, in both HCT116 (colon carcinoma) and HepG2 (hepatocellular carcinoma) cell lines. Cells were assayed at two days post-transfection at indicated concentrations (3 nM and 10 nM) with designated DsiRNAs.

DETAILED DESCRIPTION OF THE INVENTION

Figure 1:
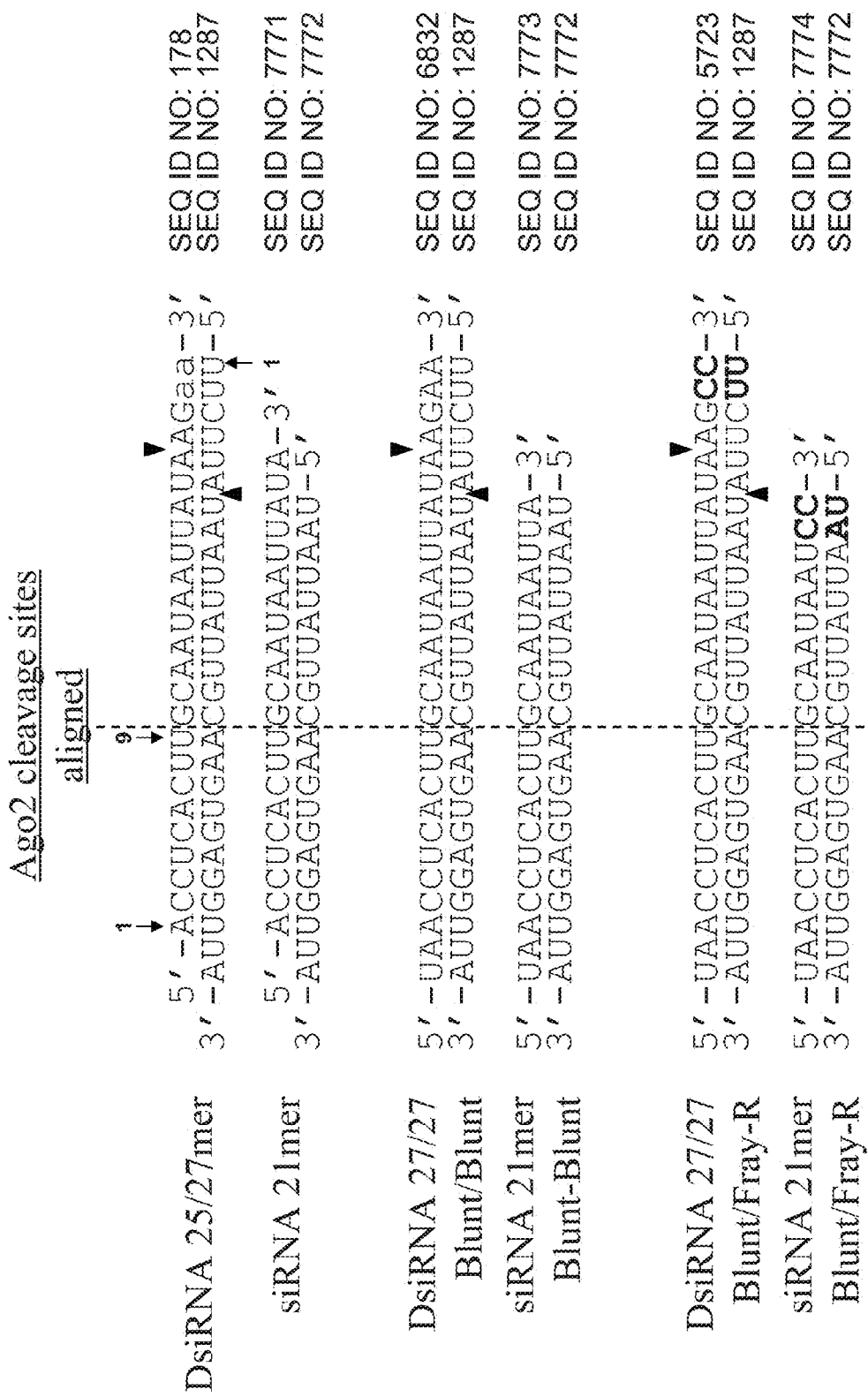
FIG. 1 shows the structures of exemplary DsiRNA agents targeting a site in the β-catenin RNA referred to herein as the "βc-1569" target site. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted β-catenin sequence.

The present invention is directed to compositions that contain double stranded RNA ("dsRNA"), and methods for preparing them, that are capable of reducing the level and/or expression of the β-catenin gene in vivo or in vitro. One of the strands of the dsRNA contains a region of nucleotide sequence that has a length that ranges from 19 to 35 nucleotides that can direct the destruction and/or translational inhibition of the targeted β-catenin transcript.

DEFINITIONS

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

The present invention features one or more DsiRNA molecules that can modulate (e.g., inhibit) β-catenin expression. The DsiRNAs of the invention optionally can be used in combination with modulators of other genes and/or gene products associated with the maintenance or development of diseases or disorders associated with β-catenin misregulation (e.g., tumor formation and/or growth, etc.). The DsiRNA agents of the invention modulate β-catenin RNAs such as those corresponding to the cDNA sequences referred to by GenBank Accession Nos. NM_001904.3 (human β-catenin, transcript variant 1), NM_001098209.1 (human β-catenin, transcript variant 2), NM_001098210.1 (human β-catenin, transcript variant 3) and NM_007614.2 & NM_007614.3 (mouse β-catenin), which are recited below and referred to herein generally as "β-catenin."

The below description of the various aspects and embodiments of the invention is provided with reference to exemplary β-catenin RNAs, generally referred to herein as β-catenin. However, such reference is meant to be exemplary only and the various aspects and embodiments of the invention are also directed to alternate β-catenin RNAs, such as mutant β-catenin RNAs or additional β-catenin splice variants. Certain aspects and embodiments are also directed to other genes involved in β-catenin pathways, including genes whose misregulation acts in association with that of β-catenin (or is affected or affects (β-catenin regulation) to produce phenotypic effects that may be targeted for treatment (e.g., tumor formation and/or growth, etc.). Such additional genes can be targeted using DsiRNA and the methods described herein for use of β-catenin targeting DsiRNAs. Thus, the inhibition and the effects of such inhibition of the other genes can be performed as described herein.

The terms "β-catenin" and "CTNNB1" refer to nucleic acid sequences encoding a β-catenin protein, peptide, or polypeptide (e.g., β-catenin transcripts, such as the sequences of β-catenin Genbank Accession Nos. NM_001904.3, NM_001098209.1, NM_001098210.1, NM_007614.2 and NM_007614.3). In certain embodiments, the term "β-catenin" is also meant to include other β-catenin encoding sequence, such as other β-catenin isoforms, mutant β-catenin genes, splice variants of β-catenin genes, and β-catenin gene polymorphisms. The term "β-catenin" is used to refer to the polypeptide gene product of a β-catenin gene/transcript, e.g., a β-catenin protein, peptide, or polypeptide, such as those encoded by β-catenin Genbank Accession Nos. NM_001904.3, NM_001098209.1, NM_001098210.1, NM_007614.2 and NM_007614.3.

As used herein, a "β-catenin-associated disease or disorder" refers to a disease or disorder known in the art to be associated with altered β-catenin expression, level and/or activity. Notably, a "β-catenin-associated disease or disorder" includes cancer and/or proliferative diseases, conditions, or disorders. Two exemplary "β-catenin-associated diseases or disorders" are colorectal cancer and melanoma.

By "proliferative disease" or "cancer" as used herein is meant, a disease, condition, trait, genotype or phenotype characterized by unregulated cell growth or replication as is known in the art; including leukemias, for example, acute myelogenous leukemia (AML), chronic myelogenous leukemia (CML), acute lymphocytic leukemia (ALL), and chronic lymphocytic leukemia, AIDS related cancers such as Kaposi's sarcoma; breast cancers; bone cancers such as Osteosarcoma, Chondrosarcomas, Ewing's sarcoma, Fibrosarcomas, Giant cell tumors, Adamantinomas, and Chordomas; Brain cancers such as Meningiomas, Glioblastomas, Lower-Grade Astrocytomas, Oligodendrocytomas, Pituitary Tumors, Schwannomas, and Metastatic brain cancers; cancers of the head and neck including various lymphomas such as mantle cell lymphoma, non-Hodgkins lymphoma, adenoma, squamous cell carcinoma, laryngeal carcinoma, gallbladder and bile duct cancers, cancers of the retina such as retinoblastoma, cancers of the esophagus, gastric cancers, multiple myeloma, ovarian cancer, uterine cancer, thyroid cancer, testicular cancer, endometrial cancer, melanoma, colorectal cancer, lung cancer, bladder cancer, prostate cancer, lung cancer (including non-small cell lung carcinoma), pancreatic cancer, sarcomas, Wilms' tumor, cervical cancer, head and neck cancer, skin cancers, nasopharyngeal carcinoma, liposarcoma, epithelial carcinoma, renal cell carcinoma, gallbladder adeno carcinoma, parotid adenocarcinoma, endometrial sarcoma, multidrug resistant cancers; and proliferative diseases and conditions, such as neovascularization associated with tumor angiogenesis, macular degeneration (e.g., wet/dry AMD), corneal neovascularization, diabetic retinopathy, neovascular glaucoma, myopic degeneration and other proliferative diseases and conditions such as restenosis and polycystic kidney disease, and other cancer or proliferative disease, condition, trait, genotype or phenotype that can respond to the modulation of disease related gene expression in a cell or tissue, alone or in combination with other therapies.

In certain embodiments, dsRNA-mediated inhibition of a β-catenin target sequence is assessed. In such embodiments, β-catenin RNA levels can be assessed by art-recognized methods (e.g., RT-PCR, Northern blot, expression array, etc.), optionally via comparison of β-catenin levels in the presence of an anti-β-catenin dsRNA of the invention relative to the absence of such an anti-β-catenin dsRNA. In certain embodiments, β-catenin levels in the presence of an anti-β-catenin dsRNA are compared to those observed in the presence of vehicle alone, in the presence of a dsRNA directed against an unrelated target RNA, or in the absence of any treatment.

It is also recognized that levels of β-catenin protein can be assessed as indicative of β-catenin RNA levels, but only to the extent that it is known, under a given set of cellular and/or tissue conditions, whether the level of β-catenin protein is directly or indirectly related to β-catenin RNA levels and/or the extent to which a dsRNA inhibits β-catenin expression, thus art-recognized methods of assessing β-catenin protein levels (e.g., Western blot, immunoprecipitation, other antibody-based methods, etc.) can also be employed to examine the inhibitory effect of a dsRNA of the invention.

An anti-β-catenin dsRNA of the invention is deemed to possess "β-catenin inhibitory activity" if a statistically significant reduction in β-catenin RNA level is seen when an anti-β-catenin dsRNA of the invention is administered to a system (e.g., cell-free in vitro system), cell, tissue or organism, as compared to a selected control. The distribution of experimental values and the number of replicate assays performed will tend to dictate the parameters of what levels of reduction in β-catenin RNA (either as a % or in absolute terms) is deemed statistically significant (as assessed by standard methods of determining statistical significance known in the art). However, in certain embodiments, "β-catenin inhibitory activity" is defined based upon a % or absolute level of reduction in the level of β-catenin mRNA in a system, cell, tissue or organism. For example, in certain embodiments, a DsiRNA of the invention is deemed to possess β-catenin inhibitory activity if at least a 5% reduction or at least a 10% reduction in β-catenin RNA is observed in the presence of a DsiRNA of the invention relative to β-catenin mRNA levels seen for a suitable control. (For example, in vivo β-catenin levels in a tissue and/or subject can, in certain embodiments, be deemed to be inhibited by a DsiRNA agent of the invention if, e.g., a 5% or 10% reduction in (β-catenin levels is observed relative to a control.) In certain other embodiments, a DsiRNA of the invention is deemed to possess β-catenin inhibitory activity if β-catenin RNA levels are observed to be reduced by at least 15% relative to a selected control, by at least 20% relative to a selected control, by at least 25% relative to a selected control, by at least 30% relative to a selected control, by at least 35% relative to a selected control, by at least 40% relative to a selected control, by at least 45% relative to a selected control, by at least 50% relative to a selected control, by at least 55% relative to a selected control, by at least 60% relative to a selected control, by at least 65% relative to a selected control, by at least 70% relative to a selected control, by at least 75% relative to a selected control, by at least 80% relative to a selected control, by at least 85% relative to a selected control, by at least 90% relative to a selected control, by at least 95% relative to a selected control, by at least 96% relative to a selected control, by at least 97% relative to a selected control, by at least 98% relative to a selected control or by at least 99% relative to a selected control. In some embodiments, complete inhibition of β-catenin is required for a DsiRNA to be deemed to possess β-catenin inhibitory activity. In certain models (e.g., cell culture), a DsiRNA is deemed to possess β-catenin inhibitory activity if at least a 50% reduction in β-catenin levels is observed relative to a suitable control. In certain other embodiments, a DsiRNA is deemed to possess β-catenin inhibitory activity if at least an 80% reduction in β-catenin levels is observed relative to a suitable control.

By way of specific example, in the Examples below, a series of DsiRNAs targeting β-catenin were tested for the ability to reduce β-catenin mRNA levels in human HeLa or mouse Hepa 1-6 cells in vitro, at 1 nM concentrations in the environment of such cells and in the presence of a transfection agent (Lipofectamine™ RNAiMAX, Invitrogen). Within the below Examples, β-catenin inhibitory activity was initially ascribed to those DsiRNAs that were observed to effect at least a 70% reduction of β-catenin mRNA levels under the assayed conditions. It is contemplated that β-catenin inhibitory activity could also be attributed to a dsRNA under either more or less stringent conditions than those employed for the Examples below, even when the same or a similar assay and conditions are employed. For example, in certain embodiments, a tested dsRNA of the invention is deemed to possess β-catenin inhibitory activity if at least a 10% reduction, at least a 20% reduction, at least a 30% reduction, at least a 40% reduction, at least a 50% reduction, at least a 60% reduction, at least a 75% reduction, at least an 80% reduction, at least an 85% reduction, at least a 90% reduction, or at least a 95% reduction in β-catenin mRNA levels is observed in a mammalian cell line in vitro at 1 nM dsRNA concentration or lower in the environment of a cell, relative to a suitable control.

Use of other endpoints for determination of whether a double stranded RNA of the invention possesses β-catenin inhibitory activity is also contemplated. Specifically, in one embodiment, in addition to or as an alternative to assessing β-catenin mRNA levels, the ability of a tested dsRNA to reduce β-catenin protein levels (e.g., at 48 hours after contacting a mammalian cell in vitro or in vivo) is assessed, and a tested dsRNA is deemed to possess β-catenin inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in β-catenin protein levels is observed in a mammalian cell contacted with the assayed double stranded RNA in vitro or in vivo, relative to a suitable control. Additional endpoints contemplated include, e.g., assessment of a phenotype associated with reduction of β-catenin levels— e.g., reduction of growth of a contacted mammalian cell line in vitro and/or reduction of growth of a tumor in vivo, including, e.g., halting or reducing the growth of tumor or cancer cell levels as described in greater detail elsewhere herein.

β-catenin inhibitory activity can also be evaluated over time (duration) and over concentration ranges (potency), with assessment of what constitutes a dsRNA possessing β-catenin inhibitory activity adjusted in accordance with concentrations administered and duration of time following administration. Thus, in certain embodiments, a DsiRNA of the invention is deemed to possess β-catenin inhibitory activity if at least a 50% reduction in β-catenin activity is observed at a duration of time of 2 hours, 5 hours, 10 hours, 1 day, 2 days, 3 days, 4 days, 5 days, 6 days, 7 days, 8 days, 9 days, 10 days or more after administration is observed/persists. In additional embodiments, a DsiRNA of the invention is deemed to be a potent β-catenin inhibitory agent if β-catenin inhibitory activity (e.g., in certain embodiments, at least 50% inhibition of (β-catenin) is observed at a concentration of 1 nM or less, 500 pM or less, 200 pM or less, 100 pM or less, 50 pM or less, 20 pM or less, 10 pM or less, 5 pM or less, 2 pM or less or even 1 pM or less in the environment of a cell, for example, within an in vitro assay for β-catenin inhibitory activity as described herein. In certain embodiments, a potent β-catenin inhibitory dsRNA of the invention is defined as one that is capable of β-catenin inhibitory activity (e.g., in certain embodiments, at least 20% reduction of (β-catenin levels) at a formulated concentration of 10 mg/kg or less when administered to a subject in an effective delivery vehicle (e.g., an effective lipid nanoparticle formulation). Preferably, a potent β-catenin inhibitory dsRNA of the invention is defined as one that is capable of β-catenin inhibitory activity (e.g., in certain embodiments, at least 50% reduction of (β-catenin levels) at a formulated concentration of 5 mg/kg or less when administered to a subject in an effective delivery vehicle. More preferably, a potent β-catenin inhibitory dsRNA of the invention is defined as one that is capable of β-catenin inhibitory activity (e.g., in certain embodiments, at least 50% reduction of (β-catenin levels) at a formulated concentration of 5 mg/kg or less when administered to a subject in an effective delivery vehicle. Optionally, a potent β-catenin inhibitory dsRNA of the invention is defined as one that is capable of β-catenin inhibitory activity (e.g., in certain embodiments, at least 50% reduction of (β-catenin levels) at a formulated concentration of 2 mg/kg or less, or even 1 mg/kg or less, when administered to a subject in an effective delivery vehicle.

In certain embodiments, potency of a dsRNA of the invention is determined in reference to the number of copies of a dsRNA present in the cytoplasm of a target cell that are required to achieve a certain level of target gene knockdown. For example, in certain embodiments, a potent dsRNA is one capable of causing 50% or greater knockdown of a target mRNA when present in the cytoplasm of a target cell at a copy number of 1000 or fewer RISC-loaded antisense strands per cell. More preferably, a potent dsRNA is one capable of producing 50% or greater knockdown of a target mRNA when present in the cytoplasm of a target cell at a copy number of 500 or fewer RISC-loaded antisense strands per cell. Optionally, a potent dsRNA is one capable of producing 50% or greater knockdown of a target mRNA when present in the cytoplasm of a target cell at a copy number of 300 or fewer RISC-loaded antisense strands per cell.

In further embodiments, the potency of a DsiRNA of the invention can be defined in reference to a 19 to 23mer dsRNA directed to the same target sequence within the same target gene. For example, a DsiRNA of the invention that possesses enhanced potency relative to a corresponding 19 to 23mer dsRNA can be a DsiRNA that reduces a target gene by an additional 5% or more, an additional 10% or more, an additional 20% or more, an additional 30% or more, an additional 40% or more, or an additional 50% or more as compared to a corresponding 19 to 23mer dsRNA, when assayed in an in vitro assay as described herein at a sufficiently low concentration to allow for detection of a potency difference (e.g., transfection concentrations at or below 1 nM in the environment of a cell, at or below 100 pM in the environment of a cell, at or below 10 pM in the environment of a cell, at or below 1 nM in the environment of a cell, in an in vitro assay as described herein; notably, it is recognized that potency differences can be best detected via performance of such assays across a range of concentrations—e.g., 0.1 pM to 10 nM—for purpose of generating a dose-response curve and identifying an IC50 value associated with a DsiRNA/dsRNA).

β-catenin inhibitory levels and/or β-catenin levels may also be assessed indirectly, e.g., measurement of a reduction in a β-catenin-associated disease marker protein or target gene, such as MYC, Cyclin D1, or Axin2, or reduction of the size or number of polyps or tumors (e.g., colon tumors) in a subject may be used to assess β-catenin levels and/or β-catenin inhibitory efficacy of a double-stranded nucleic acid of the instant invention.

In certain embodiments, the phrase "consists essentially of" is used in reference to the anti-β-catenin dsRNAs of the invention. In some such embodiments, "consists essentially of" refers to a composition that comprises a dsRNA of the invention which possess at least a certain level of β-catenin inhibitory activity (e.g., at least 50% (β-catenin inhibitory activity) and that also comprises one or more additional components and/or modifications that do not significantly impact the β-catenin inhibitory activity of the dsRNA. For example, in certain embodiments, a composition "consists essentially of" a dsRNA of the invention where modifications of the dsRNA of the invention and/or dsRNA-associated components of the composition do not alter the β-catenin inhibitory activity (optionally including potency or duration of β-catenin inhibitory activity) by greater than 3%, greater than 5%, greater than 10%, greater than 15%, greater than 20%, greater than 25%, greater than 30%, greater than 35%, greater than 40%, greater than 45%, or greater than 50% relative to the dsRNA of the invention in isolation. In certain embodiments, a composition is deemed to consist essentially of a dsRNA of the invention even if more dramatic reduction of β-catenin inhibitory activity (e.g., 80% reduction, 90% reduction, etc. in efficacy, duration and/or potency) occurs in the presence of additional components or modifications, yet where β-catenin inhibitory activity is not significantly elevated (e.g., observed levels of (β-catenin inhibitory activity are within 10% of those observed for the isolated dsRNA of the invention) in the presence of additional components and/or modifications.

As used herein, the phrase "dsRNA reduces β-catenin mRNA levels by at least X % when assayed in vitro in a mammalian cell at an effective concentration in the environment of said cell of 1 nanomolar or less" refers to a requirement for the dsRNA to reduce the native β-catenin mRNA levels of a HeLa cell population by at least X %, when assayed at a transfection concentration of 1 nanomolar or less in the presence of Lipofectamine™ RNAiMAX (Invitrogen) and following manufacturer's instructions. Such HeLa cells are obtained from ATCC and maintained in DMEM (HyClone) supplemented with 10% fetal bovine serum (HyClone) at 37° C. under 5% $CO_2$. β-catenin mRNA levels are then assayed at 24 h or 48 h post-transfection to assess % inhibition, with respect to an appropriate control as described elsewhere herein. In certain embodiments, the HeLa cells of such assays are replaced with HepG2, HCT116, HuH7 or other cell line.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs).

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, e.g., Usman and McSwiggen US 2009/0137500; Eckstein et al., International PCT Publication No. WO 92/07065; Usman et al., International PCT Publication No. WO 93/15187; Uhlman & Peyman U.S. Pat. No. 6,326,487, all are hereby incorporated by reference herein). There are several examples of modified nucleic acid bases known in the art as summarized by Limbach et al., *Nucleic Acids Res.* 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occurring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-methoxyethoxy, 2'-fluoro, 2'-allyl, 2'-O-[2-(methylamino)-2-oxoethyl], 4'-thio, 4'-$CH_2$—O-2'-bridge, 4'-$(CH_2)_2$—O-2'-bridge, 2'-LNA, and 2'-O—(N-methylcarbamate) or those comprising base analogs. In connection with 2'-modified nucleotides as described for the present disclosure, by "amino" is meant 2'-$NH_2$ or 2'-O—$NH_2$, which can be modified or unmodified. Such modified groups are described, e.g., in Eckstein et al., U.S. Pat. No. 5,672,695 and Matulic-Adamic et al., U.S. Pat. No. 6,248,878.

In reference to the nucleic acid molecules of the present disclosure, modifications may exist upon these agents in patterns on one or both strands of the double stranded ribonucleic acid (dsRNA). As used herein, "alternating positions" refers to a pattern where every other nucleotide is a modified nucleotide or there is an unmodified nucleotide (e.g., an unmodified ribonucleotide) between every modified nucleotide over a defined length of a strand of the dsRNA (e.g., 5'-MNMNMN-3'; 3'-MNMNMN-5'; where M is a modified nucleotide and N is an unmodified nucleotide). The modification pattern starts from the first nucleotide position at either the 5' or 3' terminus according to a position numbering convention, e.g., as described herein (in certain embodiments, position 1 is designated in reference to the terminal residue of a strand following a projected Dicer cleavage event of a DsiRNA agent of the invention; thus, position 1 does not always constitute a 3' terminal or 5' terminal residue of a pre-processed agent of the invention). The pattern of modified nucleotides at alternating positions may run the full length of the strand, but in certain embodiments includes at least 4, 6, 8, 10, 12, 14 nucleotides containing at least 2, 3, 4, 5, 6 or 7 modified nucleotides, respectively. As used herein, "alternating pairs of positions" refers to a pattern where two consecutive modified nucleotides are separated by two consecutive unmodified nucleotides over a defined length of a strand of the dsRNA (e.g., 5'-MMNNMMNNMMNN-3'; 3'-MMNNMMNNM-MNN-5'; where M is a modified nucleotide and N is an unmodified nucleotide). The modification pattern starts from the first nucleotide position at either the 5' or 3' terminus according to a position numbering convention such as those described herein. The pattern of modified nucleotides at alternating positions may run the full length of the strand, but preferably includes at least 8, 12, 16, 20, 24, 28 nucleotides containing at least 4, 6, 8, 10, 12 or 14 modified nucleotides, respectively. It is emphasized that the above modification patterns are exemplary and are not intended as limitations on the scope of the invention.

As used herein, "base analog" refers to a heterocyclic moiety which is located at the 1' position of a nucleotide sugar moiety in a modified nucleotide that can be incorporated into a nucleic acid duplex (or the equivalent position in a nucleotide sugar moiety substitution that can be incorporated into a nucleic acid duplex). In the dsRNAs of the invention, a base analog is generally either a purine or pyrimidine base excluding the common bases guanine (G), cytosine (C), adenine (A), thymine (T), and uracil (U). Base analogs can duplex with other bases or base analogs in dsRNAs. Base analogs include those useful in the compounds and methods of the invention, e.g., those disclosed in U.S. Pat. Nos. 5,432,272 and 6,001,983 to Benner and US Patent Publication No. 20080213891 to Manoharan, which are herein incorporated by reference. Non-limiting examples of bases include hypoxanthine (I), xanthine (X), 3β-D-ribofuranosyl-(2,6-diaminopyrimidine) (K), 3-β-D-ribofuranosyl-(1-methyl-pyrazolo[4,3-d]pyrimidine-5,7(4H,6H)-dione) (P), iso-cytosine (iso-C), iso-guanine (iso-G), 1-β-D-ribofuranosyl-(5-nitroindole), 1-β-D-ribofuranosyl-(3-nitropyrrole), 5-bromouracil, 2-aminopurine, 4-thio-dT, 7-(2-thienyl)-imidazo[4,5-b]pyridine (Ds) and pyrrole-2-carbaldehyde (Pa), 2-amino-6-(2-thienyl)purine (S),2-oxopyridine (Y), difluorotolyl, 4-fluoro-6-methylbenzimidazole, 4-methylbenzimidazole, 3-methyl isocarbostyrilyl, 5-methyl isocarbostyrilyl, and 3-methyl-7-propynyl isocarbostyrilyl, 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof (Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., J. Org. Chem., 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1: 1605-1611 (2001); Wu et al., J. Am. Chem. Soc., 122(32):7621-7632 (2000); O'Neill et al., J. Org. Chem., 67:5869-5875 (2002); Chaudhuri et al., J. Am. Chem. Soc., 117:10434-10442 (1995); and U.S. Pat. No. 6,218,108.). Base analogs may also be a universal base.

As used herein, "universal base" refers to a heterocyclic moiety located at the 1' position of a nucleotide sugar moiety in a modified nucleotide, or the equivalent position in a nucleotide sugar moiety substitution, that, when present in a nucleic acid duplex, can be positioned opposite more than one type of base without altering the double helical structure (e.g., the structure of the phosphate backbone). Additionally, the universal base does not destroy the ability of the single stranded nucleic acid in which it resides to duplex to a target nucleic acid. The ability of a single stranded nucleic acid containing a universal base to duplex a target nucleic can be assayed by methods apparent to one in the art (e.g., UV absorbance, circular dichroism, gel shift, single stranded nuclease sensitivity, etc.). Additionally, conditions under which duplex formation is observed may be varied to determine duplex stability or formation, e.g., temperature, as melting temperature (Tm) correlates with the stability of nucleic acid duplexes. Compared to a reference single stranded nucleic acid that is exactly complementary to a target nucleic acid, the single stranded nucleic acid containing a universal base forms a duplex with the target nucleic acid that has a lower Tm than a duplex formed with the complementary nucleic acid. However, compared to a reference single stranded nucleic acid in which the universal base has been replaced with a base to generate a single mismatch, the single stranded nucleic acid containing the universal base forms a duplex with the target nucleic acid that has a higher Tm than a duplex formed with the nucleic acid having the mismatched base.

Some universal bases are capable of base pairing by forming hydrogen bonds between the universal base and all of the bases guanine (G), cytosine (C), adenine (A), thymine (T), and uracil (U) under base pair forming conditions. A universal base is not a base that forms a base pair with only one single complementary base. In a duplex, a universal base may form no hydrogen bonds, one hydrogen bond, or more than one hydrogen bond with each of G, C, A, T, and U opposite to it on the opposite strand of a duplex. Preferably, the universal base does not interact with the base opposite to it on the opposite strand of a duplex. In a duplex, base pairing involving a universal base occurs without altering the double helical structure of the phosphate backbone. A universal base may also interact with bases in adjacent nucleotides on the same nucleic acid strand by stacking interactions. Such stacking interactions stabilize the duplex, especially in situations where the universal base does not form any hydrogen bonds with the base positioned opposite to it on the opposite strand of the duplex. Non-limiting examples of universal-binding nucleotides include inosine, 1-β-D-ribofuranosyl-5-nitroindole, and/or 1-β-D-ribofuranosyl-3-nitropyrrole (US Pat. Appl. Publ. No. 20070254362 to Quay et al.; Van Aerschot et al., An acyclic 5-nitroindazole nucleoside analogue as ambiguous nucleoside. Nucleic Acids Res. 1995 Nov. 11; 23(21):4363-70; Loakes et al., 3-Nitropyrrole and 5-nitroindole as universal bases in primers for DNA sequencing and PCR. Nucleic Acids Res. 1995 Jul. 11; 23(13):2361-6; Loakes and Brown, 5-Nitroindole as an universal base analogue. Nucleic Acids Res. 1994 Oct. 11; 22(20):4039-43).

As used herein, "loop" refers to a structure formed by a single strand of a nucleic acid, in which complementary regions that flank a particular single stranded nucleotide region hybridize in a way that the single stranded nucleotide region between the complementary regions is excluded from duplex formation or Watson-Crick base pairing. A loop is a single stranded nucleotide region of any length. Examples of loops include the unpaired nucleotides present in such structures as hairpins, stem loops, or extended loops.

As used herein, "extended loop" in the context of a dsRNA refers to a single stranded loop and in addition 1, 2, 3, 4, 5, 6 or up to 20 base pairs or duplexes flanking the loop. In an extended loop, nucleotides that flank the loop on the 5' side form a duplex with nucleotides that flank the loop on the 3' side. An extended loop may form a hairpin or stem loop.

As used herein, "tetraloop" in the context of a dsRNA refers to a loop (a single stranded region) consisting of four nucleotides that forms a stable secondary structure that contributes to the stability of an adjacent Watson-Crick hybridized nucleotides. Without being limited to theory, a tetraloop may stabilize an adjacent Watson-Crick base pair by stacking interactions. In addition, interactions among the four nucleotides in a tetraloop include but are not limited to non-Watson-Crick base pairing, stacking interactions, hydrogen bonding, and contact interactions (Cheong et al., Nature 1990 Aug. 16; 346(6285):680-2; Heus and Pardi, Science 1991 Jul. 12; 253(5016):191-4). A tetraloop confers an increase in the melting temperature (Tm) of an adjacent duplex that is higher than expected from a simple model loop sequence consisting of four random bases. For example, a tetraloop can confer a melting temperature of at least 55° C. in 10 mM $NaHPO_4$ to a hairpin comprising a duplex of at least 2 base pairs in length. A tetraloop may contain ribonucleotides, deoxyribonucleotides, modified nucleotides, and combinations thereof. Examples of RNA tetraloops include the UNCG family of tetraloops (e.g., UUCG), the GNRA family of tetraloops (e.g., GAAA), and the CUUG tetraloop. (Woese et al., Proc Natl Acad Sci USA. 1990 November; 87(21):8467-71; Antao et al., Nucleic Acids Res. 1991 Nov. 11; 19(21):5901-5). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, the d(TNCG) family of tetraloops (e.g., d(TTCG)). (Nakano et al. Biochemistry, 41 (48), 14281-14292, 2002.; SHINJI et al. Nippon Kagakkai Koen Yokoshu VOL. 78th; NO. 2; PAGE.731 (2000).)

As used herein, the term "siRNA" refers to a double stranded nucleic acid in which each strand comprises RNA, RNA analog(s) or RNA and DNA. The siRNA comprises between 19 and 23 nucleotides or comprises 21 nucleotides. The siRNA typically has 2 bp overhangs on the 3' ends of each strand such that the duplex region in the siRNA comprises 17-21 nucleotides, or 19 nucleotides. Typically, the antisense strand of the siRNA is sufficiently complementary with the target sequence of the β-catenin gene/RNA.

An anti-β-catenin DsiRNA of the instant invention possesses strand lengths of at least 25 nucleotides. Accordingly, in certain embodiments, an anti-β-catenin DsiRNA contains one oligonucleotide sequence, a first sequence, that is at least 25 nucleotides in length and no longer than 35 or up to 50 or more nucleotides. This sequence of RNA can be between 26 and 35, 26 and 34, 26 and 33, 26 and 32, 26 and 31, 26 and 30, and 26 and 29 nucleotides in length. This sequence can be 27 or 28 nucleotides in length or 27 nucleotides in length. The second sequence of the DsiRNA agent can be a sequence that anneals to the first sequence under biological conditions, such as within the cytoplasm of a eukaryotic cell. Generally, the second oligonucleotide sequence will have at least 19 complementary base pairs with the first oligonucleotide sequence, more typically the second oligonucleotide sequence will have 21 or more complementary base pairs, or 25 or more complementary base pairs with the first oligonucleotide sequence. In one embodiment, the second sequence is the same length as the first sequence, and the DsiRNA agent is blunt ended. In another embodiment, the ends of the DsiRNA agent have one or more overhangs.

In certain embodiments, the first and second oligonucleotide sequences of the DsiRNA agent exist on separate oligonucleotide strands that can be and typically are chemically synthesized. In some embodiments, both strands are between 26 and 35 nucleotides in length. In other embodiments, both strands are between 25 and 30 or 26 and 30 nucleotides in length. In one embodiment, both strands are 27 nucleotides in length, are completely complementary and have blunt ends. In certain embodiments of the instant invention, the first and second sequences of an anti-β-catenin DsiRNA exist on separate RNA oligonucleotides (strands). In one embodiment, one or both oligonucleotide strands are capable of serving as a substrate for Dicer. In other embodiments, at least one modification is present that promotes Dicer to bind to the double-stranded RNA structure in an orientation that maximizes the double-stranded RNA structure's effectiveness in inhibiting gene expression. In certain embodiments of the instant invention, the anti-β-catenin DsiRNA agent is comprised of two oligonucleotide strands of differing lengths, with the anti-β-catenin DsiRNA possessing a blunt end at the 3' terminus of a first strand (sense strand) and a 3' overhang at the 3' terminus of a second strand (antisense strand). The DsiRNA can also contain one or more deoxyribonucleic acid (DNA) base substitutions.

Suitable DsiRNA compositions that contain two separate oligonucleotides can be chemically linked outside their annealing region by chemical linking groups. Many suitable chemical linking groups are known in the art and can be used. Suitable groups will not block Dicer activity on the DsiRNA and will not interfere with the directed destruction of the RNA transcribed from the target gene. Alternatively, the two separate oligonucleotides can be linked by a third oligonucleotide such that a hairpin structure is produced upon annealing of the two oligonucleotides making up the DsiRNA composition. The hairpin structure will not block Dicer activity on the DsiRNA and will not interfere with the directed destruction of the target RNA.

As used herein, a dsRNA, e.g., DsiRNA or siRNA, having a sequence "sufficiently complementary" to a target RNA or cDNA sequence (e.g., β-catenin mRNA) means that the dsRNA has a sequence sufficient to trigger the destruction of the target RNA (where a cDNA sequence is recited, the RNA sequence corresponding to the recited cDNA sequence) by the RNAi machinery (e.g., the RISC complex) or process. For example, a dsRNA that is "sufficiently complementary" to a target RNA or cDNA sequence to trigger the destruction of the target RNA by the RNAi machinery or process can be identified as a dsRNA that causes a detectable reduction in the level of the target RNA in an appropriate assay of dsRNA activity (e.g., an in vitro assay as described in Example 2 below), or, in further examples, a dsRNA that is sufficiently complementary to a target RNA or cDNA sequence to trigger the destruction of the target RNA by the RNAi machinery or process can be identified as a dsRNA that produces at least a 5%, at least a 10%, at least a 15%, at least a 20%, at least a 25%, at least a 30%, at least a 35%, at least a 40%, at least a 45%, at least a 50%, at least a 55%, at least a 60%, at least a 65%, at least a 70%, at least a 75%, at least a 80%, at least a 85%, at least a 90%, at least a 95%, at least a 98% or at least a 99% reduction in the level of the target RNA in an appropriate assay of dsRNA activity. In additional examples, a dsRNA that is sufficiently complementary to a target RNA or cDNA sequence to trigger the destruction of the target RNA by the RNAi machinery or process can be identified based upon assessment of the duration of a certain level of inhibitory activity with respect to the target RNA or protein levels in a cell or organism. For example, a dsRNA that is sufficiently complementary to a target RNA or cDNA sequence to trigger the destruction of the target RNA by the RNAi machinery or process can be identified as a dsRNA capable of reducing target mRNA levels by at least 20% at least 48 hours post-administration of said dsRNA to a cell or organism. Preferably, a dsRNA that is sufficiently complementary to a target RNA or cDNA sequence to trigger the destruction of the target RNA by the RNAi machinery or process is identified as a dsRNA capable of reducing target mRNA levels by at least 40% at least 72 hours post-administration of said dsRNA to a cell or organism, by at least 40% at least four, five or seven days post-administration of said dsRNA to a cell or organism, by at least 50% at least 48 hours post-administration of said dsRNA to a cell or organism, by at least 50% at least 72 hours post-administration of said dsRNA to a cell or organism, by at least 50% at least four, five or seven days post-administration of said dsRNA to a cell or organism, by at least 80% at least 48 hours post-administration of said dsRNA to a cell or organism, by at least 80% at least 72 hours post-administration of said dsRNA to a cell or organism, or by at least 80% at least four, five or seven days post-administration of said dsRNA to a cell or organism.

The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner. Further consideration of the structure of preferred DsiRNA agents, including further description of the modifications and substitutions that can be performed upon the anti-β-catenin DsiRNA agents of the instant invention, can be found below.

Where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to as siRNA ("short interfering RNA") or DsiRNA ("Dicer substrate siRNAs"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5' end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used herein, "dsRNA" may include chemical modifications to ribonucleotides, internucleoside linkages, end-groups, caps, and conjugated moieties, including substantial modifications at multiple nucleotides and including all types of modifications disclosed herein or known in the art. Any such modifications, as used in an siRNA- or DsiRNA-type molecule, are encompassed by "dsRNA" for the purposes of this specification and claims.

The phrase "duplex region" refers to the region in two complementary or substantially complementary oligonucleotides that form base pairs with one another, either by Watson-Crick base pairing or other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

Single-stranded nucleic acids that base pair over a number of bases are said to "hybridize." Hybridization is typically determined under physiological or biologically relevant conditions (e.g., intracellular: pH 7.2, 140 mM potassium ion; extracellular pH 7.4, 145 mM sodium ion). Hybridization conditions generally contain a monovalent cation and biologically acceptable buffer and may or may not contain a divalent cation, complex anions, e.g. gluconate from potassium gluconate, uncharged species such as sucrose, and inert polymers to reduce the activity of water in the sample, e.g. PEG. Such conditions include conditions under which base pairs can form.

Hybridization is measured by the temperature required to dissociate single stranded nucleic acids forming a duplex, i.e., (the melting temperature; Tm). Hybridization conditions are also conditions under which base pairs can form. Various conditions of stringency can be used to determine hybridization (see, e.g., Wahl, G. M. and S. L. Berger (1987) Methods Enzymol. 152:399; Kimmel, A. R. (1987) Methods Enzymol. 152:507). Stringent temperature conditions will ordinarily include temperatures of at least about 30° C., more preferably of at least about 37° C., and most preferably of at least about 42° C. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). For example, a hybridization determination buffer is shown in Table 1.

nucleotide" specifically excludes a deoxyribonucleotide, which is a nucleotide possessing a single proton group at the 2' ribose ring position.

As used herein, the term "deoxyribonucleotide" encompasses natural and synthetic, unmodified and modified deoxyribonucleotides. Modifications include changes to the sugar moiety, to the base moiety and/or to the linkages between deoxyribonucleotide in the oligonucleotide. As used herein, the term "deoxyribonucleotide" also includes a modified ribonucleotide that does not permit Dicer cleavage of a dsRNA agent, e.g., a 2'-O-methyl ribonucleotide, a phosphorothioate-modified ribonucleotide residue, etc., that does not permit Dicer cleavage to occur at a bond of such a residue.

As used herein, the term "PS-NA" refers to a phosphorothioate-modified nucleotide residue. The term "PS-NA" therefore encompasses both phosphorothioate-modified ribonucleotides ("PS-RNAs") and phosphorothioate-modified deoxyribonucleotides ("PS-DNAs").

As used herein, "Dicer" refers to an endoribonuclease in the RNase III family that cleaves a dsRNA or dsRNA-containing molecule, e.g., double-stranded RNA (dsRNA) or pre-microRNA (miRNA), into double-stranded nucleic acid fragments 19-25 nucleotides long, usually with a two-base overhang on the 3' end. With respect to the dsRNAs of the invention, the duplex formed by a dsRNA region of an agent

TABLE 1

|  | final conc. | Vender | Cat# | Lot# | m.w./Stock | To make 50 mL solution |
|---|---|---|---|---|---|---|
| NaCl | 100 mM | Sigma | S-5150 | 41K8934 | 5M | 1 mL |
| KCl | 80 mM | Sigma | P-9541 | 70K0002 | 74.55 | 0.298 g |
| MgCl$_2$ | 8 mM | Sigma | M-1028 | 120K8933 | 1M | 0.4 mL |
| sucrose | 2% w/v | Fisher | BP220-212 | 907105 | 342.3 | 1 g |
| Tris-HCl | 16 mM | Fisher | BP1757-500 | 12419 | 1M | 0.8 mL |
| NaH$_2$PO$_4$ | 1 mM | Sigma | S-3193 | 52H-029515 | 120.0 | 0.006 g |
| EDTA | 0.02 mM | Sigma | E-7889 | 110K89271 | 0.5M | 2 µL |
| H$_2$O |  | Sigma | W-4502 | 51K2359 |  | to 50 mL |
| pH = 7.0 at 20° C. | adjust with HCl |  |  |  |  |  |

Useful variations on hybridization conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Antisense to Molecular Cloning Techniques, 1987, Academic Press, New York); and Sambrook et al., Molecular Cloning: A Laboratory Manual, Cold Spring Harbor Laboratory Press, New York.

As used herein, "oligonucleotide strand" is a single stranded nucleic acid molecule. An oligonucleotide may comprise ribonucleotides, deoxyribonucleotides, modified nucleotides (e.g., nucleotides with 2' modifications, synthetic base analogs, etc.) or combinations thereof. Such modified oligonucleotides can be preferred over native forms because of properties such as, for example, enhanced cellular uptake and increased stability in the presence of nucleases.

As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide. As used herein, the term "riboof the invention is recognized by Dicer and is a Dicer substrate on at least one strand of the duplex. Dicer catalyzes the first step in the RNA interference pathway, which consequently results in the degradation of a target RNA. The protein sequence of human Dicer is provided at the NCBI database under accession number NP_085124, hereby incorporated by reference.

Dicer "cleavage" is determined as follows (e.g., see Collingwood et al., Oligonucleotides 18:187-200 (2008)). In a Dicer cleavage assay, RNA duplexes (100 pmol) are incubated in 20 µL of 20 mM Tris pH 8.0, 200 mM NaCl, 2.5 mM MgCl2 with or without 1 unit of recombinant human Dicer (Stratagene, La Jolla, Calif.) at 37° C. for 18-24 hours. Samples are desalted using a Performa SR 96-well plate (Edge Biosystems, Gaithersburg, Md.). Electrospray-ionization liquid chromatography mass spectroscopy (ESI-LCMS) of duplex RNAs pre- and post-treatment with Dicer is done using an Oligo HTCS system (Novatia, Princeton, N.J.; Hail et al., 2004), which consists of a ThermoFinnigan TSQ7000, Xcalibur data system, ProMass data processing software and Paradigm MS4 HPLC (Michrom BioResources, Auburn, Calif.). In this assay, Dicer cleavage occurs where at least 5%, 10%, 20%, 30%, 40%, 50%, 60%, 70%, 80%, 90%, 95%, or even 100% of the Dicer substrate dsRNA, (i.e., 25-30 bp, dsRNA, preferably 26-30 bp dsRNA) is cleaved to a shorter dsRNA (e.g., 19-23 bp dsRNA, preferably, 21-23 bp dsRNA).

As used herein, "Dicer cleavage site" refers to the sites at which Dicer cleaves a dsRNA (e.g., the dsRNA region of a DsiRNA agent of the invention). Dicer contains two RNase III domains which typically cleave both the sense and antisense strands of a dsRNA. The average distance between the RNase III domains and the PAZ domain determines the length of the short double-stranded nucleic acid fragments it produces and this distance can vary (Macrae et al. (2006) *Science* 311: 195-8). As shown in FIG. 1, Dicer is projected to cleave certain double-stranded ribonucleic acids of the instant invention that possess an antisense strand having a 2 nucleotide 3' overhang at a site between the $21^{st}$ and $22^{nd}$ nucleotides removed from the 3' terminus of the antisense strand, and at a corresponding site between the $21^{st}$ and $22^{nd}$ nucleotides removed from the 5' terminus of the sense strand. The projected and/or prevalent Dicer cleavage site(s) for dsRNA molecules distinct from those depicted in FIG. 1 may be similarly identified via art-recognized methods, including those described in Macrae et al. While the Dicer cleavage events depicted in FIG. 1 generate 21 nucleotide siRNAs, it is noted that Dicer cleavage of a dsRNA (e.g., DsiRNA) can result in generation of Dicer-processed siRNA lengths of 19 to 23 nucleotides in length. Indeed, in certain embodiments, a double-stranded DNA region may be included within a dsRNA for purpose of directing prevalent Dicer excision of a typically non-preferred 19mer or 20mer siRNA, rather than a 21mer.

As used herein, "overhang" refers to unpaired nucleotides, in the context of a duplex having one or more free ends at the 5' terminus or 3' terminus of a dsRNA. In certain embodiments, the overhang is a 3' or 5' overhang on the antisense strand or sense strand. In some embodiments, the overhang is a 3' overhang having a length of between one and six nucleotides, optionally one to five, one to four, one to three, one to two, two to six, two to five, two to four, two to three, three to six, three to five, three to four, four to six, four to five, five to six nucleotides, or one, two, three, four, five or six nucleotides.

A dsRNA of the invention comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the β-catenin target gene, the other strand (the sense strand) comprises a region which is complementary to the antisense strand, such that the two strands hybridize and form a duplex structure when combined under suitable conditions. Generally, the duplex structure is between 15 and 35, optionally between 25 and 30, between 26 and 30, between 18 and 25, between 19 and 24, or between 19 and 21 base pairs in length. Similarly, the region of complementarity to the target sequence is between 15 and 35, optionally between 18 and 30, between 25 and 30, between 19 and 24, or between 19 and 21 nucleotides in length. The dsRNA of the invention may further comprise one or more single-stranded nucleotide overhang(s). It has been identified that dsRNAs comprising duplex structures of between 15 and 35 base pairs in length can be effective in inducing RNA interference, including DsiRNAs (generally of at least 25 base pairs in length) and siRNAs (in certain embodiments, duplex structures of siRNAs are between 20 and 23, and optionally, specifically 21 base pairs (Elbashir et al., *EMBO* 20: 6877-6888)). It has also been identified that dsRNAs possessing duplexes shorter than 20 base pairs can be effective as well (e.g., 15, 16, 17, 18 or 19 base pair duplexes). In certain embodiments, the dsRNAs of the invention can comprise at least one strand of a length of 19 nucleotides or more. In certain embodiments, it can be reasonably expected that shorter dsRNAs comprising a sequence complementary to one of the sequences of Table 10 below, minus only a few nucleotides on one or both ends may be similarly effective as compared to the dsRNAs described above and in Tables 2-5 and 7-10. Hence, dsRNAs comprising a partial sequence of at least 15, 16, 17, 18, 19, 20, or more contiguous nucleotides sufficiently complementary to one of the sequences of Table 10, and differing in their ability to inhibit the expression of the β-catenin target gene in an assay as described herein by not more than 5, 10, 15, 20, 25, or 30% inhibition from a dsRNA comprising the full sequence, are contemplated by the invention. In one embodiment, at least one end of the dsRNA has a single-stranded nucleotide overhang of 1 to 5, optionally 1 to 4, in certain embodiments, 1 or 2 nucleotides. Certain dsRNA structures having at least one nucleotide overhang possess superior inhibitory properties as compared to counterparts possessing base-paired blunt ends at both ends of the dsRNA molecule.

As used herein, the term "RNA processing" refers to processing activities performed by components of the siRNA, miRNA or RNase H pathways (e.g., Drosha, Dicer, Argonaute2 or other RISC endoribonucleases, and RNaseH), which are described in greater detail below (see "RNA Processing" section below). The term is explicitly distinguished from the post-transcriptional processes of 5' capping of RNA and degradation of RNA via non-RISC- or non-RNase H-mediated processes. Such "degradation" of an RNA can take several forms, e.g. deadenylation (removal of a 3' poly(A) tail), and/or nuclease digestion of part or all of the body of the RNA by one or more of several endo- or exo-nucleases (e.g., RNase III, RNase P, RNase T1, RNase A (1, 2, 3, 4/5), oligonucleotidase, etc.).

By "homologous sequence" is meant, a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.). Indeed, design and use of the DsiRNA agents of the instant invention contemplates the possibility of using such DsiRNA agents not only against target RNAs of β-catenin possessing perfect complementarity with the presently described DsiRNA agents, but also against target β-catenin RNAs possessing sequences that are, e.g., only 99%, 98%, 97%, 96%, 95%, 94%, 93%, 92%, 91%, 90%, 89%, 88%, 87%, 86%, 85%, 84%, 83%, 82%, 81%, 80% etc. complementary to said DsiRNA agents. Similarly, it is contemplated that the presently described DsiRNA agents of the instant invention might be readily altered by the skilled artisan to enhance the extent of complementarity between said DsiRNA agents and a target β-catenin RNA, e.g., of a specific allelic variant of β-catenin (e.g., an allele of enhanced therapeutic interest). Indeed, DsiRNA agent sequences with insertions, deletions, and single point mutations relative to the target β-catenin sequence can also be effective for inhibition. Alternatively, DsiRNA agent sequences with nucleotide analog substitutions or insertions can be effective for inhibition.

Sequence identity may be determined by sequence comparison and alignment algorithms known in the art. To determine the percent identity of two nucleic acid sequences (or of two amino acid sequences), the sequences are aligned for comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=# of identical positions/total # of positions.times.100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) Proc. Natl. Acad. Sci. USA 87:2264-68, modified as in Karlin and Altschul (1993) Proc. Natl. Acad. Sci. USA 90:5873-77. Such an algorithm is incorporated into the BLAST programs (version 2.0) of Altschul, et al. (1990) J. Mol. Biol. 215:403-10.

In another embodiment, a gapped alignment is formed by introducing gaps, and percent identity is determined over the length of the aligned sequences. To obtain gapped alignments for comparison purposes, Gapped BLAST can be utilized as described in Altschul et al., (1997) Nucleic Acids Res. 25(17): 3389-3402. In another embodiment, a global alignment is formed by introducing gaps, and percent identity is determined over the entire length of the sequences aligned. A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used.

Greater than 80% sequence identity, e.g., 80%, 81%, 82%, 83%, 84%, 85%, 86%, 87%, 88%, 89%, 90%, 91%, 92%, 93%, 94%, 95%, 96%, 97%, 98%, 99% or even 100% sequence identity, between the DsiRNA antisense strand and the portion of the β-catenin RNA sequence is preferred. Alternatively, the DsiRNA may be defined functionally as a nucleotide sequence (or oligonucleotide sequence) that is capable of hybridizing with a portion of the β-catenin RNA (e.g., 400 mM NaCl, 40 mM PIPES pH 6.4, 1 mM EDTA, 50° C. or 70° C. hybridization for 12-16 hours; followed by washing). Additional preferred hybridization conditions include hybridization at 70° C. in 1×SSC or 50° C. in 1×SSC, 50% formamide followed by washing at 70° C. in 0.3×SSC or hybridization at 70° C. in 4×SSC or 50° C. in 4×SSC, 50% formamide followed by washing at 67° C. in 1×SSC. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). Additional examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F. M. Ausubel et al., eds., John Wiley & Sons, Inc., sections 2.10 and 6.3-6.4. The length of the identical nucleotide sequences may be at least 10, 12, 15, 17, 20, 22, 25, 27 or 30 bases.

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a DsiRNA molecule having complementarity to an antisense region of the DsiRNA molecule. In addition, the sense region of a DsiRNA molecule can comprise a nucleic acid sequence having homology with a target nucleic acid sequence.

By "antisense region" is meant a nucleotide sequence of a DsiRNA molecule having complementarity to a target nucleic acid sequence. In addition, the antisense region of a DsiRNA molecule comprises a nucleic acid sequence having complementarity to a sense region of the DsiRNA molecule.

As used herein, "antisense strand" refers to a single stranded nucleic acid molecule which has a sequence complementary to that of a target RNA. When the antisense strand contains modified nucleotides with base analogs, it is not necessarily complementary over its entire length, but must at least hybridize with a target RNA.

As used herein, "sense strand" refers to a single stranded nucleic acid molecule which has a sequence complementary to that of an antisense strand. When the antisense strand contains modified nucleotides with base analogs, the sense strand need not be complementary over the entire length of the antisense strand, but must at least duplex with the antisense strand.

As used herein, "guide strand" refers to a single stranded nucleic acid molecule of a dsRNA or dsRNA-containing molecule, which has a sequence sufficiently complementary to that of a target RNA to result in RNA interference. After cleavage of the dsRNA or dsRNA-containing molecule by Dicer, a fragment of the guide strand remains associated with RISC, binds a target RNA as a component of the RISC complex, and promotes cleavage of a target RNA by RISC. As used herein, the guide strand does not necessarily refer to a continuous single stranded nucleic acid and may comprise a discontinuity, preferably at a site that is cleaved by Dicer. A guide strand is an antisense strand.

As used herein, "passenger strand" refers to an oligonucleotide strand of a dsRNA or dsRNA-containing molecule, which has a sequence that is complementary to that of the guide strand. As used herein, the passenger strand does not necessarily refer to a continuous single stranded nucleic acid and may comprise a discontinuity, preferably at a site that is cleaved by Dicer. A passenger strand is a sense strand.

By "target nucleic acid" is meant a nucleic acid sequence whose expression, level or activity is to be modulated. The target nucleic acid can be DNA or RNA. For agents that target AR, in certain embodiments target nucleic acid is β-catenin RNA. β-catenin RNA target sites can also interchangeably be referenced by corresponding cDNA sequences. Levels of β-catenin may also be targeted via targeting of upstream effectors of β-catenin, or the effects of modulated or misregulated β-catenin may also be modulated by targeting of molecules downstream of β-catenin in the β-catenin signalling pathway.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence. In one embodiment, a DsiRNA molecule of the invention comprises 19 to 30 (e.g., 19, 20, 21, 22, 23, 24, 25, 26, 27, 28, 29, or 30 or more) nucleotides that are complementary to one or more target nucleic acid molecules or a portion thereof.

In one embodiment, DsiRNA molecules of the invention that down regulate or reduce β-catenin gene expression are used for treating, preventing or reducing 3-catenin-related diseases or disorders (e.g., cancer) in a subject or organism.

In one embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (AR) nucleic acid molecule. In certain embodiments, a DsiRNA molecule of the invention possesses a length of duplexed nucleotides between 25 and 34 nucleotides in length (e.g., 25, 26, 27, 28, 29, 30, 31, 32, 33 or 34 nucleotides in length; optionally, all such nucleotides base pair with cognate nucleotides of the opposite strand). (Exemplary DsiRNA molecules of the invention are shown in FIG. 1, and below.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. Within certain aspects, the term "cell" refers specifically to mammalian cells, such as human cells, that contain one or more isolated dsRNA molecules of the present disclosure. In particular aspects, a cell processes dsRNAs or dsRNA-containing molecules resulting in RNA interference of target nucleic acids, and contains proteins and protein complexes required for RNAi, e.g., Dicer and RISC.

In certain embodiments, dsRNAs of the invention are Dicer substrate siRNAs ("DsiRNAs"). DsiRNAs can possess certain advantages as compared to inhibitory nucleic acids that are not dicer substrates ("non-DsiRNAs"). Such advantages include, but are not limited to, enhanced duration of effect of a DsiRNA relative to a non-DsiRNA, as well as enhanced inhibitory activity of a DsiRNA as compared to a non-DsiRNA (e.g., a 19-23mer siRNA) when each inhibitory nucleic acid is suitably formulated and assessed for inhibitory activity in a mammalian cell at the same concentration (in this latter scenario, the DsiRNA would be identified as more potent than the non-DsiRNA). Detection of the enhanced potency of a DsiRNA relative to a non-DsiRNA is often most readily achieved at a formulated concentration (e.g., transfection concentration of the dsRNA) that results in the DsiRNA eliciting approximately 30-70% knockdown activity upon a target RNA (e.g., a mRNA). For active DsiRNAs, such levels of knockdown activity are most often achieved at in vitro mammalian cell DsiRNA transfection concentrations of 1 nM or less of as suitably formulated, and in certain instances are observed at DsiRNA transfection concentrations of 200 pM or less, 100 pM or less, 50 pM or less, 20 pM or less, 10 pM or less, 5 pM or less, or even 1 pM or less. Indeed, due to the variability among DsiRNAs of the precise concentration at which 30-70% knockdown of a target RNA is observed, construction of an IC50 curve via assessment of the inhibitory activity of DsiRNAs and non-DsiRNAs across a range of effective concentrations is a preferred method for detecting the enhanced potency of a DsiRNA relative to a non-DsiRNA inhibitory agent.

In certain embodiments, a DsiRNA (in a state as initially formed, prior to dicer cleavage) is more potent at reducing β-catenin target gene expression in a mammalian cell than a 19, 20, 21, 22 or 23 base pair sequence that is contained within it. In certain such embodiments, a DsiRNA prior to dicer cleavage is more potent than a 19-21mer contained within it. Optionally, a DsiRNA prior to dicer cleavage is more potent than a 19 base pair duplex contained within it that is synthesized with symmetric dTdT overhangs (thereby forming a siRNA possessing 21 nucleotide strand lengths having dTdT overhangs). In certain embodiments, the DsiRNA is more potent than a 19-23mer siRNA (e.g., a 19 base pair duplex with dTdT overhangs) that targets at least 15 nucleotides of the 21 nucleotide target sequence that is recited for a DsiRNA of the invention (without wishing to be bound by theory, the identity of a such a target site for a DsiRNA is identified via identification of the Ago2 cleavage site for the DsiRNA; once the Ago2 cleavage site of a DsiRNA is determined for a DsiRNA, identification of the Ago2 cleavage site for any other inhibitory dsRNA can be performed and these Ago2 cleavage sites can be aligned, thereby determining the alignment of projected target nucleotide sequences for multiple dsRNAs). In certain related embodiments, the DsiRNA is more potent than a 19-23mer siRNA that targets at least 20 nucleotides of the 21 nucleotide target sequence that is recited for a DsiRNA of the invention. Optionally, the DsiRNA is more potent than a 19-23mer siRNA that targets the same 21 nucleotide target sequence that is recited for a DsiRNA of the invention. In certain embodiments, the DsiRNA is more potent than any 21mer siRNA that targets the same 21 nucleotide target sequence that is recited for a DsiRNA of the invention. Optionally, the DsiRNA is more potent than any 21 or 22mer siRNA that targets the same 21 nucleotide target sequence that is recited for a DsiRNA of the invention. In certain embodiments, the DsiRNA is more potent than any 21, 22 or 23mer siRNA that targets the same 21 nucleotide target sequence that is recited for a DsiRNA of the invention. As noted above, such potency assessments are most effectively performed upon dsRNAs that are suitably formulated (e.g., formulated with an appropriate transfection reagent) at a concentration of 1 nM or less. Optionally, an IC50 assessment is performed to evaluate activity across a range of effective inhibitory concentrations, thereby allowing for robust comparison of the relative potencies of dsRNAs so assayed.

The dsRNA molecules of the invention are added directly, or can be complexed with lipids (e.g., cationic lipids), packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in FIG. 1, and the below exemplary structures. Examples of such nucleic acid molecules consist essentially of sequences defined in these figures and exemplary structures. Furthermore, where such agents are modified in accordance with the below description of modification patterning of DsiRNA agents, chemically modified forms of constructs described in FIG. 1, and the below exemplary structures can be used in all uses described for the DsiRNA agents of FIG. 1, and the below exemplary structures.

In another aspect, the invention provides mammalian cells containing one or more DsiRNA molecules of this invention. The one or more DsiRNA molecules can independently be targeted to the same or different sites.

By "RNA" is meant a molecule comprising at least one, and preferably at least 4, 8 and 12 ribonucleotide residues. The at least 4, 8 or 12 RNA residues may be contiguous. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the DsiRNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the DsiRNA agents of the invention can be administered. A subject can be a mammal or mammalian cells, including a human or human cells.

The phrase "pharmaceutically acceptable carrier" refers to a carrier for the administration of a therapeutic agent. Exemplary carriers include saline, buffered saline, dextrose, water, glycerol, ethanol, and combinations thereof. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. The pharmaceutically acceptable carrier of the disclosed dsRNA compositions may be micellar structures, such as a liposomes, capsids, capsoids, polymeric nanocapsules, or polymeric microcapsules.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

Various methodologies of the instant invention include step that involves comparing a value, level, feature, characteristic, property, etc. to a "suitable control", referred to interchangeably herein as an "appropriate control". A "suitable control" or "appropriate control" is a control or standard familiar to one of ordinary skill in the art useful for comparison purposes. In one embodiment, a "suitable control" or "appropriate control" is a value, level, feature, characteristic, property, etc. determined prior to performing an RNAi methodology, as described herein. For example, a transcription rate, mRNA level, translation rate, protein level, biological activity, cellular characteristic or property, genotype, phenotype, etc. can be determined prior to introducing an RNA silencing agent (e.g., DsiRNA) of the invention into a cell or organism. In another embodiment, a "suitable control" or "appropriate control" is a value, level, feature, characteristic, property, etc. determined in a cell or organism, e.g., a control or normal cell or organism, exhibiting, for example, normal traits. In yet another embodiment, a "suitable control" or "appropriate control" is a predefined value, level, feature, characteristic, property, etc.

The term "in vitro" has its art recognized meaning, e.g., involving purified reagents or extracts, e.g., cell extracts. The term "in vivo" also has its art recognized meaning, e.g., involving living cells, e.g., immortalized cells, primary cells, cell lines, and/or cells in an organism.

"Treatment", or "treating" as used herein, is defined as the application or administration of a therapeutic agent (e.g., a DsiRNA agent or a vector or transgene encoding same) to a patient, or application or administration of a therapeutic agent to an isolated tissue or cell line from a patient, who has a disorder with the purpose to cure, heal, alleviate, relieve, alter, remedy, ameliorate, improve or affect the disease or disorder, or symptoms of the disease or disorder. The term "treatment" or "treating" is also used herein in the context of administering agents prophylactically. The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. The term "patient" includes human and other mammalian subjects that receive either prophylactic or therapeutic treatment.

Structures of Anti-β-Catenin DsiRNA Agents

In certain embodiments, the anti-β-catenin DsiRNA agents of the invention have the following structures:

In one such embodiment, the DsiRNA comprises:

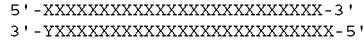

wherein "X"=RNA and "Y" is an overhang domain comprised of 1-4 RNA monomers that are optionally 2'-O-methyl RNA monomers. In a related embodiment, the DsiRNA comprises:

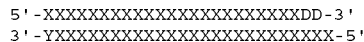

wherein "X"=RNA, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand.

DsiRNAs of the invention can carry a broad range of modification patterns (e.g., 2'-O-methyl RNA patterns, e.g., within extended DsiRNA agents). Certain modification patterns of the second strand of DsiRNAs of the invention are presented below.

In one embodiment, the DsiRNA comprises:

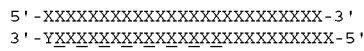

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

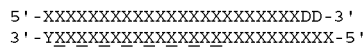

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers, and "D"=DNA. The top strand is the sense strand, and the bottom strand is the antisense strand.

In another such embodiment, the DsiRNA comprises:

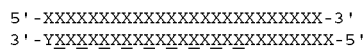

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

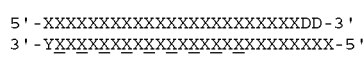

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In another such embodiment, the DsiRNA comprises:

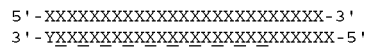

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers. In a related embodiment, the DsiRNA comprises:

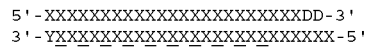

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In further embodiments, the DsiRNA comprises:

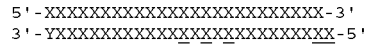

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

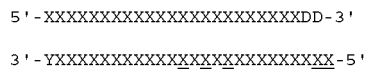

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

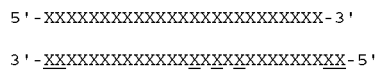

wherein "X"=RNA and "X"=2'-O-methyl RNA. In a further related embodiment, the DsiRNA comprises:

wherein "X"=RNA, "X"=2'-O-methyl RNA, and "D"=DNA. The top strand is the sense strand, and the bottom strand is the antisense strand.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In other embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In another related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
```

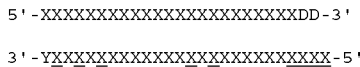

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

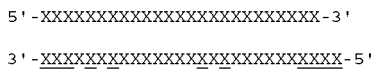

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X"=2'-O-methyl RNA. The top strand is the sense strand, and the bottom strand is the antisense strand. In a further related embodiment, the DsiRNA comprises:

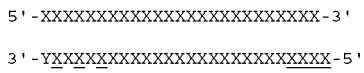

wherein "X"=RNA, "X"=2'-O-methyl RNA, and "D"=DNA. The top strand is the sense strand, and the bottom strand is the antisense strand.

In other embodiments, the DsiRNA comprises:

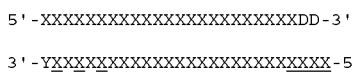

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

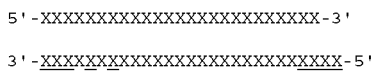

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

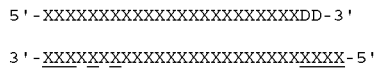

wherein "X"=RNA, "X"=2'-O-methyl RNA, and "D"=DNA. The top strand is the sense strand, and the bottom strand is the antisense strand.

In additional embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

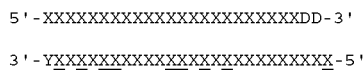

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

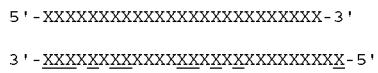

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand.

In further embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

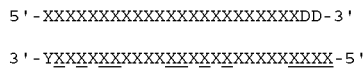

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In other embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In other embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In another related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In further embodiments, the DsiRNA comprises:

```
5'-XXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In additional embodiments, the DsiRNA comprises:

```
5'-XXXXXXXXXXXXXXXXXXXXXXX-3'
3'-YXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

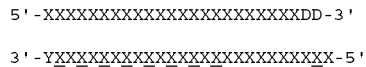

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

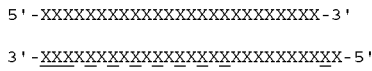

wherein "X"=RNA and "X"=2'-O-methyl RNA. The top strand is the sense strand, and the bottom strand is the antisense strand. In a further related embodiment, the DsiRNA comprises:

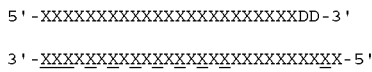

wherein "X"=RNA, "X"=2'-O-methyl RNA, and "D"=DNA. The top strand is the sense strand, and the bottom strand is the antisense strand.

In additional embodiments, the DsiRNA comprises:

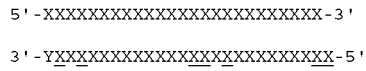

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

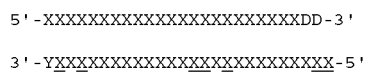

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

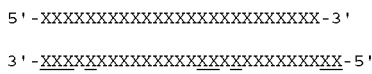

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand.

The above modification patterns can also be incorporated into, e.g., the extended DsiRNA structures and mismatch and/or frayed DsiRNA structures described below.

In another embodiment, the DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary 27mer DsiRNA agent with two terminal mismatched residues is shown:

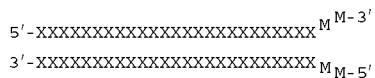

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand is the sense strand, and the bottom strand is the antisense strand. Alternatively, the bottom strand is the sense strand and the top strand is the antisense strand.

In certain additional embodiments, the present invention provides compositions for RNA interference (RNAi) that possess one or more base paired deoxyribonucleotides within a region of a double stranded ribonucleic acid (dsRNA) that is positioned 3' of a projected sense strand Dicer cleavage site and correspondingly 5' of a projected antisense strand Dicer cleavage site. The compositions of the invention comprise a dsRNA which is a precursor molecule, i.e., the dsRNA of the present invention is processed in vivo to produce an active small interfering nucleic acid (siRNA). The dsRNA is processed by Dicer to an active siRNA which is incorporated into RISC.

In certain embodiments, the DsiRNA agents of the invention can have the following exemplary structures (noting that any of the following exemplary structures can be combined, e.g., with the bottom strand modification patterns of the above-described structures—in one specific example, the bottom strand modification pattern shown in any of the above structures is applied to the 27 most 3' residues of the bottom strand of any of the following structures; in another specific example, the bottom strand modification pattern shown in any of the above structures upon the 23 most 3' residues of the bottom strand is applied to the 23 most 3' residues of the bottom strand of any of the following structures):

In one such embodiment, the DsiRNA comprises the following (an exemplary "right-extended", "DNA extended" DsiRNA):

5'-XXXXXXXXXXXXXXXXXXXXXXXXX$_{N*}$D$_N$DD-3'

3'-YXXXXXXXXXXXXXXXXXXXXXXXXX$_{N*}$D$_N$XX-5' wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

5'-XXXXXXXXXXXXXXXXXXXXXXXXX$_{N*}$D$_N$DD-3'

3'-YXXXXXXXXXXXXXXXXXXXXXXXXX$_{N*}$D$_N$DD-5' wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

5'-XXXXXXXXXXXXXXXXXXXXXXXXX$_{N*}$D$_N$DD-3'

3'-Y<u>XXXXXXXXXXXXXXXXXXXXXXXXX</u>$_{N*}$D$_N$ZZ-5' wherein "X"=RNA, "<u>X</u>"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

5'-XXXXXXXXXXXXXXXXXXXXXXXXX$_{N*}$D$_N$DD-3'

3'-Y<u>XXXXXXXXXXXXXXXXXXXXXXXXX</u>$_{N*}$D$_N$ZZ-5' wherein "X"=RNA, "<u>X</u>"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

5'-XXXXXXXXXXXXXXXXXXXXXXXXX$_{N*}$D$_N$DD-3'

3'-Y<u>XXXXXXXXXXXXXXXXXXXXXXXXX</u>$_{N*}$D$_N$ZZ-5' wherein "X"=RNA, "<u>X</u>"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

5'-XXXXXXXXXXXXXXXXXXXXXXXXX$_{N*}$[X1/D1]$_N$DD-3'

3'-YXXXXXXXXXXXXXXXXXXXXXXXXX$_{N*}$[X2/D2]$_N$ZZ-5' wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10, where at least one D1$_N$ is present in the top strand and is base paired with a corresponding D2$_N$ in the bottom strand. Optionally, D1$_N$ and D1$_{N+1}$ are base paired with corresponding D2$_N$ and D2$_{N+1}$; D1$_N$, D1$_{N+1}$ and D1$_{N+2}$ are base paired with corresponding D2$_N$, D1$_{N+1}$ and D1$_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In the structures depicted herein, the 5' end of either the sense strand or antisense strand can optionally comprise a phosphate group.

In another embodiment, a DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

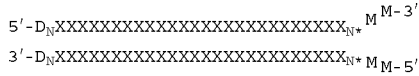

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-15 or, optionally, 1-8. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In one embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

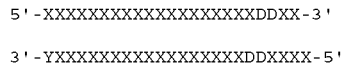

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand. The above structure is modeled to force Dicer to cleave a minimum of a 21mer duplex as its primary post-processing form. In embodiments where the bottom strand of the above structure is the antisense strand, the positioning of two deoxyribonucleotide residues at the ultimate and penultimate residues of the 5' end of the antisense strand may reduce off-target effects for a given compound.

In one embodiment, the DsiRNA comprises the following (an exemplary "left-extended", "DNA extended" DsiRNA):

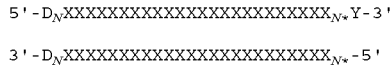

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

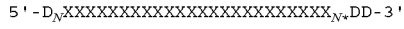
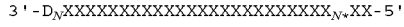

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

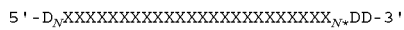
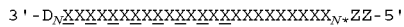

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

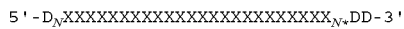
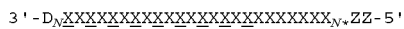

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

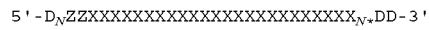
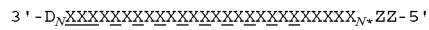

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

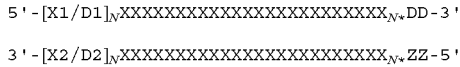

wherein "X"=RNA, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In a related embodiment, the DsiRNA comprises:

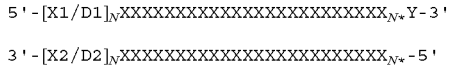

wherein "X"=RNA, "D"=DNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

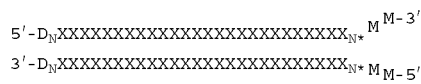

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In another embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. Exemplary structures for such a molecule are shown:

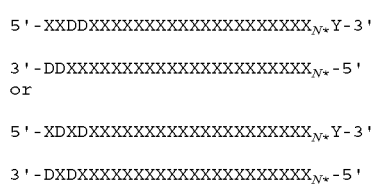

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In any of the above embodiments where the bottom strand of the above structure is the antisense strand, the positioning of two deoxyribonucleotide residues at the ultimate and penultimate residues of the 5' end of the antisense strand may reduce off-target effects.

In certain embodiments, the "D" residues of the above structures include at least one PS-DNA or PS-RNA. Optionally, the "D" residues of the above structures include at least one modified nucleotide that inhibits Dicer cleavage.

While the above-described "DNA-extended" DsiRNA agents can be categorized as either "left extended" or "right extended", DsiRNA agents comprising both left- and right-extended DNA-containing sequences within a single agent (e.g., both flanks surrounding a core dsRNA structure are dsDNA extensions) can also be generated and used in similar manner to those described herein for "right-extended" and "left-extended" agents.

In some embodiments, the DsiRNA of the instant invention further comprises a linking moiety or domain that joins the sense and antisense strands of a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetraloop.

In one embodiment, the DsiRNA agent has an asymmetric structure, with the sense strand having a 25-base pair length, and the antisense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the sense strand.

In another embodiment, the DsiRNA agent has an asymmetric structure, with the antisense strand having a 25-base pair length, and the sense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxyribonucleotides at the 3' end of the antisense strand.

Exemplary β-catenin targeting DsiRNA agents of the invention include the following:

TABLE 2

Selected Anti-β-catenin DsiRNAs, *Homo sapiens* Unique Duplexes

| | | |
|---|---|---|
| | 5'-CUGAGGGUAUUUGAAGUAUACCAta-3' | (SEQ ID NO: 8) |
| | 3'-<u>GGG</u>ACUCCCAUAAACUUCAUAUGGUAU-5' | (SEQ ID NO: 1117) |
| βc-240 Target: | 5'-CCCTGAGGGTATTTGAAGTATACCATA-3' | (SEQ ID NO: 2226) |
| | 5'-GGGUAUUUGAAGUAUACCAUACAac-3' | (SEQ ID NO: 9) |
| | 3'-<u>CUC</u>CCAUAAACUUCAUAUGGUAUGUUG-5' | (SEQ ID NO: 1118) |
| βc-244 Target: | 5'-GAGGGTATTTGAAGTATACCATACAAC-3' | (SEQ ID NO: 2227) |
| | 5'-AAGUAUACCAUACAACUGUUUUGaa-3' | (SEQ ID NO: 10) |
| | 3'-<u>ACU</u>UCAUAUGGUAUGUUGACAAAACUU-5' | (SEQ ID NO: 1119) |
| βc-253 Target: | 5'-TGAAGTATACCATACAACTGTTTTGAA-3' | (SEQ ID NO: 2228) |
| | 5'-ACCAUACAACUGUUUUGAAAAUCca-3' | (SEQ ID NO: 11) |
| | 3'-<u>UAU</u>GGUAUGUUGACAAAACUUUUAGGU-5' | (SEQ ID NO: 1120) |
| βc-259 Target: | 5'-ATACCATACAACTGTTTTGAAAATCCA-3' | (SEQ ID NO: 2229) |
| | 5'-ACAACUGUUUUGAAAAUCCAGCGtg-3' | (SEQ ID NO: 12) |
| | 3'-<u>UAU</u>GUUGACAAAACUUUUAGGUCGCAC-5' | (SEQ ID NO: 1121) |
| βc-264 Target: | 5'-ATACAACTGTTTTGAAAATCCAGCGTG-3' | (SEQ ID NO: 2230) |
| | 5'-GGGAUUUUCUCAGUCCUUCACUCaa-3' | (SEQ ID NO: 13) |
| | 3'-<u>GUC</u>CCUAAAAGAGUCAGGAAGUGAGUU-5' | (SEQ ID NO: 1122) |
| βc-496 Target: | 5'-CAGGGATTTTCTCAGTCCTTCACTCAA-3' | (SEQ ID NO: 2231) |
| | 5'-CUCAAGAACAAGUAGCUGAUAUUga-3' | (SEQ ID NO: 14) |
| | 3'-<u>GUG</u>AGUUCUUGUUCAUCGACUAUAACU-5' | (SEQ ID NO: 1123) |
| βc-516 Target: | 5'-CACTCAAGAACAAGTAGCTGATATTGA-3' | (SEQ ID NO: 2232) |
| | 5'-AACAAGUAGCUGAUAUUGAUGGAca-3' | (SEQ ID NO: 15) |
| | 3'-<u>UCU</u>UGUUCAUCGACUAUAACUACCUGU-5' | (SEQ ID NO: 1124) |
| βc-522 Target: | 5'-AGAACAAGTAGCTGATATTGATGGACA-3' | (SEQ ID NO: 2233) |

TABLE 2-continued

Selected Anti-β-catenin DsiRNAs, *Homo sapiens* Unique Duplexes

|  |  |  |  |
|---|---|---|---|
|  | 5'-CAAGUAGCUGAUAUUGAUGGACAgt-3' | (SEQ ID NO: 16) |
|  | 3'-UUGUUCAUCGACUAUAACUACCUGUCA-5' | (SEQ ID NO: 1125) |
| βc-524 Target: | 5'-AACAAGTAGCTGATATTGATGGACAGT-3' | (SEQ ID NO: 2234) |
|  | 5'-AUGGACAGUAUGCAAUGACUCGAgc-3' | (SEQ ID NO: 17) |
|  | 3'-ACUACCUGUCAUACGUUACUGAGCUCG-5' | (SEQ ID NO: 1126) |
| βc-540 Target: | 5'-TGATGGACAGTATGCAATGACTCGAGC-3' | (SEQ ID NO: 2235) |
|  | 5'-CUAUGUUCCCUGAGACAUUAGAUGa-3' | (SEQ ID NO: 18) |
|  | 3'-ACGAUACAAGGGACUCUGUAAUCUACU-5' | (SEQ ID NO: 1127) |
| βc-582 Target: | 5'-TGCTATGTTCCCTGAGACATTAGATGA-3' | (SEQ ID NO: 2236) |
|  | 5'-CUGAAACAUGCAGUUGUAAACUUga-3' | (SEQ ID NO: 19) |
|  | 3'-ACGACUUUGUACGUCAACAUUUGAACU-5' | (SEQ ID NO: 1128) |
| βc-686 Target: | 5'-TGCTGAAACATGCAGTTGTAAACTTGA-3' | (SEQ ID NO: 2237) |
|  | 5'-CAUGCAGUUGUAAACUUGAUUAAct-3' | (SEQ ID NO: 20) |
|  | 3'-UUGUACGUCAACAUUUGAACUAAUUGA-5' | (SEQ ID NO: 1129) |
| βc-692 Target: | 5'-AACATGCAGTTGTAAACTTGATTAACT-3' | (SEQ ID NO: 2238) |
|  | 5'-AGUUGUAAACUUGAUUAACUAUCaa-3' | (SEQ ID NO: 21) |
|  | 3'-CGUCAACAUUUGAACUAAUUGAUAGUU-5' | (SEQ ID NO: 1130) |
| βc-697 Target: | 5'-GCAGTTGTAAACTTGATTAACTATCAA-3' | (SEQ ID NO: 2239) |
|  | 5'-UUGAUUAACUAUCAAGAUGAUGCag-3' | (SEQ ID NO: 22) |
|  | 3'-UGAACUAAUUGAUAGUUCUACUACGUC-5' | (SEQ ID NO: 1131) |
| βc-707 Target: | 5'-ACTTGATTAACTATCAAGATGATGCAG-3' | (SEQ ID NO: 2240) |
|  | 5'-CUGAACUGACAAAACUGCUAAAUga-3' | (SEQ ID NO: 23) |
|  | 3'-GGGACUUGACUGUUUUGACGAUUUACU-5' | (SEQ ID NO: 1132) |
| βc-753 Target: | 5'-CCCTGAACTGACAAAACTGCTAAATGA-3' | (SEQ ID NO: 2241) |
|  | 5'-AGAUGGUGUCUGCUAUUGUACGUac-3' | (SEQ ID NO: 24) |
|  | 3'-AGUCUACCACAGACGAUAACAUGCAUG-5' | (SEQ ID NO: 1133) |
| βc-870 Target: | 5'-TCAGATGGTGTCTGCTATTGTACGTAC-3' | (SEQ ID NO: 2242) |
|  | 5'-ACGUACCAUGCAGAAUACAAAUGat-3' | (SEQ ID NO: 25) |
|  | 3'-CAUGCAUGGUACGUCUUAUGUUUACUA-5' | (SEQ ID NO: 1134) |
| βc-889 Target: | 5'-GTACGTACCATGCAGAATACAAATGAT-3' | (SEQ ID NO: 2243) |
|  | 5'-UACAACUCUCCACAACCUUUUAUta-3' | (SEQ ID NO: 26) |
|  | 3'-UAAUGUUGAGAGGUGUUGGAAAAUAAU-5' | (SEQ ID NO: 1135) |
| βc-1060 Target: | 5'-ATTACAACTCTCCACAACCTTTTATTA-3' | (SEQ ID NO: 2244) |
|  | 5'-CUCUCCACAACCUUUUAUUACAUca-3' | (SEQ ID NO: 27) |
|  | 3'-UUGAGAGGUGUUGGAAAAUAAUGUAGU-5' | (SEQ ID NO: 1136) |
| βc-1065 Target: | 5'-AACTCTCCACAACCTTTTATTACATCA-3' | (SEQ ID NO: 2245) |
|  | 5'-CACAACCUUUUAUUACAUCAAGAag-3' | (SEQ ID NO: 28) |
|  | 3'-AGGUGUUGGAAAAUAAUGUAGUUCUUC-5' | (SEQ ID NO: 1137) |
| βc-1070 Target: | 5'-TCCACAACCTTTTATTACATCAAGAAG-3' | (SEQ ID NO: 2246) |

TABLE 2-continued

Selected Anti-β-catenin DsiRNAs, *Homo sapiens* Unique Duplexes

|  |  |  |
|---|---|---|
|  | 5'-CUUUUAUUACAUCAAGAAGGAGCta-3' | (SEQ ID NO: 29) |
|  | 3'-UGGAAAAUAAUGUAGUUCUUCCUCGAU-5' | (SEQ ID NO: 1138) |
| βc-1076 Target: | 5'-ACCTTTTATTACATCAAGAAGGAGCTA-3' | (SEQ ID NO: 2247) |
|  | 5'-AAAACAAAUGUUAAAUUCUUGGCta-3' | (SEQ ID NO: 30) |
|  | 3'-UGUUUUGUUUACAAUUUAAGAACCGAU-5' | (SEQ ID NO: 1139) |
| βc-1154 Target: | 5'-ACAAAACAAATGTTAAATTCTTGGCTA-3' | (SEQ ID NO: 2248) |
|  | 5'-UACGACAGACUGCCUUCAAAUUUta-3' | (SEQ ID NO: 31) |
|  | 3'-UAAUGCUGUCUGACGGAAGUUUAAAAU-5' | (SEQ ID NO: 1140) |
| βc-1180 Target: | 5'-ATTACGACAGACTGCCTTCAAATTTTA-3' | (SEQ ID NO: 2249) |
|  | 5'-CAGACUGCCUUCAAAUUUUAGCUta-3' | (SEQ ID NO: 32) |
|  | 3'-CUGUCUGACGGAAGUUUAAAAUCGAAU-5' | (SEQ ID NO: 1141) |
| βc-1185 Target: | 5'-GACAGACTGCCTTCAAATTTTAGCTTA-3' | (SEQ ID NO: 2250) |
|  | 5'-CUUUAGUAAAUAUAAUGAGGACCta-3' | (SEQ ID NO: 33) |
|  | 3'-UCGAAAUCAUUUAUAUUACUCCUGGAU-5' | (SEQ ID NO: 1142) |
| βc-1260 Target: | 5'-AGCTTTAGTAAATATAATGAGGACCTA-3' | (SEQ ID NO: 2251) |
|  | 5'-AAAACUACUGUGGACCACAAGCAga-3' | (SEQ ID NO: 34) |
|  | 3'-CUUUUUGAUGACACCUGGUGUUCGUCU-5' | (SEQ ID NO: 1143) |
| βc-1294 Target: | 5'-GAAAAACTACTGTGGACCACAAGCAGA-3' | (SEQ ID NO: 2252) |
|  | 5'-AGUCAACGUCUUGUUCAGAACUGtc-3' | (SEQ ID NO: 35) |
|  | 3'-GUUCAGUUGCAGAACAAGUCUUGACAG-5' | (SEQ ID NO: 1144) |
| βc-1412 Target: | 5'-CAAGTCAACGTCTTGTTCAGAACTGTC-3' | (SEQ ID NO: 2253) |
|  | 5'-CGUCUUGUUCAGAACUGUCUUUGga-3' | (SEQ ID NO: 36) |
|  | 3'-UUGCAGAACAAGUCUUGACAGAAACCU-5' | (SEQ ID NO: 1145) |
| βc-1418 Target: | 5'-AACGTCTTGTTCAGAACTGTCTTTGGA-3' | (SEQ ID NO: 2254) |
|  | 5'-UGUUCAGAACUGUCUUUGGACUCtc-3' | (SEQ ID NO: 37) |
|  | 3'-GAACAAGUCUUGACAGAAACCUGAGAG-5' | (SEQ ID NO: 1146) |
| βc-1423 Target: | 5'-CTTGTTCAGAACTGTCTTTGGACTCTC-3' | (SEQ ID NO: 2255) |
|  | 5'-GGUUCAGAUGAUAUAAAUGUGGUca-3' | (SEQ ID NO: 38) |
|  | 3'-ACCCAAGUCUACUAUAUUUACACCAGU-5' | (SEQ ID NO: 1147) |
| βc-1520 Target: | 5'-TGGGTTCAGATGATATAAATGTGGTCA-3' | (SEQ ID NO: 2256) |
|  | 5'-UCUUUCUAACCUCACUUGCAAUAat-3' | (SEQ ID NO: 39) |
|  | 3'-UAAGAAAGAUUGGAGUGAACGUUAUUA-5' | (SEQ ID NO: 1148) |
| βc-1561 Target: | 5'-ATTCTTTCTAACCTCACTTGCAATAAT-3' | (SEQ ID NO: 2257) |
|  | 5'-CUCACUUGCAAUAAUUAUAAGAAca-3' | (SEQ ID NO: 40) |
|  | 3'-UGGAGUGAACGUUAUUAAUAUUCUUGU-5' | (SEQ ID NO: 1149) |
| βc-1571 Target: | 5'-ACCTCACTTGCAATAATTATAAGAACA-3' | (SEQ ID NO: 2258) |
|  | 5'-CAAUAAUUAUAAGAACAAGAUGAtg-3' | (SEQ ID NO: 41) |
|  | 3'-ACGUUAUUAAUAUUCUUGUUCUACUAC-5' | (SEQ ID NO: 1150) |
| βc-1579 Target: | 5'-TGCAATAATTATAAGAACAAGATGATG-3' | (SEQ ID NO: 2259) |

TABLE 2-continued

Selected Anti-β-catenin DsiRNAs, *Homo sapiens* Unique Duplexes

|  |  |  |  |
|---|---|---|---|
|  | 5'-GUAUAGAGGCUCUUGUGCGUACUgt-3' | (SEQ ID NO: 42) |  |
|  | 3'-<u>ACC</u>AUAUCUCCGAGAACACGCAUGACA-5' | (SEQ ID NO: 1151) |  |
| βc-1620 Target: | 5'-TGGTATAGAGGCTCTTGTGCGTACTGT-3' | (SEQ ID NO: 2260) |  |
|  | 5'-GGCUACUGUUGGAUUGAUUCGAAat-3' | (SEQ ID NO: 43) |  |
|  | 3'-<u>UUC</u>CGAUGACAACCUAACUAAGCUUUA-5' | (SEQ ID NO: 1152) |  |
| βc-1816 Target: | 5'-AAGGCTACTGTTGGATTGATTCGAAAT-3' | (SEQ ID NO: 2261) |  |
|  | 5'-CAUGGAAGAAAUAGUUGAAGGUUgt-3' | (SEQ ID NO: 44) |  |
|  | 3'-<u>GCG</u>UACCUUCUUUAUCAACUUCCAACA-5' | (SEQ ID NO: 1153) |  |
| βc-1987 Target: | 5'-CGCATGGAAGAAATAGTTGAAGGTTGT-3' | (SEQ ID NO: 2262) |  |
|  | 5'-UGGAAGAAAUAGUUGAAGGUUGUac-3' | (SEQ ID NO: 45) |  |
|  | 3'-<u>GUA</u>CCUUCUUUAUCAACUUCCAACAUG-5' | (SEQ ID NO: 1154) |  |
| βc-1989 Target: | 5'-CATGGAAGAAATAGTTGAAGGTTGTAC-3' | (SEQ ID NO: 2263) |  |
|  | 5'-AUUGAAAACAUCCAAAGAGUAGCtg-3' | (SEQ ID NO: 46) |  |
|  | 3'-<u>GGU</u>AACUUUUGUAGGUUUCUCAUCGAC-5' | (SEQ ID NO: 1155) |  |
| βc-2111 Target: | 5'-CCATTGAAAACATCCAAAGAGTAGCTG-3' | (SEQ ID NO: 2264) |  |
|  | 5'-GAGGACAAGCCACAAGAUUACAAga-3' | (SEQ ID NO: 47) |  |
|  | 3'-<u>GAC</u>UCCUGUUCGGUGUUCUAAUGUUCU-5' | (SEQ ID NO: 1156) |  |
| βc-2282 Target: | 5'-CTGAGGACAAGCCACAAGATTACAAGA-3' | (SEQ ID NO: 2265) |  |
|  | 5'-GAUACUGACCUGUAAAUCAUCCUtt-3' | (SEQ ID NO: 48) |  |
|  | 3'-<u>AAC</u>UAUGACUGGACAUUUAGUAGGAAA-5' | (SEQ ID NO: 1157) |  |
| βc-2624 Target: | 5'-TTGATACTGACCTGTAAATCATCCTTT-3' | (SEQ ID NO: 2266) |  |
|  | 5'-UUAGGUAAGAAGUUUUAAAAAGCca-3' | (SEQ ID NO: 49) |  |
|  | 3'-<u>GAA</u>AUCCAUUCUUCAAAAUUUUUCGGU-5' | (SEQ ID NO: 1158) |  |
| βc-2647 Target: | 5'-CTTTAGGTAAGAAGTTTTAAAAAGCCA-3' | (SEQ ID NO: 2267) |  |
|  | 5'-CAGGUAUAUACUUUGAAAGGAGAtg-3' | (SEQ ID NO: 50) |  |
|  | 3'-<u>UUG</u>UCCAUAUAUGAAACUUUCCUCUAC-5' | (SEQ ID NO: 1159) |  |
| βc-2770 Target: | 5'-AACAGGTATATACTTTGAAAGGAGATG-3' | (SEQ ID NO: 2268) |  |
|  | 5'-GAAGUUAUUAACUUUAAUGUUUUtt-3' | (SEQ ID NO: 51) |  |
|  | 3'-<u>ACC</u>UUCAAUAAUUGAAAUUACAAAAAA-5' | (SEQ ID NO: 1160) |  |
| βc-2848 Target: | 5'-TGGAAGTTATTAACTTTAATGTTTTTT-3' | (SEQ ID NO: 2269) |  |
|  | 5'-CCACAGCUUUUGCAACUUAAUACtc-3' | (SEQ ID NO: 52) |  |
|  | 3'-<u>ACG</u>GUGUCGAAAACGUUGAAUUAUGAG-5' | (SEQ ID NO: 1161) |  |
| βc-2874 Target: | 5'-TGCCACAGCTTTTGCAACTTAATACTC-3' | (SEQ ID NO: 2270) |  |
|  | 5'-CAUUUGCUGUUUUAAACAUUAAUag-3' | (SEQ ID NO: 53) |  |
|  | 3'-<u>UUG</u>UAAACGACAAAAUUUGUAAUUAUC-5' | (SEQ ID NO: 1162) |  |
| βc-2909 Target: | 5'-AACATTTGCTGTTTTAAACATTAATAG-3' | (SEQ ID NO: 2271) |  |
|  | 5'-CAAUUGAAGUAAACUUUUUGUUCtg-3' | (SEQ ID NO: 54) |  |
|  | 3'-<u>UUG</u>UUAACUUCAUUUGAAAAACAAGAC-5' | (SEQ ID NO: 1163) |  |
| βc-3074 Target: | 5'-AACAATTGAAGTAAACTTTTTGTTCTG-3' | (SEQ ID NO: 2272) |  |

TABLE 2-continued

Selected Anti-β-catenin DsiRNAs, *Homo sapiens* Unique Duplexes

```
                        5'-ACCCUAGCCUUGCUUGUUAAAUUtt-3'      (SEQ ID NO: 55)

3'-UUUGGGAUCGGAACGAACAAUUUAAAA-5'    (SEQ ID NO: 1164)

βc-3197 Target:         5'-AAACCCTAGCCTTGCTTGTTAAATTTT-3'    (SEQ ID NO: 2273)

5'-GCCUUGCUUGUUAAAUUUUUUUUtt-3'      (SEQ ID NO: 56)

3'-AUCGGAACGAACAAUUUAAAAAAAAAA-5'    (SEQ ID NO: 1165)

βc-3203 Target:         5'-TAGCCTTGCTTGTTAAATTTTTTTTT-3'     (SEQ ID NO: 2274)

5'-GAAGUAGCUCUUUUUUUUUUUUUtt-3'      (SEQ ID NO: 57)

3'-AACUUCAUCGAGAAAAAAAAAAAAAA-5'     (SEQ ID NO: 1166)

βc-3273 Target:         5'-TTGAAGTAGCTCTTTTTTTTTTTTTT-3'     (SEQ ID NO: 2275)

5'-GUAGUGUUAAGUUAUAGUGAAUAct-3'      (SEQ ID NO: 58)

3'-AGCAUCACAAUUCAAUAUCACUUAUGA-5'    (SEQ ID NO: 1167)

βc-3333 Target:         5'-TCGTAGTGTTAAGTTATAGTGAATACT-3'    (SEQ ID NO: 2276)

5'-GUGAAUACUGCUACAGCAAUUUCta-3'      (SEQ ID NO: 59)

3'-AUCACUUAUGACGAUGUCGUUAAAGAU-5'    (SEQ ID NO: 1168)

βc-3349 Target:         5'-TAGTGAATACTGCTACAGCAATTTCTA-3'    (SEQ ID NO: 2277)

5'-UACUGCUACAGCAAUUUCUAAUUtt-3'      (SEQ ID NO: 60)

3'-UUAUGACGAUGUCGUUAAAGAUUAAAA-5'    (SEQ ID NO: 1169)

βc-3354 Target:         5'-AATACTGCTACAGCAATTTCTAATTTT-3'    (SEQ ID NO: 2278)

5'-CUAAUUUUUAAGAAUUGAGUAAUgg-3'      (SEQ ID NO: 61)

3'-AAGAUUAAAAAUUCUUAACUCAUUACC-5'    (SEQ ID NO: 1170)

βc-3371 Target:         5'-TTCTAATTTTTAAGAATTGAGTAATGG-3'    (SEQ ID NO: 2279)

5'-UUUUAAGAAUUGAGUAAUGGUGUag-3'      (SEQ ID NO: 62)

3'-UAAAAAUUCUUAACUCAUUACCACAUC-5'    (SEQ ID NO: 1171)

βc-3376 Target:         5'-ATTTTTAAGAATTGAGTAATGGTGTAG-3'    (SEQ ID NO: 2280)

5'-CAUAAUCACUCUAAUUAAUUGUAat-3'      (SEQ ID NO: 63)

3'-AAGUAUUAGUGAGAUUAAUUAACAUUA-5'    (SEQ ID NO: 1172)

βc-3411 Target:         5'-TTCATAATCACTCTAATTAATTGTAAT-3'    (SEQ ID NO: 2281)

5'-UAAUUGUAAUCUGAAUAAAGUGUaa-3'      (SEQ ID NO: 64)

3'-UAAUUAACAUUAGACUUAUUUCACAUU-5'    (SEQ ID NO: 1173)

βc-3426 Target:         5'-ATTAATTGTAATCTGAATAAAGTGTAA-3'    (SEQ ID NO: 2282)

5'-GUAAUCUGAAUAAAGUGUAACAAtt-3'      (SEQ ID NO: 65)

3'-AACAUUAGACUUAUUUCACAUUGUUAA-5'    (SEQ ID NO: 1174)

βc-3431 Target:         5'-TTGTAATCTGAATAAAGTGTAACAATT-3'    (SEQ ID NO: 2283)

5'-UGAAUAAAGUGUAACAAUUGUGUag-3'      (SEQ ID NO: 66)

3'-AGACUUAUUUCACAUUGUUAACACAUC-5'    (SEQ ID NO: 1175)

βc-3437 Target:         5'-TCTGAATAAAGTGTAACAATTGTGTAG-3'    (SEQ ID NO: 2284)

5'-GUAGCCUUUUUGUAUAAAAUAGAca-3'      (SEQ ID NO: 67)

3'-CACAUCGGAAAAACAUAUUUUAUCUGU-5'    (SEQ ID NO: 1176)

βc-3458 Target:         5'-GTGTAGCCTTTTTGTATAAAATAGACA-3'    (SEQ ID NO: 2285)
```

TABLE 2-continued

Selected Anti-β-catenin DsiRNAs, *Homo sapiens* Unique Duplexes

|  |  |  |  |
|---|---|---|---|
| | 5'-UGUAUAAAAUAGACAAAUAGAAAat-3' | (SEQ ID NO: 68) |
| | 3'-<u>AAA</u>CAUAUUUUAUCUGUUUAUCUUUUA-5' | (SEQ ID NO: 1177) |
| βc-3468 Target: | 5'-TTTGTATAAAATAGACAAATAGAAAAT-3' | (SEQ ID NO: 2286) |
| | 5'-AAAAUGGUCCAAUUAGUUUCCUUtt-3' | (SEQ ID NO: 69) |
| | 3'-<u>UCU</u>UUUACCAGGUUAAUCAAAGGAAAA-5' | (SEQ ID NO: 1178) |
| βc-3488 Target: | 5'-AGAAAATGGTCCAATTAGTTTCCTTTT-3' | (SEQ ID NO: 2287) |
| | 5'-CCAAUUAGUUUCCUUUUUAAUAUGc-3' | (SEQ ID NO: 70) |
| | 3'-<u>CAG</u>GUUAAUCAAAGGAAAAAUUAUACG-5' | (SEQ ID NO: 1179) |
| βc-3496 Target: | 5'-GTCCAATTAGTTTCCTTTTTAATATGC-3' | (SEQ ID NO: 2288) |
| | 5'-UUUGAUCAAAACUAUUUGGGAUat-3' | (SEQ ID NO: 71) |
| | 3'-<u>AAA</u>AACUAGUUUUUGAUAAACCCUAUA-5' | (SEQ ID NO: 1180) |
| βc-3552 Target: | 5'-TTTTTGATCAAAACTATTTGGGATAT-3' | (SEQ ID NO: 2289) |
| | 5'-GAGGUGUUAUUUGGAACCUUGUUtt-3' | (SEQ ID NO: 72) |
| | 3'-<u>UUC</u>UCCACAAUAAACCUUGGAACAAAA-5' | (SEQ ID NO: 1181) |
| βc-3600 Target: | 5'-AAGAGGTGTTATTTGGAACCTTGTTTT-3' | (SEQ ID NO: 2290) |
| | 5'-GUUAUUUGGAACCUUGUUUUGGAca-3' | (SEQ ID NO: 73) |
| | 3'-<u>CAC</u>AAUAAACCUUGGAACAAAACCUGU-5' | (SEQ ID NO: 1182) |
| βc-3605 Target: | 5'-GTGTTATTTGGAACCTTGTTTTGGACA-3' | (SEQ ID NO: 2291) |
| | 5'-ACCUUGUUUUGGACAGUUUACCAgt-3' | (SEQ ID NO: 74) |
| | 3'-<u>CUU</u>GGAACAAAACCUGUCAAAUGGUCA-5' | (SEQ ID NO: 1183) |
| βc-3615 Target: | 5'-GAACCTTGTTTTGGACAGTTTACCAGT-3' | (SEQ ID NO: 2292) |
| | 5'-GAUACGAUGCUUCAAGAGAAAAUgc-3' | (SEQ ID NO: 75) |
| | 3'-<u>CAC</u>UAUGCUACGAAGUUCUCUUUUACG-5' | (SEQ ID NO: 1184) |
| βc-3674 Target: | 5'-GTGATACGATGCTTCAAGAGAAAATGC-3' | (SEQ ID NO: 2293) |
| | 5'-CAAGAGAAAAUGCGGUUAUAAAAaa-3' | (SEQ ID NO: 76) |
| | 3'-<u>AAG</u>UUCUCUUUUACGCCAAUAUUUUUU-5' | (SEQ ID NO: 1185) |
| βc-3686 Target: | 5'-TTCAAGAGAAATGCGGTTATAAAAAA-3' | (SEQ ID NO: 2294) |
| | 5'-GAAAAUGCGGUUAUAAAAAAUGGtt-3' | (SEQ ID NO: 77) |
| | 3'-<u>CUC</u>UUUUACGCCAAUAUUUUUUACCAA-5' | (SEQ ID NO: 1186) |
| βc-3691 Target: | 5'-GAGAAAATGCGGTTATAAAAAATGGTT-3' | (SEQ ID NO: 2295) |
| | 5'-GUUAUAAAAAAUGGUUCAGAAUUaa-3' | (SEQ ID NO: 78) |
| | 3'-<u>GCC</u>AAUAUUUUUUACCAAGUCUUAAUU-5' | (SEQ ID NO: 1187) |
| βc-3700 Target: | 5'-CGGTTATAAAAAATGGTTCAGAATTAA-3' | (SEQ ID NO: 2296) |
| | 5'-AAAAUGGUUCAGAAUUAAACUUUta-3' | (SEQ ID NO: 79) |
| | 3'-<u>UUU</u>UUUACCAAGUCUUAAUUUGAAAAU-5' | (SEQ ID NO: 1188) |
| βc-3707 Target: | 5'-AAAAAATGGTTCAGAATTAAACTTTTA-3' | (SEQ ID NO: 2297) |

TABLE 3

Selected Anti-β-catenin DsiRNAs, Duplexes Targeting Both Human and Mouse Sequences

| | | |
|---|---|---|
| | 5'-GCGUGGACAAUGGCUACUCAAGCtg-3' | (SEQ ID NO: 80) |
| | 3'-GUCGCACCUGUUACCGAUGAGUUCGAC-5' | (SEQ ID NO: 1189) |
| βc-284 Target: | 5'-CAGCGTGGACAATGGCTACTCAAGCTG-3' | (SEQ ID NO: 2298) |
| | 5'-CGUGGACAAUGGCUACUCAAGCUga-3' | (SEQ ID NO: 81) |
| | 3'-UCGCACCUGUUACCGAUGAGUUCGACU-5' | (SEQ ID NO: 1190) |
| βc-285 Target: | 5'-AGCGTGGACAATGGCTACTCAAGCTGA-3' | (SEQ ID NO: 2299) |
| | 5'-GUGGACAAUGGCUACUCAAGCUGat-3' | (SEQ ID NO: 82) |
| | 3'-CGCACCUGUUACCGAUGAGUUCGACUA-5' | (SEQ ID NO: 1191) |
| βc-286 Target: | 5'-GCGTGGACAATGGCTACTCAAGCTGAT-3' | (SEQ ID NO: 2300) |
| | 5'-UGGACAAUGGCUACUCAAGCUGAtt-3' | (SEQ ID NO: 83) |
| | 3'-GCACCUGUUACCGAUGAGUUCGACUAA-5' | (SEQ ID NO: 1192) |
| βc-287 Target: | 5'-CGTGGACAATGGCTACTCAAGCTGATT-3' | (SEQ ID NO: 2301) |
| | 5'-GGACAAUGGCUACUCAAGCUGAUtt-3' | (SEQ ID NO: 84) |
| | 3'-CACCUGUUACCGAUGAGUUCGACUAAA-5' | (SEQ ID NO: 1193) |
| βc-288 Target: | 5'-GTGGACAATGGCTACTCAAGCTGATTT-3' | (SEQ ID NO: 2302) |
| | 5'-GACAAUGGCUACUCAAGCUGAUUtg-3' | (SEQ ID NO: 85) |
| | 3'-ACCUGUUACCGAUGAGUUCGACUAAAC-5' | (SEQ ID NO: 1194) |
| βc-289 Target: | 5'-TGGACAATGGCTACTCAAGCTGATTTG-3' | (SEQ ID NO: 2303) |
| | 5'-ACAAUGGCUACUCAAGCUGAUUUga-3' | (SEQ ID NO: 86) |
| | 3'-CCUGUUACCGAUGAGUUCGACUAAACU-5' | (SEQ ID NO: 1195) |
| βc-290 Target: | 5'-GGACAATGGCTACTCAAGCTGATTTGA-3' | (SEQ ID NO: 2304) |
| | 5'-CAAUGGCUACUCAAGCUGAUUUGat-3' | (SEQ ID NO: 87) |
| | 3'-CUGUUACCGAUGAGUUCGACUAAACUA-5' | (SEQ ID NO: 1196) |
| βc-291 Target: | 5'-GACAATGGCTACTCAAGCTGATTTGAT-3' | (SEQ ID NO: 2305) |
| | 5'-UGAUGGAGUUGGACAUGGCCAUGga-3' | (SEQ ID NO: 88) |
| | 3'-AAACUACCUCAACCUGUACCGGUACCU-5' | (SEQ ID NO: 1197) |
| βc-312 Target: | 5'-TTTGATGGAGTTGGACATGGCCATGGA-3' | (SEQ ID NO: 2306) |
| | 5'-GAUGGAGUUGGACAUGGCCAUGGaa-3' | (SEQ ID NO: 89) |
| | 3'-AACUACCUCAACCUGUACCGGUACCUU-5' | (SEQ ID NO: 1198) |
| βc-313 Target: | 5'-TTGATGGAGTTGGACATGGCCATGGAA-3' | (SEQ ID NO: 2307) |
| | 5'-AUGGAGUUGGACAUGGCCAUGGAac-3' | (SEQ ID NO: 90) |
| | 3'-ACUACCUCAACCUGUACCGGUACCUUG-5' | (SEQ ID NO: 1199) |
| βc-314 Target: | 5'-TGATGGAGTTGGACATGGCCATGGAAC-3' | (SEQ ID NO: 2308) |
| | 5'-UGGAGUUGGACAUGGCCAUGGAAcc-3' | (SEQ ID NO: 91) |
| | 3'-CUACCUCAACCUGUACCGGUACCUUGG-5' | (SEQ ID NO: 1200) |
| βc-315 Target: | 5'-GATGGAGTTGGACATGGCCATGGAACC-3' | (SEQ ID NO: 2309) |
| | 5'-GGAGUUGGACAUGGCCAUGGAACca-3' | (SEQ ID NO: 92) |
| | 3'-UACCUCAACCUGUACCGGUACCUUGGU-5' | (SEQ ID NO: 1201) |
| βc-316 Target: | 5'-ATGGAGTTGGACATGGCCATGGAACCA-3' | (SEQ ID NO: 2310) |

TABLE 3-continued

Selected Anti-β-catenin DsiRNAs, Duplexes Targeting Both Human and Mouse Sequences

|  |  |  |  |
|---|---|---|---|
|  | 5'-GAGUUGGACAUGGCCAUGGAACCag-3' | (SEQ ID NO: 93) |  |
|  | 3'-<u>ACC</u>UCAACCUGUACCGGUACCUUGGUC-5' | (SEQ ID NO: 1202) |  |
| βc-317 Target: | 5'-TGGAGTTGGACATGGCCATGGAACCAG-3' | (SEQ ID NO: 2311) |  |
|  | 5'-AGUUGGACAUGGCCAUGGAACCAga-3' | (SEQ ID NO: 94) |  |
|  | 3'-<u>CCU</u>CAACCUGUACCGGUACCUUGGUCU-5' | (SEQ ID NO: 1203) |  |
| βc-318 Target: | 5'-GGAGTTGGACATGGCCATGGAACCAGA-3' | (SEQ ID NO: 2312) |  |
|  | 5'-UCUGGAAUCCAUUCUGGUGCCACta-3' | (SEQ ID NO: 95) |  |
|  | 3'-<u>UGA</u>GACCUUAGGUAAGACCACGGUGAU-5' | (SEQ ID NO: 1204) |  |
| βc-389 Target: | 5'-ACTCTGGAATCCATTCTGGTGCCACTA-3' | (SEQ ID NO: 2313) |  |
|  | 5'-CUGGAAUCCAUUCUGGUGCCACUac-3' | (SEQ ID NO: 96) |  |
|  | 3'-<u>GAG</u>ACCUUAGGUAAGACCACGGUGAUG-5' | (SEQ ID NO: 1205) |  |
| βc-390 Target: | 5'-CTCTGGAATCCATTCTGGTGCCACTAC-3' | (SEQ ID NO: 2314) |  |
|  | 5'-UGGAAUCCAUUCUGGUGCCACUAcc-3' | (SEQ ID NO: 97) |  |
|  | 3'-<u>AGA</u>CCUUAGGUAAGACCACGGUGAUGG-5' | (SEQ ID NO: 1206) |  |
| βc-391 Target: | 5'-TCTGGAATCCATTCTGGTGCCACTACC-3' | (SEQ ID NO: 2315) |  |
|  | 5'-GGAAUCCAUUCUGGUGCCACUACca-3' | (SEQ ID NO: 98) |  |
|  | 3'-<u>GAC</u>CUUAGGUAAGACCACGGUGAUGGU-5' | (SEQ ID NO: 1207) |  |
| βc-392 Target: | 5'-CTGGAATCCATTCTGGTGCCACTACCA-3' | (SEQ ID NO: 2316) |  |
|  | 5'-GAAUCCAUUCUGGUGCCACUACCac-3' | (SEQ ID NO: 99) |  |
|  | 3'-<u>ACC</u>UUAGGUAAGACCACGGUGAUGGUG-5' | (SEQ ID NO: 1208) |  |
| βc-393 Target: | 5'-TGGAATCCATTCTGGTGCCACTACCAC-3' | (SEQ ID NO: 2317) |  |
|  | 5'-UAGAUGAGGGCAUGCAGAUCCCAtc-3' | (SEQ ID NO: 100) |  |
|  | 3'-<u>UAA</u>UCUACUCCCGUACGUCUAGGGUAG-5' | (SEQ ID NO: 1209) |  |
| βc-600 Target: | 5'-ATTAGATGAGGGCATGCAGATCCCATC-3' | (SEQ ID NO: 2318) |  |
|  | 5'-AGAUGAGGGCAUGCAGAUCCCAUct-3' | (SEQ ID NO: 101) |  |
|  | 3'-<u>AAU</u>CUACUCCCGUACGUCUAGGGUAGA-5' | (SEQ ID NO: 1210) |  |
| βc-601 Target: | 5'-TTAGATGAGGGCATGCAGATCCCATCT-3' | (SEQ ID NO: 2319) |  |
|  | 5'-GAUGAGGGCAUGCAGAUCCCAUCta-3' | (SEQ ID NO: 102) |  |
|  | 3'-<u>AUC</u>UACUCCCGUACGUCUAGGGUAGAU-5' | (SEQ ID NO: 1211) |  |
| βc-602 Target: | 5'-TAGATGAGGGCATGCAGATCCCATCTA-3' | (SEQ ID NO: 2320) |  |
|  | 5'-AUGAGGGCAUGCAGAUCCCAUCUac-3' | (SEQ ID NO: 103) |  |
|  | 3'-<u>UCU</u>ACUCCCGUACGUCUAGGGUAGAUG-5' | (SEQ ID NO: 1212) |  |
| βc-603 Target: | 5'-AGATGAGGGCATGCAGATCCCATCTAC-3' | (SEQ ID NO: 2321) |  |
|  | 5'-UGAGGGCAUGCAGAUCCCAUCUACa-3' | (SEQ ID NO: 104) |  |
|  | 3'-<u>CUA</u>CUCCCGUACGUCUAGGGUAGAUGU-5' | (SEQ ID NO: 1213) |  |
| βc-604 Target: | 5'-GATGAGGGCATGCAGATCCCATCTACA-3' | (SEQ ID NO: 2322) |  |
|  | 5'-GAGGGCAUGCAGAUCCCAUCUACac-3' | (SEQ ID NO: 105) |  |
|  | 3'-<u>UAC</u>UCCCGUACGUCUAGGGUAGAUGUG-5' | (SEQ ID NO: 1214) |  |
| βc-605 Target: | 5'-ATGAGGGCATGCAGATCCCATCTACAC-3' | (SEQ ID NO: 2323) |  |

TABLE 3-continued

Selected Anti-β-catenin DsiRNAs, Duplexes Targeting Both Human and Mouse Sequences

|  |  |  |  |
|---|---|---|---|
|  | 5'-GCUGCUCAUCCCACUAAUGUCCAgc-3' | (SEQ ID NO: 106) |  |
|  | 3'-UACGACGAGUAGGGUGAUUACAGGUCG-5' | (SEQ ID NO: 1215) |  |
| βc-638 Target: | 5'-ATGCTGCTCATCCCACTAATGTCCAGC-3' | (SEQ ID NO: 2324) |  |
|  | 5'-CUGCUCAUCCCACUAAUGUCCAGCg-3' | (SEQ ID NO: 107) |  |
|  | 3'-ACGACGAGUAGGGUGAUUACAGGUCGC-5' | (SEQ ID NO: 1216) |  |
| βc-639 Target: | 5'-TGCTGCTCATCCCACTAATGTCCAGCG-3' | (SEQ ID NO: 2325) |  |
|  | 5'-UGCUCAUCCCACUAAUGUCCAGCgt-3' | (SEQ ID NO: 108) |  |
|  | 3'-CGACGAGUAGGGUGAUUACAGGUCGCA-5' | (SEQ ID NO: 1217) |  |
| βc-640 Target: | 5'-GCTGCTCATCCCACTAATGTCCAGCGT-3' | (SEQ ID NO: 2326) |  |
|  | 5'-GCUCAUCCCACUAAUGUCCAGCGtt-3' | (SEQ ID NO: 109) |  |
|  | 3'-GACGAGUAGGGUGAUUACAGGUCGCAA-5' | (SEQ ID NO: 1218) |  |
| βc-641 Target: | 5'-CTGCTCATCCCACTAATGTCCAGCGTT-3' | (SEQ ID NO: 2327) |  |
|  | 5'-CUCAUCCCACUAAUGUCCAGCGUtt-3' | (SEQ ID NO: 110) |  |
|  | 3'-ACGAGUAGGGUGAUUACAGGUCGCAAA-5' | (SEQ ID NO: 1219) |  |
| βc-642 Target: | 5'-TGCTCATCCCACTAATGTCCAGCGTTT-3' | (SEQ ID NO: 2328) |  |
|  | 5'-UCAUCCCACUAAUGUCCAGCGUUtg-3' | (SEQ ID NO: 111) |  |
|  | 3'-CGAGUAGGGUGAUUACAGGUCGCAAAC-5' | (SEQ ID NO: 1220) |  |
| βc-643 Target: | 5'-GCTCATCCCACTAATGTCCAGCGTTTG-3' | (SEQ ID NO: 2329) |  |
|  | 5'-CAUCCCACUAAUGUCCAGCGUUUgg-3' | (SEQ ID NO: 112) |  |
|  | 3'-GAGUAGGGUGAUUACAGGUCGCAAACC-5' | (SEQ ID NO: 1221) |  |
| βc-644 Target: | 5'-CTCATCCCACTAATGTCCAGCGTTTGG-3' | (SEQ ID NO: 2330) |  |
|  | 5'-AUCCCACUAAUGUCCAGCGUUUGgc-3' | (SEQ ID NO: 113) |  |
|  | 3'-AGUAGGGUGAUUACAGGUCGCAAACCG-5' | (SEQ ID NO: 1222) |  |
| βc-645 Target: | 5'-TCATCCCACTAATGTCCAGCGTTTGGC-3' | (SEQ ID NO: 2331) |  |
|  | 5'-UUGGCUGAACCAUCACAGAUGCUga-3' | (SEQ ID NO: 114) |  |
|  | 3'-CAAACCGACUUGGUAGUGUCUACGACU-5' | (SEQ ID NO: 1223) |  |
| βc-665 Target: | 5'-GTTTGGCTGAACCATCACAGATGCTGA-3' | (SEQ ID NO: 2332) |  |
|  | 5'-UGGCUGAACCAUCACAGAUGCUGaa-3' | (SEQ ID NO: 115) |  |
|  | 3'-AAACCGACUUGGUAGUGUCUACGACUU-5' | (SEQ ID NO: 1224) |  |
| βc-666 Target: | 5'-TTTGGCTGAACCATCACAGATGCTGAA-3' | (SEQ ID NO: 2333) |  |
|  | 5'-GGCUGAACCAUCACAGAUGCUGAaa-3' | (SEQ ID NO: 116) |  |
|  | 3'-AACCGACUUGGUAGUGUCUACGACUUU-5' | (SEQ ID NO: 1225) |  |
| βc-667 Target: | 5'-TTGGCTGAACCATCACAGATGCTGAAA-3' | (SEQ ID NO: 2334) |  |
|  | 5'-GAACUUGCCACACGUGCAAUCCtg-3' | (SEQ ID NO: 117) |  |
|  | 3'-GUCUUGAACGGUGUGCACGUUAGGGAC-5' | (SEQ ID NO: 1226) |  |
| βc-731 Target: | 5'-CAGAACTTGCCACACGTGCAATCCTG-3' | (SEQ ID NO: 2335) |  |
|  | 5'-AACUUGCCACACGUGCAAUCCCUga-3' | (SEQ ID NO: 118) |  |
|  | 3'-UCUUGAACGGUGUGCACGUUAGGGACU-5' | (SEQ ID NO: 1227) |  |
| βc-732 Target: | 5'-AGAACTTGCCACACGTGCAATCCCTGA-3' | (SEQ ID NO: 2336) |  |

TABLE 3-continued

Selected Anti-β-catenin DsiRNAs, Duplexes Targeting Both Human and Mouse Sequences

|  |  |  |  |
|---|---|---|---|
|  | 5'-GUUAUGGUCCAUCAGCUUUCUAAaa-3' | (SEQ ID NO: 119) |  |
|  | 3'-GUCAAUACCAGGUAGUCGAAAGAUUUU-5' | (SEQ ID NO: 1228) |  |
| βc-809 Target: | 5'-CAGTTATGGTCCATCAGCTTTCTAAAA-3' | (SEQ ID NO: 2337) |  |
|  | 5'-UUAUGGUCCAUCAGCUUUCUAAAaa-3' | (SEQ ID NO: 120) |  |
|  | 3'-UCAAUACCAGGUAGUCGAAAGAUUUUU-5' | (SEQ ID NO: 1229) |  |
| βc-810 Target: | 5'-AGTTATGGTCCATCAGCTTTCTAAAAA-3' | (SEQ ID NO: 2338) |  |
|  | 5'-AAAAAGGAAGCUUCCAGACACGCta-3' | (SEQ ID NO: 121) |  |
|  | 3'-GAUUUUUCCUUCGAAGGUCUGUGCGAU-5' | (SEQ ID NO: 1230) |  |
| βc-830 Target: | 5'-CTAAAAAGGAAGCTTCCAGACACGCTA-3' | (SEQ ID NO: 2339) |  |
|  | 5'-AAAAGGAAGCUUCCAGACACGCUat-3' | (SEQ ID NO: 122) |  |
|  | 3'-AUUUUUCCUUCGAAGGUCUGUGCGAUA-5' | (SEQ ID NO: 1231) |  |
| βc-831 Target: | 5'-TAAAAAGGAAGCTTCCAGACACGCTAT-3' | (SEQ ID NO: 2340) |  |
|  | 5'-ACCAUGCAGAAUACAAAUGAUGUag-3' | (SEQ ID NO: 123) |  |
|  | 3'-CAUGGUACGUCUUAUGUUUACUACAUC-5' | (SEQ ID NO: 1232) |  |
| βc-893 Target: | 5'-GTACCATGCAGAATACAAATGATGTAG-3' | (SEQ ID NO: 2341) |  |
|  | 5'-CCAUGCAGAAUACAAAUGAUGUAga-3' | (SEQ ID NO: 124) |  |
|  | 3'-AUGGUACGUCUUAUGUUUACUACAUCU-5' | (SEQ ID NO: 1233) |  |
| βc-894 Target: | 5'-TACCATGCAGAATACAAATGATGTAGA-3' | (SEQ ID NO: 2342) |  |
|  | 5'-CAUGCAGAAUACAAAUGAUGUAGaa-3' | (SEQ ID NO: 125) |  |
|  | 3'-UGGUACGUCUUAUGUUUACUACAUCUU-5' | (SEQ ID NO: 1234) |  |
| βc-895 Target: | 5'-ACCATGCAGAATACAAATGATGTAGAA-3' | (SEQ ID NO: 2343) |  |
|  | 5'-AUGCAGAAUACAAAUGAUGUAGAaa-3' | (SEQ ID NO: 126) |  |
|  | 3'-GGUACGUCUUAUGUUUACUACAUCUUU-5' | (SEQ ID NO: 1235) |  |
| βc-896 Target: | 5'-CCATGCAGAATACAAATGATGTAGAAA-3' | (SEQ ID NO: 2344) |  |
|  | 5'-UGCAGAAUACAAAUGAUGUAGAAac-3' | (SEQ ID NO: 127) |  |
|  | 3'-GUACGUCUUAUGUUUACUACAUCUUUG-5' | (SEQ ID NO: 1236) |  |
| βc-897 Target: | 5'-CATGCAGAATACAAATGATGTAGAAAC-3' | (SEQ ID NO: 2345) |  |
|  | 5'-GCAGAAUACAAAUGAUGUAGAAAca-3' | (SEQ ID NO: 128) |  |
|  | 3'-UACGUCUUAUGUUUACUACAUCUUUGU-5' | (SEQ ID NO: 1237) |  |
| βc-898 Target: | 5'-ATGCAGAATACAAATGATGTAGAAACA-3' | (SEQ ID NO: 2346) |  |
|  | 5'-CAGAAUACAAAUGAUGUAGAAACag-3' | (SEQ ID NO: 129) |  |
|  | 3'-ACGUCUUAUGUUUACUACAUCUUUGUC-5' | (SEQ ID NO: 1238) |  |
| βc-899 Target: | 5'-TGCAGAATACAAATGATGTAGAAACAG-3' | (SEQ ID NO: 2347) |  |
|  | 5'-AGAAUACAAAUGAUGUAGAAACAgc-3' | (SEQ ID NO: 130) |  |
|  | 3'-CGUCUUAUGUUUACUACAUCUUUGUCG-5' | (SEQ ID NO: 1239) |  |
| βc-900 Target: | 5'-GCAGAATACAAATGATGTAGAAACAGC-3' | (SEQ ID NO: 2348) |  |
|  | 5'-CUGGCCAUCUUUAAGUCUGGAGGca-3' | (SEQ ID NO: 131) |  |
|  | 3'-AUGACCGGUAGAAAUUCAGACCUCCGU-5' | (SEQ ID NO: 1240) |  |
| βc-977 Target: | 5'-TACTGGCCATCTTTAAGTCTGGAGGCA-3' | (SEQ ID NO: 2349) |  |

TABLE 3-continued

Selected Anti-β-catenin DsiRNAs, Duplexes Targeting Both Human and Mouse Sequences

|   |   |   |
|---|---|---|
|  | 5'-UGGCCAUCUUUAAGUCUGGAGGCat-3' | (SEQ ID NO: 132) |
|  | 3'-UGACCGGUAGAAAUUCAGACCUCCGUA-5' | (SEQ ID NO: 1241) |
| βc-978 Target: | 5'-ACTGGCCATCTTTAAGTCTGGAGGC-3' | (SEQ ID NO: 2350) |
|  | 5'-GAAGGAGCUAAAAUGGCAGUGCGtt-3' | (SEQ ID NO: 133) |
|  | 3'-UUCUUCCUCGAUUUUACCGUCACGCAA-5' | (SEQ ID NO: 1242) |
| βc-1091 Target: | 5'-AAGAAGGAGCTAAAATGGCAGTGCGTT-3' | (SEQ ID NO: 2351) |
|  | 5'-AAGGAGCUAAAAUGGCAGUGCGUtt-3' | (SEQ ID NO: 134) |
|  | 3'-UCUUCCUCGAUUUUACCGUCACGCAAA-5' | (SEQ ID NO: 1243) |
| βc-1092 Target: | 5'-AGAAGGAGCTAAAATGGCAGTGCGTTT-3' | (SEQ ID NO: 2352) |
|  | 5'-AGGAGCUAAAAUGGCAGUGCGUUta-3' | (SEQ ID NO: 135) |
|  | 3'-CUUCCUCGAUUUUACCGUCACGCAAAU-5' | (SEQ ID NO: 1244) |
| βc-1093 Target: | 5'-GAAGGAGCTAAAATGGCAGTGCGTTTA-3' | (SEQ ID NO: 2353) |
|  | 5'-GGAGCUAAAAUGGCAGUGCGUUUag-3' | (SEQ ID NO: 136) |
|  | 3'-UUCCUCGAUUUUACCGUCACGCAAAUC-5' | (SEQ ID NO: 1245) |
| βc-1094 Target: | 5'-AAGGAGCTAAAATGGCAGTGCGTTTAG-3' | (SEQ ID NO: 2354) |
|  | 5'-GAGCUAAAAUGGCAGUGCGUUUAgc-3' | (SEQ ID NO: 137) |
|  | 3'-UCCUCGAUUUUACCGUCACGCAAAUCG-5' | (SEQ ID NO: 1246) |
| βc-1095 Target: | 5'-AGGAGCTAAAATGGCAGTGCGTTTAGC-3' | (SEQ ID NO: 2355) |
|  | 5'-CUGUGGACCACAAGCAGAGUGCUga-3' | (SEQ ID NO: 138) |
|  | 3'-AUGACACCUGGUGUUCGUCUCACGACU-5' | (SEQ ID NO: 1247) |
| βc-1301 Target: | 5'-TACTGTGGACCACAAGCAGAGTGCTGA-3' | (SEQ ID NO: 2356) |
|  | 5'-UGUGGACCACAAGCAGAGUGCUGaa-3' | (SEQ ID NO: 139) |
|  | 3'-UGACACCUGGUGUUCGUCUCACGACUU-5' | (SEQ ID NO: 1248) |
| βc-1302 Target: | 5'-ACTGTGGACCACAAGCAGAGTGCTGAA-3' | (SEQ ID NO: 2357) |
|  | 5'-GUGGACCACAAGCAGAGUGCUGAag-3' | (SEQ ID NO: 140) |
|  | 3'-GACACCUGGUGUUCGUCUCACGACUUC-5' | (SEQ ID NO: 1249) |
| βc-1303 Target: | 5'-CTGTGGACCACAAGCAGAGTGCTGAAG-3' | (SEQ ID NO: 2358) |
|  | 5'-UGGACCACAAGCAGAGUGCUGAAgg-3' | (SEQ ID NO: 141) |
|  | 3'-ACACCUGGUGUUCGUCUCACGACUUCC-5' | (SEQ ID NO: 1250) |
| βc-1304 Target: | 5'-TGTGGACCACAAGCAGAGTGCTGAAGG-3' | (SEQ ID NO: 2359) |
|  | 5'-GGACCACAAGCAGAGUGCUGAAGgt-3' | (SEQ ID NO: 142) |
|  | 3'-CACCUGGUGUUCGUCUCACGACUUCCA-5' | (SEQ ID NO: 1251) |
| βc-1305 Target: | 5'-GTGGACCACAAGCAGAGTGCTGAAGGT-3' | (SEQ ID NO: 2360) |
|  | 5'-GACCACAAGCAGAGUGCUGAAGGtg-3' | (SEQ ID NO: 143) |
|  | 3'-ACCUGGUGUUCGUCUCACGACUUCCAC-5' | (SEQ ID NO: 1252) |
| βc-1306 Target: | 5'-TGGACCACAAGCAGAGTGCTGAAGGTG-3' | (SEQ ID NO: 2361) |
|  | 5'-ACCACAAGCAGAGUGCUGAAGGUgc-3' | (SEQ ID NO: 144) |
|  | 3'-CCUGGUGUUCGUCUCACGACUUCCACG-5' | (SEQ ID NO: 1253) |
| βc-1307 Target: | 5'-GGACCACAAGCAGAGTGCTGAAGGTGC-3' | (SEQ ID NO: 2362) |

TABLE 3-continued

Selected Anti-β-catenin DsiRNAs, Duplexes Targeting Both Human and Mouse Sequences

|   |   |   |   |
|---|---|---|---|
|   |   | 5'-CCACAAGCAGAGUGCUGAAGGUGct-3' | (SEQ ID NO: 145) |
|   |   | 3'-CUGGUGUUCGUCUCACGACUUCCACGA-5' | (SEQ ID NO: 1254) |
| βc-1308 | Target: | 5'-GACCACAAGCAGAGTGCTGAAGGTGCT-3' | (SEQ ID NO: 2363) |
|   |   | 5'-CACAAGCAGAGUGCUGAAGGUGCta-3' | (SEQ ID NO: 146) |
|   |   | 3'-UGGUGUUCGUCUCACGACUUCCACGAU-5' | (SEQ ID NO: 1255) |
| βc-1309 | Target: | 5'-ACCACAAGCAGAGTGCTGAAGGTGCTA-3' | (SEQ ID NO: 2364) |
|   |   | 5'-ACAAGCAGAGUGCUGAAGGUGCUat-3' | (SEQ ID NO: 147) |
|   |   | 3'-GGUGUUCGUCUCACGACUUCCACGAUA-5' | (SEQ ID NO: 1256) |
| βc-1310 | Target: | 5'-CCACAAGCAGAGTGCTGAAGGTGCTAT-3' | (SEQ ID NO: 2365) |
|   |   | 5'-CAAGCAGAGUGCUGAAGGUGCUAtc-3' | (SEQ ID NO: 148) |
|   |   | 3'-GUGUUCGUCUCACGACUUCCACGAUAG-5' | (SEQ ID NO: 1257) |
| βc-1311 | Target: | 5'-CACAAGCAGAGTGCTGAAGGTGCTATC-3' | (SEQ ID NO: 2366) |
|   |   | 5'-AAGCAGAGUGCUGAAGGUGCUAUct-3' | (SEQ ID NO: 149) |
|   |   | 3'-UGUUCGUCUCACGACUUCCACGAUAGA-5' | (SEQ ID NO: 1258) |
| βc-1312 | Target: | 5'-ACAAGCAGAGTGCTGAAGGTGCTATCT-3' | (SEQ ID NO: 2367) |
|   |   | 5'-AGCAGAGUGCUGAAGGUGCUAUCtg-3' | (SEQ ID NO: 150) |
|   |   | 3'-GUUCGUCUCACGACUUCCACGAUAGAC-5' | (SEQ ID NO: 1259) |
| βc-1313 | Target: | 5'-CAAGCAGAGTGCTGAAGGTGCTATCTG-3' | (SEQ ID NO: 2368) |
|   |   | 5'-GCAGAGUGCUGAAGGUGCUAUCUgt-3' | (SEQ ID NO: 151) |
|   |   | 3'-UUCGUCUCACGACUUCCACGAUAGACA-5' | (SEQ ID NO: 1260) |
| βc-1314 | Target: | 5'-AAGCAGAGTGCTGAAGGTGCTATCTGT-3' | (SEQ ID NO: 2369) |
|   |   | 5'-AACUGUCUUUGGACUCUCAGGAAtc-3' | (SEQ ID NO: 152) |
|   |   | 3'-UCUUGACAGAAACCUGAGAGUCCUUAG-5' | (SEQ ID NO: 1261) |
| βc-1430 | Target: | 5'-AGAACTGTCTTTGGACTCTCAGGAATC-3' | (SEQ ID NO: 2370) |
|   |   | 5'-ACUGUCUUUGGACUCUCAGGAAUct-3' | (SEQ ID NO: 153) |
|   |   | 3'-CUUGACAGAAACCUGAGAGUCCUUAGA-5' | (SEQ ID NO: 1262) |
| βc-1431 | Target: | 5'-GAACTGTCTTTGGACTCTCAGGAATCT-3' | (SEQ ID NO: 2371) |
|   |   | 5'-GAUGAUAUAAAUGUGGUCACCUGtg-3' | (SEQ ID NO: 154) |
|   |   | 3'-GUCUACUAUAUUUACACCAGUGGACAC-5' | (SEQ ID NO: 1263) |
| βc-1526 | Target: | 5'-CAGATGATATAAATGTGGTCACCTGTG-3' | (SEQ ID NO: 2372) |
|   |   | 5'-AUGAUAUAAAUGUGGUCACCUGUgc-3' | (SEQ ID NO: 155) |
|   |   | 3'-UCUACUAUAUUUACACCAGUGGACACG-5' | (SEQ ID NO: 1264) |
| βc-1527 | Target: | 5'-AGATGATATAAATGTGGTCACCTGTGC-3' | (SEQ ID NO: 2373) |
|   |   | 5'-UGAUAUAAAUGUGGUCACCUGUGca-3' | (SEQ ID NO: 156) |
|   |   | 3'-CUACUAUAUUUACACCAGUGGACACGU-5' | (SEQ ID NO: 1265) |
| βc-1528 | Target: | 5'-GATGATATAAATGTGGTCACCTGTGCA-3' | (SEQ ID NO: 2374) |
|   |   | 5'-GAUAUAAAUGUGGUCACCUGUGCag-3' | (SEQ ID NO: 157) |
|   |   | 3'-UACUAUAUUUACACCAGUGGACACGUC-5' | (SEQ ID NO: 1266) |
| βc-1529 | Target: | 5'-ATGATATAAATGTGGTCACCTGTGCAG-3' | (SEQ ID NO: 2375) |

TABLE 3-continued

Selected Anti-β-catenin DsiRNAs, Duplexes Targeting Both Human and Mouse Sequences

|  |  |  |
|---|---|---|
|  | 5'-AUAUAAAUGUGGUCACCUGUGCAgc-3' | (SEQ ID NO: 158) |
|  | 3'-ACUAUAUUUACACCAGUGGACACGUCG-5' | (SEQ ID NO: 1267) |
| βc-1530 Target: | 5'-TGATATAAATGTGGTCACCTGTGCAGC-3' | (SEQ ID NO: 2376) |
|  | 5'-UAUAAAUGUGGUCACCUGUGCAGct-3' | (SEQ ID NO: 159) |
|  | 3'-CUAUAUUUACACCAGUGGACACGUCGA-5' | (SEQ ID NO: 1268) |
| βc-1531 Target: | 5'-GATATAAATGTGGTCACCTGTGCAGCT-3' | (SEQ ID NO: 2377) |
|  | 5'-AUAAAUGUGGUCACCUGUGCAGCtg-3' | (SEQ ID NO: 160) |
|  | 3'-UAUAUUUACACCAGUGGACACGUCGAC-5' | (SEQ ID NO: 1269) |
| βc-1532 Target: | 5'-ATATAAATGTGGTCACCTGTGCAGCTG-3' | (SEQ ID NO: 2378) |
|  | 5'-UAAAUGUGGUCACCUGUGCAGCUgg-3' | (SEQ ID NO: 161) |
|  | 3'-AUAUUUACACCAGUGGACACGUCGACC-5' | (SEQ ID NO: 1270) |
| βc-1533 Target: | 5'-TATAAATGTGGTCACCTGTGCAGCTGG-3' | (SEQ ID NO: 2379) |
|  | 5'-AAAUGUGGUCACCUGUGCAGCUGga-3' | (SEQ ID NO: 162) |
|  | 3'-UAUUUACACCAGUGGACACGUCGACCU-5' | (SEQ ID NO: 1271) |
| βc-1534 Target: | 5'-ATAAATGTGGTCACCTGTGCAGCTGGA-3' | (SEQ ID NO: 2380) |
|  | 5'-AAUGUGGUCACCUGUGCAGCUGGaa-3' | (SEQ ID NO: 163) |
|  | 3'-AUUUACACCAGUGGACACGUCGACCUU-5' | (SEQ ID NO: 1272) |
| βc-1535 Target: | 5'-TAAATGTGGTCACCTGTGCAGCTGGAA-3' | (SEQ ID NO: 2381) |
|  | 5'-AUGUGGUCACCUGUGCAGCUGGAat-3' | (SEQ ID NO: 164) |
|  | 3'-UUUACACCAGUGGACACGUCGACCUUA-5' | (SEQ ID NO: 1273) |
| βc-1536 Target: | 5'-AAATGTGGTCACCTGTGCAGCTGGAAT-3' | (SEQ ID NO: 2382) |
|  | 5'-UGUGGUCACCUGUGCAGCUGGAAtt-3' | (SEQ ID NO: 165) |
|  | 3'-UUACACCAGUGGACACGUCGACCUUAA-5' | (SEQ ID NO: 1274) |
| βc-1537 Target: | 5'-AATGTGGTCACCTGTGCAGCTGGAATT-3' | (SEQ ID NO: 2383) |
|  | 5'-GUGGUCACCUGUGCAGCUGGAAUtc-3' | (SEQ ID NO: 166) |
|  | 3'-UACACCAGUGGACACGUCGACCUUAAG-5' | (SEQ ID NO: 1275) |
| βc-1538 Target: | 5'-ATGTGGTCACCTGTGCAGCTGGAATTC-3' | (SEQ ID NO: 2384) |
|  | 5'-UGGUCACCUGUGCAGCUGGAAUUct-3' | (SEQ ID NO: 167) |
|  | 3'-ACACCAGUGGACACGUCGACCUUAAGA-5' | (SEQ ID NO: 1276) |
| βc-1539 Target: | 5'-TGTGGTCACCTGTGCAGCTGGAATTCT-3' | (SEQ ID NO: 2385) |
|  | 5'-GGUCACCUGUGCAGCUGGAAUUCtt-3' | (SEQ ID NO: 168) |
|  | 3'-CACCAGUGGACACGUCGACCUUAAGAA-5' | (SEQ ID NO: 1277) |
| βc-1540 Target: | 5'-GTGGTCACCTGTGCAGCTGGAATTCTT-3' | (SEQ ID NO: 2386) |
|  | 5'-GUCACCUGUGCAGCUGGAAUUCUtt-3' | (SEQ ID NO: 169) |
|  | 3'-ACCAGUGGACACGUCGACCUUAAGAAA-5' | (SEQ ID NO: 1278) |
| βc-1541 Target: | 5'-TGGTCACCTGTGCAGCTGGAATTCTTT-3' | (SEQ ID NO: 2387) |
|  | 5'-UCACCUGUGCAGCUGGAAUUCUUtc-3' | (SEQ ID NO: 170) |
|  | 3'-CCAGUGGACACGUCGACCUUAAGAAAG-5' | (SEQ ID NO: 1279) |
| βc-1542 Target: | 5'-GGTCACCTGTGCAGCTGGAATTCTTTC-3' | (SEQ ID NO: 2388) |

TABLE 3-continued

Selected Anti-β-catenin DsiRNAs, Duplexes Targeting Both Human and Mouse Sequences

|  |  |  |  |
|---|---|---|---|
|  | 5'-CACCUGUGCAGCUGGAAUUCUUUct-3' | (SEQ ID NO: 171) |
|  | 3'-CAGUGGACACGUCGACCUUAAGAAAGA-5' | (SEQ ID NO: 1280) |
| βc-1543 Target: | 5'-GTCACCTGTGCAGCTGGAATTCTTTCT-3' | (SEQ ID NO: 2389) |
|  | 5'-ACCUGUGCAGCUGGAAUUCUUUCta-3' | (SEQ ID NO: 172) |
|  | 3'-AGUGGACACGUCGACCUUAAGAAAGAU-5' | (SEQ ID NO: 1281) |
| βc-1544 Target: | 5'-TCACCTGTGCAGCTGGAATTCTTTCTA-3' | (SEQ ID NO: 2390) |
|  | 5'-CCUGUGCAGCUGGAAUUCUUUCUaa-3' | (SEQ ID NO: 173) |
|  | 3'-GUGGACACGUCGACCUUAAGAAAGAUU-5' | (SEQ ID NO: 1282) |
| βc-1545 Target: | 5'-CACCTGTGCAGCTGGAATTCTTTCTAA-3' | (SEQ ID NO: 2391) |
|  | 5'-UCUAACCUCACUUGCAAUAAUUAta-3' | (SEQ ID NO: 174) |
|  | 3'-AAAGAUUGGAGUGAACGUUAUUAAUAU-5' | (SEQ ID NO: 1283) |
| βc-1565 Target: | 5'-TTTCTAACCTCACTTGCAATAATTATA-3' | (SEQ ID NO: 2392) |
|  | 5'-CUAACCUCACUUGCAAUAAUUAUaa-3' | (SEQ ID NO: 175) |
|  | 3'-AAGAUUGGAGUGAACGUUAUUAAUAUU-5' | (SEQ ID NO: 1284) |
| βc-1566 Target: | 5'-TTCTAACCTCACTTGCAATAATTATAA-3' | (SEQ ID NO: 2393) |
|  | 5'-UAACCUCACUUGCAAUAAUUAUAag-3' | (SEQ ID NO: 176) |
|  | 3'-AGAUUGGAGUGAACGUUAUUAAUAUUC-5' | (SEQ ID NO: 1285) |
| βc-1567 Target: | 5'-TCTAACCTCACTTGCAATAATTATAAG-3' | (SEQ ID NO: 2394) |
|  | 5'-AACCUCACUUGCAAUAAUUAUAAga-3' | (SEQ ID NO: 177) |
|  | 3'-GAUUGGAGUGAACGUUAUUAAUAUUCU-5' | (SEQ ID NO: 1286) |
| βc-1568 Target: | 5'-CTAACCTCACTTGCAATAATTATAAGA-3' | (SEQ ID NO: 2395) |
|  | 5'-ACCUCACUUGCAAUAAUUAUAAGaa-3' | (SEQ ID NO: 178) |
|  | 3'-AUUGGAGUGAACGUUAUUAAUAUUCUU-5' | (SEQ ID NO: 1287) |
| βc-1569 Target: | 5'-TAACCTCACTTGCAATAATTATAAGAA-3' | (SEQ ID NO: 2396) |
|  | 5'-GCUGGUGACAGGGAAGACAUCACtg-3' | (SEQ ID NO: 179) |
|  | 3'-CCCGACCACUGUCCCUUCUGUAGUGAC-5' | (SEQ ID NO: 1288) |
| βc-1652 Target: | 5'-GGGCTGGTGACAGGGAAGACATCACTG-3' | (SEQ ID NO: 2397) |
|  | 5'-CUGGUGACAGGGAAGACAUCACUga-3' | (SEQ ID NO: 180) |
|  | 3'-CCGACCACUGUCCCUUCUGUAGUGACU-5' | (SEQ ID NO: 1289) |
| βc-1653 Target: | 5'-GGCTGGTGACAGGGAAGACATCACTGA-3' | (SEQ ID NO: 2398) |
|  | 5'-UGGUGACAGGGAAGACAUCACUGag-3' | (SEQ ID NO: 181) |
|  | 3'-CGACCACUGUCCCUUCUGUAGUGACUC-5' | (SEQ ID NO: 1290) |
| βc-1654 Target: | 5'-GCTGGTGACAGGGAAGACATCACTGAG-3' | (SEQ ID NO: 2399) |
|  | 5'-GGUGACAGGGAAGACAUCACUGAgc-3' | (SEQ ID NO: 182) |
|  | 3'-GACCACUGUCCCUUCUGUAGUGACUCG-5' | (SEQ ID NO: 1291) |
| βc-1655 Target: | 5'-CTGGTGACAGGGAAGACATCACTGAGC-3' | (SEQ ID NO: 2400) |
|  | 5'-GUGACAGGGAAGACAUCACUGAGcc-3' | (SEQ ID NO: 183) |
|  | 3'-ACCACUGUCCCUUCUGUAGUGACUCGG-5' | (SEQ ID NO: 1292) |
| βc-1656 Target: | 5'-TGGTGACAGGGAAGACATCACTGAGCC-3' | (SEQ ID NO: 2401) |

TABLE 3-continued

Selected Anti-β-catenin DsiRNAs, Duplexes Targeting Both Human and Mouse Sequences

|  |  |  |  |
|---|---|---|---|
|  | 5'-UGACAGGGAAGACAUCACUGAGCct-3' | (SEQ ID NO: 184) |  |
|  | 3'-CCACUGUCCCUUCUGUAGUGACUCGGA-5' | (SEQ ID NO: 1293) |  |
| βc-1657 Target: | 5'-GGTGACAGGGAAGACATCACTGAGCCT-3' | (SEQ ID NO: 2402) |  |
|  | 5'-GACAGGGAAGACAUCACUGAGCCtg-3' | (SEQ ID NO: 185) |  |
|  | 3'-CACUGUCCCUUCUGUAGUGACUCGGAC-5' | (SEQ ID NO: 1294) |  |
| βc-1658 Target: | 5'-GTGACAGGGAAGACATCACTGAGCCTG-3' | (SEQ ID NO: 2403) |  |
|  | 5'-ACAGGGAAGACAUCACUGAGCCUgc-3' | (SEQ ID NO: 186) |  |
|  | 3'-ACUGUCCCUUCUGUAGUGACUCGGACG-5' | (SEQ ID NO: 1295) |  |
| βc-1659 Target: | 5'-TGACAGGGAAGACATCACTGAGCCTGC-3' | (SEQ ID NO: 2404) |  |
|  | 5'-CAGGGAAGACAUCACUGAGCCUGcc-3' | (SEQ ID NO: 187) |  |
|  | 3'-CUGUCCCUUCUGUAGUGACUCGGACGG-5' | (SEQ ID NO: 1296) |  |
| βc-1660 Target: | 5'-GACAGGGAAGACATCACTGAGCCTGCC-3' | (SEQ ID NO: 2405) |  |
|  | 5'-AGGGAAGACAUCACUGAGCCUGCca-3' | (SEQ ID NO: 188) |  |
|  | 3'-UGUCCCUUCUGUAGUGACUCGGACGGU-5' | (SEQ ID NO: 1297) |  |
| βc-1661 Target: | 5'-ACAGGGAAGACATCACTGAGCCTGCCA-3' | (SEQ ID NO: 2406) |  |
|  | 5'-GGGAAGACAUCACUGAGCCUGCCat-3' | (SEQ ID NO: 189) |  |
|  | 3'-GUCCCUUCUGUAGUGACUCGGACGGUA-5' | (SEQ ID NO: 1298) |  |
| βc-1662 Target: | 5'-CAGGGAAGACATCACTGAGCCTGCC-3' | (SEQ ID NO: 2407) |  |
|  | 5'-GGAAGACAUCACUGAGCCUGCCAtc-3' | (SEQ ID NO: 190) |  |
|  | 3'-UCCCUUCUGUAGUGACUCGGACGGUAG-5' | (SEQ ID NO: 1299) |  |
| βc-1663 Target: | 5'-AGGGAAGACATCACTGAGCCTGCCATC-3' | (SEQ ID NO: 2408) |  |
|  | 5'-GAAGACAUCACUGAGCCUGCCAUct-3' | (SEQ ID NO: 191) |  |
|  | 3'-CCCUUCUGUAGUGACUCGGACGGUAGA-5' | (SEQ ID NO: 1300) |  |
| βc-1664 Target: | 5'-GGGAAGACATCACTGAGCCTGCCATCT-3' | (SEQ ID NO: 2409) |  |
|  | 5'-AAGACAUCACUGAGCCUGCCAUCtg-3' | (SEQ ID NO: 192) |  |
|  | 3'-CCUUCUGUAGUGACUCGGACGGUAGAC-5' | (SEQ ID NO: 1301) |  |
| βc-1665 Target: | 5'-GGAAGACATCACTGAGCCTGCCATCTG-3' | (SEQ ID NO: 2410) |  |
|  | 5'-AGACAUCACUGAGCCUGCCAUCUgt-3' | (SEQ ID NO: 193) |  |
|  | 3'-CUUCUGUAGUGACUCGGACGGUAGACA-5' | (SEQ ID NO: 1302) |  |
| βc-1666 Target: | 5'-GAAGACATCACTGAGCCTGCCATCTGT-3' | (SEQ ID NO: 2411) |  |
|  | 5'-GACAUCACUGAGCCUGCCAUCUGtg-3' | (SEQ ID NO: 194) |  |
|  | 3'-UUCUGUAGUGACUCGGACGGUAGACAC-5' | (SEQ ID NO: 1303) |  |
| βc-1667 Target: | 5'-AAGACATCACTGAGCCTGCCATCTGTG-3' | (SEQ ID NO: 2412) |  |
|  | 5'-ACAUCACUGAGCCUGCCAUCUGUgc-3' | (SEQ ID NO: 195) |  |
|  | 3'-UCUGUAGUGACUCGGACGGUAGACACG-5' | (SEQ ID NO: 1304) |  |
| βc-1668 Target: | 5'-AGACATCACTGAGCCTGCCATCTGTGC-3' | (SEQ ID NO: 2413) |  |
|  | 5'-CAUCACUGAGCCUGCCAUCUGUGct-3' | (SEQ ID NO: 196) |  |
|  | 3'-CUGUAGUGACUCGGACGGUAGACACGA-5' | (SEQ ID NO: 1305) |  |
| βc-1669 Target: | 5'-GACATCACTGAGCCTGCCATCTGTGCT-3' | (SEQ ID NO: 2414) |  |

TABLE 3-continued

Selected Anti-β-catenin DsiRNAs, Duplexes Targeting Both Human and Mouse Sequences

|  |  |  |  |
|---|---|---|---|
|  | 5'-AUCACUGAGCCUGCCAUCUGUGCtc-3' | (SEQ ID NO: 197) |  |
|  | 3'-UGUAGUGACUCGGACGUAGACACGAG-5' | (SEQ ID NO: 1306) |  |
| βc-1670 Target: | 5'-ACATCACTGAGCCTGCCATCTGTGCTC-3' | (SEQ ID NO: 2415) |  |
|  | 5'-UCACUGAGCCUGCCAUCUGUGCUct-3' | (SEQ ID NO: 198) |  |
|  | 3'-GUAGUGACUCGGACGGUAGACACGAGA-5' | (SEQ ID NO: 1307) |  |
| βc-1671 Target: | 5'-CATCACTGAGCCTGCCATCTGTGCTCT-3' | (SEQ ID NO: 2416) |  |
|  | 5'-CACUGAGCCUGCCAUCUGUGCUCtt-3' | (SEQ ID NO: 199) |  |
|  | 3'-UAGUGACUCGGACGGUAGACACGAGAA-5' | (SEQ ID NO: 1308) |  |
| βc-1672 Target: | 5'-ATCACTGAGCCTGCCATCTGTGCTCTT-3' | (SEQ ID NO: 2417) |  |
|  | 5'-ACUGAGCCUGCCAUCUGUGCUCUtc-3' | (SEQ ID NO: 200) |  |
|  | 3'-AGUGACUCGGACGGUAGACACGAGAAG-5' | (SEQ ID NO: 1309) |  |
| βc-1673 Target: | 5'-TCACTGAGCCTGCCATCTGTGCTCTTC-3' | (SEQ ID NO: 2418) |  |
|  | 5'-CUGAGCCUGCCAUCUGUGCUCUUcg-3' | (SEQ ID NO: 201) |  |
|  | 3'-GUGACUCGGACGGUAGACACGAGAAGC-5' | (SEQ ID NO: 1310) |  |
| βc-1674 Target: | 5'-CACTGAGCCTGCCATCTGTGCTCTTCG-3' | (SEQ ID NO: 2419) |  |
|  | 5'-UGAGCCUGCCAUCUGUGCUCUUCgt-3' | (SEQ ID NO: 202) |  |
|  | 3'-UGACUCGGACGGUAGACACGAGAAGCA-5' | (SEQ ID NO: 1311) |  |
| βc-1675 Target: | 5'-ACTGAGCCTGCCATCTGTGCTCTTCGT-3' | (SEQ ID NO: 2420) |  |
|  | 5'-GAGCCUGCCAUCUGUGCUCUUCGtc-3' | (SEQ ID NO: 203) |  |
|  | 3'-GACUCGGACGGUAGACACGAGAAGCAG-5' | (SEQ ID NO: 1312) |  |
| βc-1676 Target: | 5'-CTGAGCCTGCCATCTGTGCTCTTCGTC-3' | (SEQ ID NO: 2421) |  |
|  | 5'-AGCCUGCCAUCUGUGCUCUUCGUca-3' | (SEQ ID NO: 204) |  |
|  | 3'-ACUCGGACGGUAGACACGAGAAGCAGU-5' | (SEQ ID NO: 1313) |  |
| βc-1677 Target: | 5'-TGAGCCTGCCATCTGTGCTCTTCGTCA-3' | (SEQ ID NO: 2422) |  |
|  | 5'-GCCUGCCAUCUGUGCUCUUCGUCat-3' | (SEQ ID NO: 205) |  |
|  | 3'-CUCGGACGGUAGACACGAGAAGCAGUA-5' | (SEQ ID NO: 1314) |  |
| βc-1678 Target: | 5'-GAGCCTGCCATCTGTGCTCTTCGTC-3' | (SEQ ID NO: 2423) |  |
|  | 5'-CCUGCCAUCUGUGCUCUUCGUCAtc-3' | (SEQ ID NO: 206) |  |
|  | 3'-UCGGACGGUAGACACGAGAAGCAGUAG-5' | (SEQ ID NO: 1315) |  |
| βc-1679 Target: | 5'-AGCCTGCCATCTGTGCTCTTCGTCATC-3' | (SEQ ID NO: 2424) |  |
|  | 5'-CUGCCAUCUGUGCUCUUCGUCAUct-3' | (SEQ ID NO: 207) |  |
|  | 3'-CGGACGGUAGACACGAGAAGCAGUAGA-5' | (SEQ ID NO: 1316) |  |
| βc-1680 Target: | 5'-GCCTGCCATCTGTGCTCTTCGTCATCT-3' | (SEQ ID NO: 2425) |  |
|  | 5'-UGCCAUCUGUGCUCUUCGUCAUCtg-3' | (SEQ ID NO: 208) |  |
|  | 3'-GGACGGUAGACACGAGAAGCAGUAGAC-5' | (SEQ ID NO: 1317) |  |
| βc-1681 Target: | 5'-CCTGCCATCTGTGCTCTTCGTCATCTG-3' | (SEQ ID NO: 2426) |  |
|  | 5'-GCCAUCUGUGCUCUUCGUCAUCUga-3' | (SEQ ID NO: 209) |  |
|  | 3'-GACGGUAGACACGAGAAGCAGUAGACU-5' | (SEQ ID NO: 1318) |  |
| βc-1682 Target: | 5'-CTGCCATCTGTGCTCTTCGTCATCTGA-3' | (SEQ ID NO: 2427) |  |

TABLE 3-continued

Selected Anti-β-catenin DsiRNAs, Duplexes Targeting Both Human and Mouse Sequences

|  |  |  |  |
|---|---|---|---|
|  | 5'-CCAUCUGUGCUCUUCGUCAUCUGAc-3' | (SEQ ID NO: 210) |
|  | 3'-ACGGUAGACACGAGAAGCAGUAGACUG-5' | (SEQ ID NO: 1319) |
| βc-1683 Target: | 5'-TGCCATCTGTGCTCTTCGTCATCTGAC-3' | (SEQ ID NO: 2428) |
|  | 5'-CAUCUGUGCUCUUCGUCAUCUGAcc-3' | (SEQ ID NO: 211) |
|  | 3'-CGGUAGACACGAGAAGCAGUAGACUGG-5' | (SEQ ID NO: 1320) |
| βc-1684 Target: | 5'-GCCATCTGTGCTCTTCGTCATCTGACC-3' | (SEQ ID NO: 2429) |
|  | 5'-AUCUGUGCUCUUCGUCAUCUGACca-3' | (SEQ ID NO: 212) |
|  | 3'-GGUAGACACGAGAAGCAGUAGACUGGU-5' | (SEQ ID NO: 1321) |
| βc-1685 Target: | 5'-CCATCTGTGCTCTTCGTCATCTGACCA-3' | (SEQ ID NO: 2430) |
|  | 5'-UCUGUGCUCUUCGUCAUCUGACCag-3' | (SEQ ID NO: 213) |
|  | 3'-GUAGACACGAGAAGCAGUAGACUGGUC-5' | (SEQ ID NO: 1322) |
| βc-1686 Target: | 5'-CATCTGTGCTCTTCGTCATCTGACCAG-3' | (SEQ ID NO: 2431) |
|  | 5'-CUGUGCUCUUCGUCAUCUGACCAgc-3' | (SEQ ID NO: 214) |
|  | 3'-UAGACACGAGAAGCAGUAGACUGGUCG-5' | (SEQ ID NO: 1323) |
| βc-1687 Target: | 5'-ATCTGTGCTCTTCGTCATCTGACCAGC-3' | (SEQ ID NO: 2432) |
|  | 5'-UGUGCUCUUCGUCAUCUGACCAGcc-3' | (SEQ ID NO: 215) |
|  | 3'-AGACACGAGAAGCAGUAGACUGGUCGG-5' | (SEQ ID NO: 1324) |
| βc-1688 Target: | 5'-TCTGTGCTCTTCGTCATCTGACCAGCC-3' | (SEQ ID NO: 2433) |
|  | 5'-GUGCUCUUCGUCAUCUGACCAGCcg-3' | (SEQ ID NO: 216) |
|  | 3'-GACACGAGAAGCAGUAGACUGGUCGGC-5' | (SEQ ID NO: 1325) |
| βc-1689 Target: | 5'-CTGTGCTCTTCGTCATCTGACCAGCCG-3' | (SEQ ID NO: 2434) |
|  | 5'-UGCUCUUCGUCAUCUGACCAGCCga-3' | (SEQ ID NO: 217) |
|  | 3'-ACACGAGAAGCAGUAGACUGGUCGGCU-5' | (SEQ ID NO: 1326) |
| βc-1690 Target: | 5'-TGTGCTCTTCGTCATCTGACCAGCCGA-3' | (SEQ ID NO: 2435) |
|  | 5'-GCUCUUCGUCAUCUGACCAGCCGac-3' | (SEQ ID NO: 218) |
|  | 3'-CACGAGAAGCAGUAGACUGGUCGGCUG-5' | (SEQ ID NO: 1327) |
| βc-1691 Target: | 5'-GTGCTCTTCGTCATCTGACCAGCCGAC-3' | (SEQ ID NO: 2436) |
|  | 5'-CUCUUCGUCAUCUGACCAGCCGAca-3' | (SEQ ID NO: 219) |
|  | 3'-ACGAGAAGCAGUAGACUGGUCGGCUGU-5' | (SEQ ID NO: 1328) |
| βc-1692 Target: | 5'-TGCTCTTCGTCATCTGACCAGCCGACA-3' | (SEQ ID NO: 2437) |
|  | 5'-UCUUCGUCAUCUGACCAGCCGACac-3' | (SEQ ID NO: 220) |
|  | 3'-CGAGAAGCAGUAGACUGGUCGGCUGUG-5' | (SEQ ID NO: 1329) |
| βc-1693 Target: | 5'-GCTCTTCGTCATCTGACCAGCCGACAC-3' | (SEQ ID NO: 2438) |
|  | 5'-CUUCGUCAUCUGACCAGCCGACAcc-3' | (SEQ ID NO: 221) |
|  | 3'-GAGAAGCAGUAGACUGGUCGGCUGUGG-5' | (SEQ ID NO: 1330) |
| βc-1694 Target: | 5'-CTCTTCGTCATCTGACCAGCCGACACC-3' | (SEQ ID NO: 2439) |
|  | 5'-UUCGUCAUCUGACCAGCCGACACca-3' | (SEQ ID NO: 222) |
|  | 3'-AGAAGCAGUAGACUGGUCGGCUGUGGU-5' | (SEQ ID NO: 1331) |
| βc-1695 Target: | 5'-TCTTCGTCATCTGACCAGCCGACACCA-3' | (SEQ ID NO: 2440) |

TABLE 3-continued

Selected Anti-β-catenin DsiRNAs, Duplexes Targeting Both Human and Mouse Sequences

|  |  |  |  |
|---|---|---|---|
|  | 5'-CACCCACCAUCCCACUGGCCUCUGa-3' | (SEQ ID NO: 223) |  |
|  | 3'-AUGUGGGUGGUAGGGUGACCGGAGACU-5' | (SEQ ID NO: 1332) |  |
| βc-1787 Target: | 5'-TACACCCACCATCCCACTGGCCTCTGA-3' | (SEQ ID NO: 2441) |  |
|  | 5'-ACCCACCAUCCCACUGGCCUCUGat-3' | (SEQ ID NO: 224) |  |
|  | 3'-UGUGGGUGGUAGGGUGACCGGAGACUA-5' | (SEQ ID NO: 1333) |  |
| βc-1788 Target: | 5'-ACACCCACCATCCCACTGGCCTCTGAT-3' | (SEQ ID NO: 2442) |  |
|  | 5'-CCCACCAUCCCACUGGCCUCUGAta-3' | (SEQ ID NO: 225) |  |
|  | 3'-GUGGGUGGUAGGGUGACCGGAGACUAU-5' | (SEQ ID NO: 1334) |  |
| βc-1789 Target: | 5'-CACCCACCATCCCACTGGCCTCTGATA-3' | (SEQ ID NO: 2443) |  |
|  | 5'-CCACCAUCCCACUGGCCUCUGAUaa-3' | (SEQ ID NO: 226) |  |
|  | 3'-UGGGUGGUAGGGUGACCGGAGACUAUU-5' | (SEQ ID NO: 1335) |  |
| βc-1790 Target: | 5'-ACCCACCATCCCACTGGCCTCTGATAA-3' | (SEQ ID NO: 2444) |  |
|  | 5'-CACCAUCCCACUGGCCUCUGAUAaa-3' | (SEQ ID NO: 227) |  |
|  | 3'-GGGUGGUAGGGUGACCGGAGACUAUUU-5' | (SEQ ID NO: 1336) |  |
| βc-1791 Target: | 5'-CCCACCATCCCACTGGCCTCTGATAAA-3' | (SEQ ID NO: 2445) |  |
|  | 5'-ACCAUCCCACUGGCCUCUGAUAAag-3' | (SEQ ID NO: 228) |  |
|  | 3'-GGUGGUAGGGUGACCGGAGACUAUUUC-5' | (SEQ ID NO: 1337) |  |
| βc-1792 Target: | 5'-CCACCATCCCACTGGCCTCTGATAAAG-3' | (SEQ ID NO: 2446) |  |
|  | 5'-CCAUCCCACUGGCCUCUGAUAAAgg-3' | (SEQ ID NO: 229) |  |
|  | 3'-GUGGUAGGGUGACCGGAGACUAUUUCC-5' | (SEQ ID NO: 1338) |  |
| βc-1793 Target: | 5'-CACCATCCCACTGGCCTCTGATAAAGG-3' | (SEQ ID NO: 2447) |  |
|  | 5'-CAUCCCACUGGCCUCUGAUAAAGgc-3' | (SEQ ID NO: 230) |  |
|  | 3'-UGGUAGGGUGACCGGAGACUAUUUCCG-5' | (SEQ ID NO: 1339) |  |
| βc-1794 Target: | 5'-ACCATCCCACTGGCCTCTGATAAAGGC-3' | (SEQ ID NO: 2448) |  |
|  | 5'-AUCCCACUGGCCUCUGAUAAAGGct-3' | (SEQ ID NO: 231) |  |
|  | 3'-GGUAGGGUGACCGGAGACUAUUUCCGA-5' | (SEQ ID NO: 1340) |  |
| βc-1795 Target: | 5'-CCATCCCACTGGCCTCTGATAAAGGCT-3' | (SEQ ID NO: 2449) |  |
|  | 5'-UCCCACUGGCCUCUGAUAAAGGCta-3' | (SEQ ID NO: 232) |  |
|  | 3'-GUAGGGUGACCGGAGACUAUUUCCGAU-5' | (SEQ ID NO: 1341) |  |
| βc-1796 Target: | 5'-CATCCCACTGGCCTCTGATAAAGGCTA-3' | (SEQ ID NO: 2450) |  |
|  | 5'-CCCACUGGCCUCUGAUAAAGGCUac-3' | (SEQ ID NO: 233) |  |
|  | 3'-UAGGGUGACCGGAGACUAUUUCCGAUG-5' | (SEQ ID NO: 1342) |  |
| βc-1797 Target: | 5'-ATCCCACTGGCCTCTGATAAAGGCTAC-3' | (SEQ ID NO: 2451) |  |
|  | 5'-CCACUGGCCUCUGAUAAAGGCUAct-3' | (SEQ ID NO: 234) |  |
|  | 3'-AGGGUGACCGGAGACUAUUUCCGAUGA-5' | (SEQ ID NO: 1343) |  |
| βc-1798 Target: | 5'-TCCCACTGGCCTCTGATAAAGGCTACT-3' | (SEQ ID NO: 2452) |  |
|  | 5'-CACUGGCCUCUGAUAAAGGCUACtg-3' | (SEQ ID NO: 235) |  |
|  | 3'-GGGUGACCGGAGACUAUUUCCGAUGAC-5' | (SEQ ID NO: 1344) |  |
| βc-1799 Target: | 5'-CCCACTGGCCTCTGATAAAGGCTACTG-3' | (SEQ ID NO: 2453) |  |

TABLE 3-continued

Selected Anti-β-catenin DsiRNAs, Duplexes Targeting Both Human and Mouse Sequences

|  |  |  |  |
|---|---|---|---|
| | 5'-ACUGGCCUCUGAUAAAGGCUACUgt-3' | (SEQ ID NO: 236) |
| | 3'-GGUGACCGGAGACUAUUUCCGAUGACA-5' | (SEQ ID NO: 1345) |
| βc-1800 Target: | 5'-CCACTGGCCTCTGATAAAGGCTACTGT-3' | (SEQ ID NO: 2454) |
| | 5'-ACUGUUGGAUUGAUUCGAAAUCUtg-3' | (SEQ ID NO: 237) |
| | 3'-GAUGACAACCUAACUAAGCUUUAGAAC-5' | (SEQ ID NO: 1346) |
| βc-1820 Target: | 5'-CTACTGTTGGATTGATTCGAAATCTTG-3' | (SEQ ID NO: 2455) |
| | 5'-CUGUUGGAUUGAUUCGAAAUCUUgc-3' | (SEQ ID NO: 238) |
| | 3'-AUGACAACCUAACUAAGCUUUAGAACG-5' | (SEQ ID NO: 1347) |
| βc-1821 Target: | 5'-TACTGTTGGATTGATTCGAAATCTTGC-3' | (SEQ ID NO: 2456) |
| | 5'-AAUACCAUUCCAUUGUUUGUGCAgc-3' | (SEQ ID NO: 239) |
| | 3'-AUUUAUGGUAAGGUAACAAACACGUCG-5' | (SEQ ID NO: 1348) |
| βc-2072 Target: | 5'-TAAATACCATTCCATTGTTTGTGCAGC-3' | (SEQ ID NO: 2457) |
| | 5'-AUACCAUUCCAUUGUUUGUGCAGct-3' | (SEQ ID NO: 240) |
| | 3'-UUUAUGGUAAGGUAACAAACACGUCGA-5' | (SEQ ID NO: 1349) |
| βc-2073 Target: | 5'-AAATACCATTCCATTGTTTGTGCAGCT-3' | (SEQ ID NO: 2458) |
| | 5'-UACCAUUCCAUUGUUUGUGCAGCtg-3' | (SEQ ID NO: 241) |
| | 3'-UUAUGGUAAGGUAACAAACACGUCGAC-5' | (SEQ ID NO: 1350) |
| βc-2074 Target: | 5'-AATACCATTCCATTGTTTGTGCAGCTG-3' | (SEQ ID NO: 2459) |
| | 5'-ACCAUUCCAUUGUUUGUGCAGCUgc-3' | (SEQ ID NO: 242) |
| | 3'-UAUGGUAAGGUAACAAACACGUCGACG-5' | (SEQ ID NO: 1351) |
| βc-2075 Target: | 5'-ATACCATTCCATTGTTTGTGCAGCTGC-3' | (SEQ ID NO: 2460) |
| | 5'-CCAUUCCAUUGUUUGUGCAGCUGct-3' | (SEQ ID NO: 243) |
| | 3'-AUGGUAAGGUAACAAACACGUCGACGA-5' | (SEQ ID NO: 1352) |
| βc-2076 Target: | 5'-TACCATTCCATTGTTTGTGCAGCTGCT-3' | (SEQ ID NO: 2461) |
| | 5'-CAUUCCAUUGUUUGUGCAGCUGCtt-3' | (SEQ ID NO: 244) |
| | 3'-UGGUAAGGUAACAAACACGUCGACGAA-5' | (SEQ ID NO: 1353) |
| βc-2077 Target: | 5'-ACCATTCCATTGTTTGTGCAGCTGCTT-3' | (SEQ ID NO: 2462) |
| | 5'-UGCUUUAUUCUCCCAUUGAAAACat-3' | (SEQ ID NO: 245) |
| | 3'-CGACGAAAUAAGAGGGUAACUUUUGUA-5' | (SEQ ID NO: 1354) |
| βc-2097 Target: | 5'-GCTGCTTTATTCTCCCATTGAAAAC-3' | (SEQ ID NO: 2463) |
| | 5'-GCUUUAUUCUCCCAUUGAAAACAtc-3' | (SEQ ID NO: 246) |
| | 3'-GACGAAAUAAGAGGGUAACUUUUGUAG-5' | (SEQ ID NO: 1355) |
| βc-2098 Target: | 5'-CTGCTTTATTCTCCCATTGAAAACATC-3' | (SEQ ID NO: 2464) |
| | 5'-CUUUAUUCUCCCAUUGAAAACAUcc-3' | (SEQ ID NO: 247) |
| | 3'-ACGAAAUAAGAGGGUAACUUUUGUAGG-5' | (SEQ ID NO: 1356) |
| βc-2099 Target: | 5'-TGCTTTATTCTCCCATTGAAAACATCC-3' | (SEQ ID NO: 2465) |
| | 5'-UUUAUUCUCCCAUUGAAAACAUCca-3' | (SEQ ID NO: 248) |
| | 3'-CGAAAUAAGAGGGUAACUUUUGUAGGU-5' | (SEQ ID NO: 1357) |
| βc-2100 Target: | 5'-GCTTTATTCTCCCATTGAAAACATCCA-3' | (SEQ ID NO: 2466) |

TABLE 3-continued

Selected Anti-β-catenin DsiRNAs, Duplexes Targeting Both Human and Mouse Sequences

|  |  |  |  |
|---|---|---|---|
|  | 5'-GUCCUCUGUGAACUUGCUCAGGAca-3' | (SEQ ID NO: 249) |  |
|  | 3'-CCCAGGAGACACUUGAACGAGUCCUGU-5' | (SEQ ID NO: 1358) |  |
| βc-2141 Target: | 5'-GGGTCCTCTGTGAACTTGCTCAGGACA-3' | (SEQ ID NO: 2467) |  |
|  | 5'-UCCUCUGUGAACUUGCUCAGGACaa-3' | (SEQ ID NO: 250) |  |
|  | 3'-CCAGGAGACACUUGAACGAGUCCUGUU-5' | (SEQ ID NO: 1359) |  |
| βc-2142 Target: | 5'-GGTCCTCTGTGAACTTGCTCAGGACAA-3' | (SEQ ID NO: 2468) |  |
|  | 5'-CCUCUGUGAACUUGCUCAGGACAag-3' | (SEQ ID NO: 251) |  |
|  | 3'-CAGGAGACACUUGAACGAGUCCUGUUC-5' | (SEQ ID NO: 1360) |  |
| βc-2143 Target: | 5'-GTCCTCTGTGAACTTGCTCAGGACAAG-3' | (SEQ ID NO: 2469) |  |
|  | 5'-CUCUGUGAACUUGCUCAGGACAAgg-3' | (SEQ ID NO: 252) |  |
|  | 3'-AGGAGACACUUGAACGAGUCCUGUUCC-5' | (SEQ ID NO: 1361) |  |
| βc-2144 Target: | 5'-TCCTCTGTGAACTTGCTCAGGACAAGG-3' | (SEQ ID NO: 2470) |  |
|  | 5'-UCUGUGAACUUGCUCAGGACAAGga-3' | (SEQ ID NO: 253) |  |
|  | 3'-GGAGACACUUGAACGAGUCCUGUUCCU-5' | (SEQ ID NO: 1362) |  |
| βc-2145 Target: | 5'-CCTCTGTGAACTTGCTCAGGACAAGGA-3' | (SEQ ID NO: 2471) |  |
|  | 5'-CUGUGAACUUGCUCAGGACAAGGaa-3' | (SEQ ID NO: 254) |  |
|  | 3'-GAGACACUUGAACGAGUCCUGUUCCUU-5' | (SEQ ID NO: 1363) |  |
| βc-2146 Target: | 5'-CTCTGTGAACTTGCTCAGGACAAGGAA-3' | (SEQ ID NO: 2472) |  |
|  | 5'-UGUGAACUUGCUCAGGACAAGGAag-3' | (SEQ ID NO: 255) |  |
|  | 3'-AGACACUUGAACGAGUCCUGUUCCUUC-5' | (SEQ ID NO: 1364) |  |
| βc-2147 Target: | 5'-TCTGTGAACTTGCTCAGGACAAGGAAG-3' | (SEQ ID NO: 2473) |  |
|  | 5'-GUGAACUUGCUCAGGACAAGGAAgc-3' | (SEQ ID NO: 256) |  |
|  | 3'-GACACUUGAACGAGUCCUGUUCCUUCG-5' | (SEQ ID NO: 1365) |  |
| βc-2148 Target: | 5'-CTGTGAACTTGCTCAGGACAAGGAAGC-3' | (SEQ ID NO: 2474) |  |
|  | 5'-UGAACUUGCUCAGGACAAGGAAGct-3' | (SEQ ID NO: 257) |  |
|  | 3'-ACACUUGAACGAGUCCUGUUCCUUCGA-5' | (SEQ ID NO: 1366) |  |
| βc-2149 Target: | 5'-TGTGAACTTGCTCAGGACAAGGAAGCT-3' | (SEQ ID NO: 2475) |  |
|  | 5'-GAACUUGCUCAGGACAAGGAAGCtg-3' | (SEQ ID NO: 258) |  |
|  | 3'-CACUUGAACGAGUCCUGUUCCUUCGAC-5' | (SEQ ID NO: 1367) |  |
| βc-2150 Target: | 5'-GTGAACTTGCTCAGGACAAGGAAGCTG-3' | (SEQ ID NO: 2476) |  |
|  | 5'-AACUUGCUCAGGACAAGGAAGCUgc-3' | (SEQ ID NO: 259) |  |
|  | 3'-ACUUGAACGAGUCCUGUUCCUUCGACG-5' | (SEQ ID NO: 1368) |  |
| βc-2151 Target: | 5'-TGAACTTGCTCAGGACAAGGAAGCTGC-3' | (SEQ ID NO: 2477) |  |
|  | 5'-AUUGAAGCUGAGGGAGCCACAGCtc-3' | (SEQ ID NO: 260) |  |
|  | 3'-GAUAACUUCGACUCCCUCGGUGUCGAG-5' | (SEQ ID NO: 1369) |  |
| βc-2183 Target: | 5'-CTATTGAAGCTGAGGGAGCCACAGCTC-3' | (SEQ ID NO: 2478) |  |
|  | 5'-UUGAAGCUGAGGGAGCCACAGCUcc-3' | (SEQ ID NO: 261) |  |
|  | 3'-AUAACUUCGACUCCCUCGGUGUCGAGG-5' | (SEQ ID NO: 1370) |  |
| βc-2184 Target: | 5'-TATTGAAGCTGAGGGAGCCACAGCTCC-3' | (SEQ ID NO: 2479) |  |

TABLE 3-continued

Selected Anti-β-catenin DsiRNAs, Duplexes Targeting Both Human and Mouse Sequences

|  |  |  |  |
|---|---|---|---|
|  | 5'-UGAAGCUGAGGGAGCCACAGCUCct-3' | (SEQ ID NO: 262) |  |
|  | 3'-UAACUUCGACUCCCUCGGUGUCGAGGA-5' | (SEQ ID NO: 1371) |  |
| βc-2185 Target: | 5'-ATTGAAGCTGAGGGAGCCACAGCTCCT-3' | (SEQ ID NO: 2480) |  |
|  | 5'-UUCCGAAUGUCUGAGGACAAGCCac-3' | (SEQ ID NO: 263) |  |
|  | 3'-ACAAGGCUUACAGACUCCUGUUCGGUG-5' | (SEQ ID NO: 1372) |  |
| βc-2270 Target: | 5'-TGTTCCGAATGTCTGAGGACAAGCCAC-3' | (SEQ ID NO: 2481) |  |
|  | 5'-UCCGAAUGUCUGAGGACAAGCCAca-3' | (SEQ ID NO: 264) |  |
|  | 3'-CAAGGCUUACAGACUCCUGUUCGGUGU-5' | (SEQ ID NO: 1373) |  |
| βc-2271 Target: | 5'-GTTCCGAATGTCTGAGGACAAGCCACA-3' | (SEQ ID NO: 2482) |  |
|  | 5'-CCGAAUGUCUGAGGACAAGCCACaa-3' | (SEQ ID NO: 265) |  |
|  | 3'-AAGGCUUACAGACUCCUGUUCGGUGUU-5' | (SEQ ID NO: 1374) |  |
| βc-2272 Target: | 5'-TTCCGAATGTCTGAGGACAAGCCACAA-3' | (SEQ ID NO: 2483) |  |
|  | 5'-CGAAUGUCUGAGGACAAGCCACAag-3' | (SEQ ID NO: 266) |  |
|  | 3'-AGGCUUACAGACUCCUGUUCGGUGUUC-5' | (SEQ ID NO: 1375) |  |
| βc-2273 Target: | 5'-TCCGAATGTCTGAGGACAAGCCACAAG-3' | (SEQ ID NO: 2484) |  |
|  | 5'-GAAUGUCUGAGGACAAGCCACAAga-3' | (SEQ ID NO: 267) |  |
|  | 3'-GGCUUACAGACUCCUGUUCGGUGUUCU-5' | (SEQ ID NO: 1376) |  |
| βc-2274 Target: | 5'-CCGAATGTCTGAGGACAAGCCACAAGA-3' | (SEQ ID NO: 2485) |  |
|  | 5'-AAUGUCUGAGGACAAGCCACAAGat-3' | (SEQ ID NO: 268) |  |
|  | 3'-GCUUACAGACUCCUGUUCGGUGUUCUA-5' | (SEQ ID NO: 1377) |  |
| βc-2275 Target: | 5'-CGAATGTCTGAGGACAAGCCACAAGAT-3' | (SEQ ID NO: 2486) |  |
|  | 5'-AUGUCUGAGGACAAGCCACAAGAtt-3' | (SEQ ID NO: 269) |  |
|  | 3'-CUUACAGACUCCUGUUCGGUGUUCUAA-5' | (SEQ ID NO: 1378) |  |
| βc-2276 Target: | 5'-GAATGTCTGAGGACAAGCCACAAGATT-3' | (SEQ ID NO: 2487) |  |
|  | 5'-UGUCUGAGGACAAGCCACAAGAUta-3' | (SEQ ID NO: 270) |  |
|  | 3'-UUACAGACUCCUGUUCGGUGUUCUAAU-5' | (SEQ ID NO: 1379) |  |
| βc-2277 Target: | 5'-AATGTCTGAGGACAAGCCACAAGATTA-3' | (SEQ ID NO: 2488) |  |
|  | 5'-ACAGAGCCAAUGGCUUGGAAUGAga-3' | (SEQ ID NO: 271) |  |
|  | 3'-CUUGUCUCGGUUACCGAACCUUACUCU-5' | (SEQ ID NO: 1380) |  |
| βc-2345 Target: | 5'-GAACAGAGCCAATGGCTTGGAATGAGA-3' | (SEQ ID NO: 2489) |  |
|  | 5'-CAGAGCCAAUGGCUUGGAAUGAGac-3' | (SEQ ID NO: 272) |  |
|  | 3'-UUGUCUCGGUUACCGAACCUUACUCUG-5' | (SEQ ID NO: 1381) |  |
| βc-2346 Target: | 5'-AACAGAGCCAATGGCTTGGAATGAGAC-3' | (SEQ ID NO: 2490) |  |
|  | 5'-AGAGCCAAUGGCUUGGAAUGAGAct-3' | (SEQ ID NO: 273) |  |
|  | 3'-UGUCUCGGUUACCGAACCUUACUCUGA-5' | (SEQ ID NO: 1382) |  |
| βc-2347 Target: | 5'-ACAGAGCCAATGGCTTGGAATGAGACT-3' | (SEQ ID NO: 2491) |  |
|  | 5'-GAGCCAAUGGCUUGGAAUGAGACtg-3' | (SEQ ID NO: 274) |  |
|  | 3'-GUCUCGGUUACCGAACCUUACUCUGAC-5' | (SEQ ID NO: 1383) |  |
| βc-2348 Target: | 5'-CAGAGCCAATGGCTTGGAATGAGACTG-3' | (SEQ ID NO: 2492) |  |

TABLE 3-continued

Selected Anti-β-catenin DsiRNAs, Duplexes Targeting Both Human and Mouse Sequences

|  |  |  |  |
|---|---|---|---|
|  | 5'-AGCCAAUGGCUUGGAAUGAGACUGc-3' | (SEQ ID NO: 275) |  |
|  | 3'-UCUCGGUUACCGAACCUUACUCUGACG-5' | (SEQ ID NO: 1384) |  |
| βc-2349 Target: | 5'-AGAGCCAATGGCTTGGAATGAGACTGC-3' | (SEQ ID NO: 2493) |  |
|  | 5'-GCCAAUGGCUUGGAAUGAGACUGct-3' | (SEQ ID NO: 276) |  |
|  | 3'-CUCGGUUACCGAACCUUACUCUGACGA-5' | (SEQ ID NO: 1385) |  |
| βc-2350 Target: | 5'-GAGCCAATGGCTTGGAATGAGACTGCT-3' | (SEQ ID NO: 2494) |  |
|  | 5'-CCAAUGGCUUGGAAUGAGACUGCtg-3' | (SEQ ID NO: 277) |  |
|  | 3'-UCGGUUACCGAACCUUACUCUGACGAC-5' | (SEQ ID NO: 1386) |  |
| βc-2351 Target: | 5'-AGCCAATGGCTTGGAATGAGACTGCTG-3' | (SEQ ID NO: 2495) |  |
|  | 5'-CAAUGGCUUGGAAUGAGACUGCUga-3' | (SEQ ID NO: 278) |  |
|  | 3'-CGGUUACCGAACCUUACUCUGACGACU-5' | (SEQ ID NO: 1387) |  |
| βc-2352 Target: | 5'-GCCAATGGCTTGGAATGAGACTGCTGA-3' | (SEQ ID NO: 2496) |  |
|  | 5'-AAUGGCUUGGAAUGAGACUGCUGat-3' | (SEQ ID NO: 279) |  |
|  | 3'-GGUUACCGAACCUUACUCUGACGACUA-5' | (SEQ ID NO: 1388) |  |
| βc-2353 Target: | 5'-CCAATGGCTTGGAATGAGACTGCTGAT-3' | (SEQ ID NO: 2497) |  |
|  | 5'-AUGGCUUGGAAUGAGACUGCUGAtc-3' | (SEQ ID NO: 280) |  |
|  | 3'-GUUACCGAACCUUACUCUGACGACUAG-5' | (SEQ ID NO: 1389) |  |
| βc-2354 Target: | 5'-CAATGGCTTGGAATGAGACTGCTGATC-3' | (SEQ ID NO: 2498) |  |
|  | 5'-UGGCUUGGAAUGAGACUGCUGAUct-3' | (SEQ ID NO: 281) |  |
|  | 3'-UUACCGAACCUUACUCUGACGACUAGA-5' | (SEQ ID NO: 1390) |  |
| βc-2355 Target: | 5'-AATGGCTTGGAATGAGACTGCTGATCT-3' | (SEQ ID NO: 2499) |  |
|  | 5'-CUUGGAUAUCGCCAGGAUGAUCCta-3' | (SEQ ID NO: 282) |  |
|  | 3'-GGGAACCUAUAGCGGUCCUACUAGGAU-5' | (SEQ ID NO: 1391) |  |
| βc-2411 Target: | 5'-CCCTTGGATATCGCCAGGATGATCCTA-3' | (SEQ ID NO: 2500) |  |
|  | 5'-UUGGAUAUCGCCAGGAUGAUCCUag-3' | (SEQ ID NO: 283) |  |
|  | 3'-GGAACCUAUAGCGGUCCUACUAGGAUC-5' | (SEQ ID NO: 1392) |  |
| βc-2412 Target: | 5'-CCTTGGATATCGCCAGGATGATCCTAG-3' | (SEQ ID NO: 2501) |  |
|  | 5'-UGGAUAUCGCCAGGAUGAUCCUAgc-3' | (SEQ ID NO: 284) |  |
|  | 3'-GAACCUAUAGCGGUCCUACUAGGAUCG-5' | (SEQ ID NO: 1393) |  |
| βc-2413 Target: | 5'-CTTGGATATCGCCAGGATGATCCTAGC-3' | (SEQ ID NO: 2502) |  |
|  | 5'-GGAUAUCGCCAGGAUGAUCCUAGct-3' | (SEQ ID NO: 285) |  |
|  | 3'-AACCUAUAGCGGUCCUACUAGGAUCGA-5' | (SEQ ID NO: 1394) |  |
| βc-2414 Target: | 5'-TTGGATATCGCCAGGATGATCCTAGCT-3' | (SEQ ID NO: 2503) |  |
|  | 5'-GAUAUCGCCAGGAUGAUCCUAGCta-3' | (SEQ ID NO: 286) |  |
|  | 3'-ACCUAUAGCGGUCCUACUAGGAUCGAU-5' | (SEQ ID NO: 1395) |  |
| βc-2415 Target: | 5'-TGGATATCGCCAGGATGATCCTAGCTA-3' | (SEQ ID NO: 2504) |  |
|  | 5'-CGUUCUUUUCACUCUGGUGGAUAtg-3' | (SEQ ID NO: 287) |  |
|  | 3'-UAGCAAGAAAAGUGAGACCACCUAUAC-5' | (SEQ ID NO: 1396) |  |
| βc-2441 Target: | 5'-ATCGTTCTTTTCACTCTGGTGGATATG-3' | (SEQ ID NO: 2505) |  |

TABLE 3-continued

Selected Anti-β-catenin DsiRNAs, Duplexes Targeting Both Human and Mouse Sequences

| | | | |
|---|---|---|---|
| | | 5'-GUUCUUUUCACUCUGGUGGAUAUGg-3' | (SEQ ID NO: 288) |
| | | 3'-AGCAAGAAAAGUGAGACCACCUAUACC-5' | (SEQ ID NO: 1397) |
| βc-2442 | Target: | 5'-TCGTTCTTTTCACTCTGGTGGATATGG-3' | (SEQ ID NO: 2506) |
| | | 5'-UUCUUUUCACUCUGGUGGAUAUGgc-3' | (SEQ ID NO: 289) |
| | | 3'-GCAAGAAAAGUGAGACCACCUAUACCG-5' | (SEQ ID NO: 1398) |
| βc-2443 | Target: | 5'-CGTTCTTTTCACTCTGGTGGATATGGC-3' | (SEQ ID NO: 2507) |
| | | 5'-UCUUUUCACUCUGGUGGAUAUGGcc-3' | (SEQ ID NO: 290) |
| | | 3'-CAAGAAAAGUGAGACCACCUAUACCGG-5' | (SEQ ID NO: 1399) |
| βc-2444 | Target: | 5'-GTTCTTTTCACTCTGGTGGATATGGCC-3' | (SEQ ID NO: 2508) |
| | | 5'-CUUUUCACUCUGGUGGAUAUGGCca-3' | (SEQ ID NO: 291) |
| | | 3'-AAGAAAAGUGAGACCACCUAUACCGGU-5' | (SEQ ID NO: 1400) |
| βc-2445 | Target: | 5'-TTCTTTTCACTCTGGTGGATATGGCCA-3' | (SEQ ID NO: 2509) |
| | | 5'-CAUGAGAUGGGUGGCCACCACCCtg-3' | (SEQ ID NO: 292) |
| | | 3'-UUGUACUCUACCCACCGGUGGUGGGAC-5' | (SEQ ID NO: 1401) |
| βc-2501 | Target: | 5'-AACATGAGATGGGTGGCCACCACCCTG-3' | (SEQ ID NO: 2510) |
| | | 5'-AUGAGAUGGGUGGCCACCACCCUgg-3' | (SEQ ID NO: 293) |
| | | 3'-UGUACUCUACCCACCGGUGGUGGGACC-5' | (SEQ ID NO: 1402) |
| βc-2502 | Target: | 5'-ACATGAGATGGGTGGCCACCACCCTGG-3' | (SEQ ID NO: 2511) |
| | | 5'-UGAGAUGGGUGGCCACCACCCUGgt-3' | (SEQ ID NO: 294) |
| | | 3'-GUACUCUACCCACCGGUGGUGGGACCA-5' | (SEQ ID NO: 1403) |
| βc-2503 | Target: | 5'-CATGAGATGGGTGGCCACCACCCTGGT-3' | (SEQ ID NO: 2512) |
| | | 5'-GAGAUGGGUGGCCACCACCCUGGtg-3' | (SEQ ID NO: 295) |
| | | 3'-UACUCUACCCACCGGUGGUGGGACCAC-5' | (SEQ ID NO: 1404) |
| βc-2504 | Target: | 5'-ATGAGATGGGTGGCCACCACCCTGGTG-3' | (SEQ ID NO: 2513) |
| | | 5'-AGAUGGGUGGCCACCACCCUGGUgc-3' | (SEQ ID NO: 296) |
| | | 3'-ACUCUACCCACCGGUGGUGGGACCACG-5' | (SEQ ID NO: 1405) |
| βc-2505 | Target: | 5'-TGAGATGGGTGGCCACCACCCTGGTGC-3' | (SEQ ID NO: 2514) |
| | | 5'-GAUGGGUGGCCACCACCCUGGUGct-3' | (SEQ ID NO: 297) |
| | | 3'-CUCUACCCACCGGUGGUGGGACCACGA-5' | (SEQ ID NO: 1406) |
| βc-2506 | Target: | 5'-GAGATGGGTGGCCACCACCCTGGTGCT-3' | (SEQ ID NO: 2515) |
| | | 5'-AUGGGUGGCCACCACCCUGGUGCtg-3' | (SEQ ID NO: 298) |
| | | 3'-UCUACCCACCGGUGGUGGGACCACGAC-5' | (SEQ ID NO: 1407) |
| βc-2507 | Target: | 5'-AGATGGGTGGCCACCACCCTGGTGCTG-3' | (SEQ ID NO: 2516) |
| | | 5'-UGGGUGGCCACCACCCUGGUGCUga-3' | (SEQ ID NO: 299) |
| | | 3'-CUACCCACCGGUGGUGGGACCACGACU-5' | (SEQ ID NO: 1408) |
| βc-2508 | Target: | 5'-GATGGGTGGCCACCACCCTGGTGCTGA-3' | (SEQ ID NO: 2517) |
| | | 5'-GGGUGGCCACCACCCUGGUGCUGac-3' | (SEQ ID NO: 300) |
| | | 3'-UACCCACCGGUGGUGGGACCACGACUG-5' | (SEQ ID NO: 1409) |
| βc-2509 | Target: | 5'-ATGGGTGGCCACCACCCTGGTGCTGAC-3' | (SEQ ID NO: 2518) |

TABLE 3-continued

Selected Anti-β-catenin DsiRNAs, Duplexes Targeting Both Human and Mouse Sequences

|  |  |  |
|---|---|---|
|  | 5'-GGUGGCCACCACCCUGGUGCUGAct-3' | (SEQ ID NO: 301) |
|  | 3'-ACCACCGGUGGUGGGACCACGACUGA-5' | (SEQ ID NO: 1410) |
| βc-2510 Target: | 5'-TGGGTGGCCACCACCCTGGTGCTGACT-3' | (SEQ ID NO: 2519) |
|  | 5'-GUGGCCACCACCCUGGUGCUGACta-3' | (SEQ ID NO: 302) |
|  | 3'-CCCACCGGUGGUGGGACCACGACUGAU-5' | (SEQ ID NO: 1411) |
| βc-2511 Target: | 5'-GGGTGGCCACCACCCTGGTGCTGACTA-3' | (SEQ ID NO: 2520) |
|  | 5'-UGGCCACCACCCUGGUGCUGACUat-3' | (SEQ ID NO: 303) |
|  | 3'-CCACCGGUGGUGGGACCACGACUGAUA-5' | (SEQ ID NO: 1412) |
| βc-2512 Target: | 5'-GGTGGCCACCACCCTGGTGCTGACTAT-3' | (SEQ ID NO: 2521) |
|  | 5'-GGCCACCACCCUGGUGCUGACUAtc-3' | (SEQ ID NO: 304) |
|  | 3'-CACCGGUGGUGGGACCACGACUGAUAG-5' | (SEQ ID NO: 1413) |
| βc-2513 Target: | 5'-GTGGCCACCACCCTGGTGCTGACTATC-3' | (SEQ ID NO: 2522) |
|  | 5'-GCCACCACCCUGGUGCUGACUAUcc-3' | (SEQ ID NO: 305) |
|  | 3'-ACCGGUGGUGGGACCACGACUGAUAGG-5' | (SEQ ID NO: 1414) |
| βc-2514 Target: | 5'-TGGCCACCACCCTGGTGCTGACTATCC-3' | (SEQ ID NO: 2523) |
|  | 5'-CCACCACCCUGGUGCUGACUAUCca-3' | (SEQ ID NO: 306) |
|  | 3'-CCGGUGGUGGGACCACGACUGAUAGGU-5' | (SEQ ID NO: 1415) |
| βc-2515 Target: | 5'-GGCCACCACCCTGGTGCTGACTATCCA-3' | (SEQ ID NO: 2524) |
|  | 5'-CACCACCCUGGUGCUGACUAUCCag-3' | (SEQ ID NO: 307) |
|  | 3'-CGGUGGUGGGACCACGACUGAUAGGUC-5' | (SEQ ID NO: 1416) |
| βc-2516 Target: | 5'-GCCACCACCCTGGTGCTGACTATCCAG-3' | (SEQ ID NO: 2525) |
|  | 5'-ACCACCCUGGUGCUGACUAUCCAgt-3' | (SEQ ID NO: 308) |
|  | 3'-GGUGGUGGGACCACGACUGAUAGGUCA-5' | (SEQ ID NO: 1417) |
| βc-2517 Target: | 5'-CCACCACCCTGGTGCTGACTATCCAGT-3' | (SEQ ID NO: 2526) |
|  | 5'-CCACCCUGGUGCUGACUAUCCAGtt-3' | (SEQ ID NO: 309) |
|  | 3'-GUGGUGGGACCACGACUGAUAGGUCAA-5' | (SEQ ID NO: 1418) |
| βc-2518 Target: | 5'-CACCACCCTGGTGCTGACTATCCAGTT-3' | (SEQ ID NO: 2527) |
|  | 5'-CACCCUGGUGCUGACUAUCCAGUtg-3' | (SEQ ID NO: 310) |
|  | 3'-UGGUGGGACCACGACUGAUAGGUCAAC-5' | (SEQ ID NO: 1419) |
| βc-2519 Target: | 5'-ACCACCCTGGTGCTGACTATCCAGTTG-3' | (SEQ ID NO: 2528) |
|  | 5'-ACCCUGGUGCUGACUAUCCAGUUga-3' | (SEQ ID NO: 311) |
|  | 3'-GGUGGGACCACGACUGAUAGGUCAACU-5' | (SEQ ID NO: 1420) |
| βc-2520 Target: | 5'-CCACCCTGGTGCTGACTATCCAGTTGA-3' | (SEQ ID NO: 2529) |
|  | 5'-CCCUGGUGCUGACUAUCCAGUUGat-3' | (SEQ ID NO: 312) |
|  | 3'-GUGGGACCACGACUGAUAGGUCAACUA-5' | (SEQ ID NO: 1421) |
| βc-2521 Target: | 5'-CACCCTGGTGCTGACTATCCAGTTGAT-3' | (SEQ ID NO: 2530) |
|  | 5'-CCUGGUGCUGACUAUCCAGUUGAtg-3' | (SEQ ID NO: 313) |
|  | 3'-UGGGACCACGACUGAUAGGUCAACUAC-5' | (SEQ ID NO: 1422) |
| βc-2522 Target: | 5'-ACCCTGGTGCTGACTATCCAGTTGATG-3' | (SEQ ID NO: 2531) |

TABLE 3-continued

Selected Anti-β-catenin DsiRNAs, Duplexes Targeting Both Human and Mouse Sequences

|  |  |  |  |
|---|---|---|---|
|  | 5'-CUGGUGCUGACUAUCCAGUUGAUgg-3' | (SEQ ID NO: 314) |  |
|  | 3'-GGGACCACGACUGAUAGGUCAACUACC-5' | (SEQ ID NO: 1423) |  |
| βc-2523 Target: | 5'-CCCTGGTGCTGACTATCCAGTTGATGG-3' | (SEQ ID NO: 2532) |  |
|  | 5'-UGGUGCUGACUAUCCAGUUGAUGgg-3' | (SEQ ID NO: 315) |  |
|  | 3'-GGACCACGACUGAUAGGUCAACUACCC-5' | (SEQ ID NO: 1424) |  |
| βc-2524 Target: | 5'-CCTGGTGCTGACTATCCAGTTGATGGG-3' | (SEQ ID NO: 2533) |  |
|  | 5'-GGUGCUGACUAUCCAGUUGAUGGgc-3' | (SEQ ID NO: 316) |  |
|  | 3'-GACCACGACUGAUAGGUCAACUACCCG-5' | (SEQ ID NO: 1425) |  |
| βc-2525 Target: | 5'-CTGGTGCTGACTATCCAGTTGATGGGC-3' | (SEQ ID NO: 2534) |  |
|  | 5'-GUGCUGACUAUCCAGUUGAUGGGct-3' | (SEQ ID NO: 317) |  |
|  | 3'-ACCACGACUGAUAGGUCAACUACCCGA-5' | (SEQ ID NO: 1426) |  |
| βc-2526 Target: | 5'-TGGTGCTGACTATCCAGTTGATGGGCT-3' | (SEQ ID NO: 2535) |  |
|  | 5'-UGCUGACUAUCCAGUUGAUGGGCtg-3' | (SEQ ID NO: 318) |  |
|  | 3'-CCACGACUGAUAGGUCAACUACCCGAC-5' | (SEQ ID NO: 1427) |  |
| βc-2527 Target: | 5'-GGTGCTGACTATCCAGTTGATGGGCTG-3' | (SEQ ID NO: 2536) |  |
|  | 5'-GCUGACUAUCCAGUUGAUGGGCUgc-3' | (SEQ ID NO: 319) |  |
|  | 3'-CACGACUGAUAGGUCAACUACCCGACG-5' | (SEQ ID NO: 1428) |  |
| βc-2528 Target: | 5'-GTGCTGACTATCCAGTTGATGGGCTGC-3' | (SEQ ID NO: 2537) |  |
|  | 5'-CUGACUAUCCAGUUGAUGGGCUGcc-3' | (SEQ ID NO: 320) |  |
|  | 3'-ACGACUGAUAGGUCAACUACCCGACGG-5' | (SEQ ID NO: 1429) |  |
| βc-2529 Target: | 5'-TGCTGACTATCCAGTTGATGGGCTGCC-3' | (SEQ ID NO: 2538) |  |
|  | 5'-UGACUAUCCAGUUGAUGGGCUGCca-3' | (SEQ ID NO: 321) |  |
|  | 3'-CGACUGAUAGGUCAACUACCCGACGGU-5' | (SEQ ID NO: 1430) |  |
| βc-2530 Target: | 5'-GCTGACTATCCAGTTGATGGGCTGCCA-3' | (SEQ ID NO: 2539) |  |
|  | 5'-GACUAUCCAGUUGAUGGGCUGCCag-3' | (SEQ ID NO: 322) |  |
|  | 3'-GACUGAUAGGUCAACUACCCGACGGUC-5' | (SEQ ID NO: 1431) |  |
| βc-2531 Target: | 5'-CTGACTATCCAGTTGATGGGCTGCCAG-3' | (SEQ ID NO: 2540) |  |
|  | 5'-ACUAUCCAGUUGAUGGGCUGCCAga-3' | (SEQ ID NO: 323) |  |
|  | 3'-ACUGAUAGGUCAACUACCCGACGGUCU-5' | (SEQ ID NO: 1432) |  |
| βc-2532 Target: | 5'-TGACTATCCAGTTGATGGGCTGCCAGA-3' | (SEQ ID NO: 2541) |  |
|  | 5'-CUAUCCAGUUGAUGGGCUGCCAGat-3' | (SEQ ID NO: 324) |  |
|  | 3'-CUGAUAGGUCAACUACCCGACGGUCUA-5' | (SEQ ID NO: 1433) |  |
| βc-2533 Target: | 5'-GACTATCCAGTTGATGGGCTGCCAGAT-3' | (SEQ ID NO: 2542) |  |
|  | 5'-UAUCCAGUUGAUGGGCUGCCAGAtc-3' | (SEQ ID NO: 325) |  |
|  | 3'-UGAUAGGUCAACUACCCGACGGUCUAG-5' | (SEQ ID NO: 1434) |  |
| βc-2534 Target: | 5'-ACTATCCAGTTGATGGGCTGCCAGATC-3' | (SEQ ID NO: 2543) |  |
|  | 5'-AUCCAGUUGAUGGGCUGCCAGAUct-3' | (SEQ ID NO: 326) |  |
|  | 3'-GAUAGGUCAACUACCCGACGGUCUAGA-5' | (SEQ ID NO: 1435) |  |
| βc-2535 Target: | 5'-CTATCCAGTTGATGGGCTGCCAGATCT-3' | (SEQ ID NO: 2544) |  |

TABLE 3-continued

Selected Anti-β-catenin DsiRNAs, Duplexes Targeting Both Human and Mouse Sequences

|  |  |  |  |
|---|---|---|---|
|  | 5'-GCCCAGGACCUCAUGGAUGGGCUGc-3' | (SEQ ID NO: 327) |  |
|  | 3'-UACGGGUCCUGGAGUACCUACCCGACG-5' | (SEQ ID NO: 1436) |  |
| βc-2567 Target: | 5'-ATGCCCAGGACCTCATGGATGGGCTGC-3' | (SEQ ID NO: 2545) |  |
|  | 5'-CCCAGGACCUCAUGGAUGGGCUGcc-3' | (SEQ ID NO: 328) |  |
|  | 3'-ACGGGUCCUGGAGUACCUACCCGACGG-5' | (SEQ ID NO: 1437) |  |
| βc-2568 Target: | 5'-TGCCCAGGACCTCATGGATGGGCTGCC-3' | (SEQ ID NO: 2546) |  |
|  | 5'-CCAGGACCUCAUGGAUGGGCUGCct-3' | (SEQ ID NO: 329) |  |
|  | 3'-CGGGUCCUGGAGUACCUACCCGACGGA-5' | (SEQ ID NO: 1438) |  |
| βc-2569 Target: | 5'-GCCCAGGACCTCATGGATGGGCTGCCT-3' | (SEQ ID NO: 2547) |  |
|  | 5'-AGCAAUCAGCUGGCCUGGUUUGAta-3' | (SEQ ID NO: 330) |  |
|  | 3'-UGUCGUUAGUCGACCGGACCAAACUAU-5' | (SEQ ID NO: 1439) |  |
| βc-2603 Target: | 5'-ACAGCAATCAGCTGGCCTGGTTTGATA-3' | (SEQ ID NO: 2548) |  |
|  | 5'-GCAAUCAGCUGGCCUGGUUUGAUac-3' | (SEQ ID NO: 331) |  |
|  | 3'-GUCGUUAGUCGACCGGACCAAACUAUG-5' | (SEQ ID NO: 1440) |  |
| βc-2604 Target: | 5'-CAGCAATCAGCTGGCCTGGTTTGATAC-3' | (SEQ ID NO: 2549) |  |
|  | 5'-CAAUCAGCUGGCCUGGUUUGAUAct-3' | (SEQ ID NO: 332) |  |
|  | 3'-UCGUUAGUCGACCGGACCAAACUAUGA-5' | (SEQ ID NO: 1441) |  |
| βc-2605 Target: | 5'-AGCAATCAGCTGGCCTGGTTTGATACT-3' | (SEQ ID NO: 2550) |  |
|  | 5'-AAUCAGCUGGCCUGGUUUGAUACtg-3' | (SEQ ID NO: 333) |  |
|  | 3'-CGUUAGUCGACCGGACCAAACUAUGAC-5' | (SEQ ID NO: 1442) |  |
| βc-2606 Target: | 5'-GCAATCAGCTGGCCTGGTTTGATACTG-3' | (SEQ ID NO: 2551) |  |
|  | 5'-AUCAGCUGGCCUGGUUUGAUACUga-3' | (SEQ ID NO: 334) |  |
|  | 3'-GUUAGUCGACCGGACCAAACUAUGACU-5' | (SEQ ID NO: 1443) |  |
| βc-2607 Target: | 5'-CAATCAGCTGGCCTGGTTTGATACTGA-3' | (SEQ ID NO: 2552) |  |
|  | 5'-UCAGCUGGCCUGGUUUGAUACUGac-3' | (SEQ ID NO: 335) |  |
|  | 3'-UUAGUCGACCGGACCAAACUAUGACUG-5' | (SEQ ID NO: 1444) |  |
| βc-2608 Target: | 5'-AATCAGCTGGCCTGGTTTGATACTGAC-3' | (SEQ ID NO: 2553) |  |
|  | 5'-CAGCUGGCCUGGUUUGAUACUGAcc-3' | (SEQ ID NO: 336) |  |
|  | 3'-UAGUCGACCGGACCAAACUAUGACUGG-5' | (SEQ ID NO: 1445) |  |
| βc-2609 Target: | 5'-ATCAGCTGGCCTGGTTTGATACTGACC-3' | (SEQ ID NO: 2554) |  |
|  | 5'-AGCUGGCCUGGUUUGAUACUGACct-3' | (SEQ ID NO: 337) |  |
|  | 3'-AGUCGACCGGACCAAACUAUGACUGGA-5' | (SEQ ID NO: 1446) |  |
| βc-2610 Target: | 5'-TCAGCTGGCCTGGTTTGATACTGACCT-3' | (SEQ ID NO: 2555) |  |
|  | 5'-GCUGGCCUGGUUUGAUACUGACCtg-3' | (SEQ ID NO: 338) |  |
|  | 3'-GUCGACCGGACCAAACUAUGACUGGAC-5' | (SEQ ID NO: 1447) |  |
| βc-2611 Target: | 5'-CAGCTGGCCTGGTTTGATACTGACCTG-3' | (SEQ ID NO: 2556) |  |
|  | 5'-CUGGCCUGGUUUGAUACUGACCUgt-3' | (SEQ ID NO: 339) |  |
|  | 3'-UCGACCGGACCAAACUAUGACUGGACA-5' | (SEQ ID NO: 1448) |  |
| βc-2612 Target: | 5'-AGCTGGCCTGGTTTGATACTGACCTGT-3' | (SEQ ID NO: 2557) |  |

TABLE 3-continued

Selected Anti-β-catenin DsiRNAs, Duplexes Targeting Both Human and Mouse Sequences

|  |  |  |  |
|---|---|---|---|
|  | 5'-UGGCCUGGUUUGAUACUGACCUGta-3' | (SEQ ID NO: 340) |  |
|  | 3'-<u>CGA</u>CCGGACCAAACUAUGACUGGACAU-5' | (SEQ ID NO: 1449) |  |
| βc-2613 Target: | 5'-GCTGGCCTGGTTTGATACTGACCTGTA-3' | (SEQ ID NO: 2558) |  |
|  | 5'-GGCCUGGUUUGAUACUGACCUGUaa-3' | (SEQ ID NO: 341) |  |
|  | 3'-<u>GAC</u>CGGACCAAACUAUGACUGGACAUU-5' | (SEQ ID NO: 1450) |  |
| βc-2614 Target: | 5'-CTGGCCTGGTTTGATACTGACCTGTAA-3' | (SEQ ID NO: 2559) |  |
|  | 5'-GCCUGGUUUGAUACUGACCUGUAaa-3' | (SEQ ID NO: 342) |  |
|  | 3'-<u>ACC</u>GGACCAAACUAUGACUGGACAUUU-5' | (SEQ ID NO: 1451) |  |
| βc-2615 Target: | 5'-TGGCCTGGTTTGATACTGACCTGTAAA-3' | (SEQ ID NO: 2560) |  |
|  | 5'-CCUGGUUUGAUACUGACCUGUAAat-3' | (SEQ ID NO: 343) |  |
|  | 3'-<u>CCG</u>GACCAAACUAUGACUGGACAUUUA-5' | (SEQ ID NO: 1452) |  |
| βc-2616 Target: | 5'-GGCCTGGTTTGATACTGACCTGTAAAT-3' | (SEQ ID NO: 2561) |  |
|  | 5'-CUGGUUUGAUACUGACCUGUAAAtc-3' | (SEQ ID NO: 344) |  |
|  | 3'-<u>CGG</u>ACCAAACUAUGACUGGACAUUUAG-5' | (SEQ ID NO: 1453) |  |
| βc-2617 Target: | 5'-GCCTGGTTTGATACTGACCTGTAAATC-3' | (SEQ ID NO: 2562) |  |
|  | 5'-UGGUUUGAUACUGACCUGUAAAUca-3' | (SEQ ID NO: 345) |  |
|  | 3'-<u>GGA</u>CCAAACUAUGACUGGACAUUUAGU-5' | (SEQ ID NO: 1454) |  |
| βc-2618 Target: | 5'-CCTGGTTTGATACTGACCTGTAAATCA-3' | (SEQ ID NO: 2563) |  |
|  | 5'-GGUUUGAUACUGACCUGUAAAUCat-3' | (SEQ ID NO: 346) |  |
|  | 3'-<u>GAC</u>CAAACUAUGACUGGACAUUUAGUA-5' | (SEQ ID NO: 1455) |  |
| βc-2619 Target: | 5'-CTGGTTTGATACTGACCTGTAAATC-3' | (SEQ ID NO: 2564) |  |
|  | 5'-GUUUGAUACUGACCUGUAAAUCAtc-3' | (SEQ ID NO: 347) |  |
|  | 3'-<u>ACC</u>AAACUAUGACUGGACAUUUAGUAG-5' | (SEQ ID NO: 1456) |  |
| βc-2620 Target: | 5'-TGGTTTGATACTGACCTGTAAATCATC-3' | (SEQ ID NO: 2565) |  |
|  | 5'-UUUGAUACUGACCUGUAAAUCAUcc-3' | (SEQ ID NO: 348) |  |
|  | 3'-<u>CCA</u>AACUAUGACUGGACAUUUAGUAGG-5' | (SEQ ID NO: 1457) |  |
| βc-2621 Target: | 5'-GGTTTGATACTGACCTGTAAATCATCC-3' | (SEQ ID NO: 2566) |  |
|  | 5'-UUGAUACUGACCUGUAAAUCAUCct-3' | (SEQ ID NO: 349) |  |
|  | 3'-<u>CAA</u>ACUAUGACUGGACAUUUAGUAGGA-5' | (SEQ ID NO: 1458) |  |
| βc-2622 Target: | 5'-GTTTGATACTGACCTGTAAATCATCCT-3' | (SEQ ID NO: 2567) |  |
|  | 5'-UGAUACUGACCUGUAAAUCAUCCtt-3' | (SEQ ID NO: 350) |  |
|  | 3'-<u>AAA</u>CUAUGACUGGACAUUUAGUAGGAA-5' | (SEQ ID NO: 1459) |  |
| βc-2623 Target: | 5'-TTTGATACTGACCTGTAAATCATCCTT-3' | (SEQ ID NO: 2568) |  |
|  | 5'-UUUUGCCACAGCUUUUGCAACUUaa-3' | (SEQ ID NO: 351) |  |
|  | 3'-<u>AAA</u>AAACGGUGUCGAAAACGUUGAAUU-5' | (SEQ ID NO: 1460) |  |
| βc-2869 Target: | 5'-TTTTTTGCCACAGCTTTTGCAACTTAA-3' | (SEQ ID NO: 2569) |  |
|  | 5'-UGAGUAACAUUUGCUGUUUUAAAca-3' | (SEQ ID NO: 352) |  |
|  | 3'-<u>UUA</u>CUCAUUGUAAACGACAAAAUUUGU-5' | (SEQ ID NO: 1461) |  |
| βc-2902 Target: | 5'-AATGAGTAACATTTGCTGTTTTAAACA-3' | (SEQ ID NO: 2570) |  |

TABLE 3-continued

Selected Anti-β-catenin DsiRNAs, Duplexes Targeting Both Human and Mouse Sequences

|  |  |  |  |
|---|---|---|---|
|  | 5'-AACAUUAAUAGCAGCCUUUCUCUct-3' | (SEQ ID NO: 353) |
|  | 3'-<u>AU</u>UUGUAAUUAUCGUCGGAAAGAGAGA-5' | (SEQ ID NO: 1462) |
| βc-2923 Target: | 5'-TAAACATTAATAGCAGCCTTTCTCTCT-3' | (SEQ ID NO: 2571) |
|  | 5'-CAUUAAUAGCAGCCUUUCUCUCUtt-3' | (SEQ ID NO: 354) |
|  | 3'-<u>UU</u>GUAAUUAUCGUCGGAAAGAGAGAAA-5' | (SEQ ID NO: 1463) |
| βc-2925 Target: | 5'-AACATTAATAGCAGCCTTTCTCTCTTT-3' | (SEQ ID NO: 2572) |
|  | 5'-UUAAUAGCAGCCUUUCUCUCUUUat-3' | (SEQ ID NO: 355) |
|  | 3'-<u>GU</u>AAUUAUCGUCGGAAAGAGAGAAAUA-5' | (SEQ ID NO: 1464) |
| βc-2927 Target: | 5'-CATTAATAGCAGCCTTTCTCTCTTTAT-3' | (SEQ ID NO: 2573) |
|  | 5'-AAUAGCAGCCUUUCUCUCUUUAUac-3' | (SEQ ID NO: 356) |
|  | 3'-<u>AA</u>UUAUCGUCGGAAAGAGAGAAAUAUG-5' | (SEQ ID NO: 1465) |
| βc-2929 Target: | 5'-TTAATAGCAGCCTTTCTCTCTTTATAC-3' | (SEQ ID NO: 2574) |
|  | 5'-GCAUUGUGAUUGGCCUGUAGAGUtg-3' | (SEQ ID NO: 357) |
|  | 3'-<u>AA</u>CGUAACACUAACCGGACAUCUCAAC-5' | (SEQ ID NO: 1466) |
| βc-2973 Target: | 5'-TTGCATTGTGATTGGCCTGTAGAGTTG-3' | (SEQ ID NO: 2575) |
|  | 5'-AUUGUGAUUGGCCUGUAGAGUUGct-3' | (SEQ ID NO: 358) |
|  | 3'-<u>CG</u>UAACACUAACCGGACAUCUCAACGA-5' | (SEQ ID NO: 1467) |
| βc-2975 Target: | 5'-GCATTGTGATTGGCCTGTAGAGTTGCT-3' | (SEQ ID NO: 2576) |
|  | 5'-UGUGAUUGGCCUGUAGAGUUGCUga-3' | (SEQ ID NO: 359) |
|  | 3'-<u>UA</u>ACACUAACCGGACAUCUCAACGACU-5' | (SEQ ID NO: 1468) |
| βc-2977 Target: | 5'-ATTGTGATTGGCCTGTAGAGTTGCTGA-3' | (SEQ ID NO: 2577) |
|  | 5'-UGAUUGGCCUGUAGAGUUGCUGAga-3' | (SEQ ID NO: 360) |
|  | 3'-<u>AC</u>ACUAACCGGACAUCUCAACGACUCU-5' | (SEQ ID NO: 1469) |
| βc-2979 Target: | 5'-TGTGATTGGCCTGTAGAGTTGCTGAGA-3' | (SEQ ID NO: 2578) |
|  | 5'-AUUGGCCUGUAGAGUUGCUGAGAgg-3' | (SEQ ID NO: 361) |
|  | 3'-<u>AC</u>UAACCGGACAUCUCAACGACUCUCC-5' | (SEQ ID NO: 1470) |
| βc-2981 Target: | 5'-TGATTGGCCTGTAGAGTTGCTGAGAGG-3' | (SEQ ID NO: 2579) |
|  | 5'-UGGCCUGUAGAGUUGCUGAGAGGgc-3' | (SEQ ID NO: 362) |
|  | 3'-<u>UA</u>ACCGGACAUCUCAACGACUCUCCCG-5' | (SEQ ID NO: 1471) |
| βc-2983 Target: | 5'-ATTGGCCTGTAGAGTTGCTGAGAGGGC-3' | (SEQ ID NO: 2580) |
|  | 5'-GCCUGUAGAGUUGCUGAGAGGGCtc-3' | (SEQ ID NO: 363) |
|  | 3'-<u>AC</u>CGGACAUCUCAACGACUCUCCCGAG-5' | (SEQ ID NO: 1472) |
| βc-2985 Target: | 5'-TGGCCTGTAGAGTTGCTGAGAGGGCTC-3' | (SEQ ID NO: 2581) |
|  | 5'-CUGUAGAGUUGCUGAGAGGGCUCga-3' | (SEQ ID NO: 364) |
|  | 3'-<u>CG</u>GACAUCUCAACGACUCUCCCGAGCU-5' | (SEQ ID NO: 1473) |
| βc-2987 Target: | 5'-GCCTGTAGAGTTGCTGAGAGGGCTCGA-3' | (SEQ ID NO: 2582) |
|  | 5'-GUAGAGUUGCUGAGAGGGCUCGAgg-3' | (SEQ ID NO: 365) |
|  | 3'-<u>GA</u>CAUCUCAACGACUCUCCCGAGCUCC-5' | (SEQ ID NO: 1474) |
| βc-2989 Target: | 5'-CTGTAGAGTTGCTGAGAGGGCTCGAGG-3' | (SEQ ID NO: 2583) |

TABLE 3-continued

Selected Anti-β-catenin DsiRNAs, Duplexes Targeting Both Human and Mouse Sequences

|  |  |  |  |
|---|---|---|---|
|  | 5'-GUGGGCUGGUAUCUCAGAAAGUGcc-3' | (SEQ ID NO: 366) |  |
|  | 3'-CCCACCCGACCAUAGAGUCUUUCACGG-5' | (SEQ ID NO: 1475) |  |
| βc-3015 Target: | 5'-GGGTGGGCTGGTATCTCAGAAAGTGCC-3' | (SEQ ID NO: 2584) |  |
|  | 5'-GGGCUGGUAUCUCAGAAAGUGCCtg-3' | (SEQ ID NO: 367) |  |
|  | 3'-CACCCGACCAUAGAGUCUUUCACGGAC-5' | (SEQ ID NO: 1476) |  |
| βc-3017 Target: | 5'-GTGGGCTGGTATCTCAGAAAGTGCCTG-3' | (SEQ ID NO: 2585) |  |
|  | 5'-GCUGGUAUCUCAGAAAGUGCCUGac-3' | (SEQ ID NO: 368) |  |
|  | 3'-CCCGACCAUAGAGUCUUUCACGGACUG-5' | (SEQ ID NO: 1477) |  |
| βc-3019 Target: | 5'-GGGCTGGTATCTCAGAAAGTGCCTGAC-3' | (SEQ ID NO: 2586) |  |
|  | 5'-UGGUAUCUCAGAAAGUGCCUGACac-3' | (SEQ ID NO: 369) |  |
|  | 3'-CGACCAUAGAGUCUUUCACGGACUGUG-5' | (SEQ ID NO: 1478) |  |
| βc-3021 Target: | 5'-GCTGGTATCTCAGAAAGTGCCTGACAC-3' | (SEQ ID NO: 2587) |  |
|  | 5'-ACUAACCAAGCUGAGUUUCCUAUgg-3' | (SEQ ID NO: 370) |  |
|  | 3'-UGUGAUUGGUUCGACUCAAAGGAUACC-5' | (SEQ ID NO: 1479) |  |
| βc-3046 Target: | 5'-ACACTAACCAAGCTGAGTTTCCTATGG-3' | (SEQ ID NO: 2588) |  |
|  | 5'-UAACCAAGCUGAGUUUCCUAUGGga-3' | (SEQ ID NO: 371) |  |
|  | 3'-UGAUUGGUUCGACUCAAAGGAUACCCU-5' | (SEQ ID NO: 1480) |  |
| βc-3048 Target: | 5'-ACTAACCAAGCTGAGTTTCCTATGGGA-3' | (SEQ ID NO: 2589) |  |
|  | 5'-ACCAAGCUGAGUUUCCUAUGGGAac-3' | (SEQ ID NO: 372) |  |
|  | 3'-AUUGGUUCGACUCAAAGGAUACCCUUG-5' | (SEQ ID NO: 1481) |  |
| βc-3050 Target: | 5'-TAACCAAGCTGAGTTTCCTATGGGAAC-3' | (SEQ ID NO: 2590) |  |
|  | 5'-CAAGCUGAGUUUCCUAUGGGAACaa-3' | (SEQ ID NO: 373) |  |
|  | 3'-UGGUUCGACUCAAAGGAUACCCUUGUU-5' | (SEQ ID NO: 1482) |  |
| βc-3052 Target: | 5'-ACCAAGCTGAGTTTCCTATGGGAACAA-3' | (SEQ ID NO: 2591) |  |
|  | 5'-AGCUGAGUUUCCUAUGGGAACAAtt-3' | (SEQ ID NO: 374) |  |
|  | 3'-GUUCGACUCAAAGGAUACCCUUGUUAA-5' | (SEQ ID NO: 1483) |  |
| βc-3054 Target: | 5'-CAAGCTGAGTTTCCTATGGGAACAATT-3' | (SEQ ID NO: 2592) |  |
|  | 5'-CUGAGUUUCCUAUGGGAACAAUUga-3' | (SEQ ID NO: 375) |  |
|  | 3'-UCGACUCAAAGGAUACCCUUGUUAACU-5' | (SEQ ID NO: 1484) |  |
| βc-3056 Target: | 5'-AGCTGAGTTTCCTATGGGAACAATTGA-3' | (SEQ ID NO: 2593) |  |
|  | 5'-CUUUUUGUUCUGGUCCUUUUUGGtc-3' | (SEQ ID NO: 376) |  |
|  | 3'-UUGAAAAACAAGACCAGGAAAAACCAG-5' | (SEQ ID NO: 1485) |  |
| βc-3087 Target: | 5'-AACTTTTGTTCTGGTCCTTTTTGGTC-3' | (SEQ ID NO: 2594) |  |
|  | 5'-UUUUGUUCUGGUCCUUUUUGGUCga-3' | (SEQ ID NO: 377) |  |
|  | 3'-GAAAAACAAGACCAGGAAAAACCAGCU-5' | (SEQ ID NO: 1486) |  |
| βc-3089 Target: | 5'-CTTTTGTTCTGGTCCTTTTTGGTCGA-3' | (SEQ ID NO: 2595) |  |
|  | 5'-UUGUUCUGGUCCUUUUUGGUCGAgg-3' | (SEQ ID NO: 378) |  |
|  | 3'-AAAACAAGACCAGGAAAAACCAGCUCC-5' | (SEQ ID NO: 1487) |  |
| βc-3091 Target: | 5'-TTTTGTTCTGGTCCTTTTTGGTCGAGG-3' | (SEQ ID NO: 2596) |  |

TABLE 3-continued

Selected Anti-β-catenin DsiRNAs, Duplexes Targeting Both Human and Mouse Sequences

|  |  |  |  |
|---|---|---|---|
|  | 5'-GUUCUGGUCCUUUUUGGUCGAGGag-3' | (SEQ ID NO: 379) |
|  | 3'-AACAAGACCAGGAAAAACCAGCUCCUC-5' | (SEQ ID NO: 1488) |
| βc-3093 Target: | 5'-TTGTTCTGGTCCTTTTTGGTCGAGGAG-3' | (SEQ ID NO: 2597) |
|  | 5'-UCUGGUCCUUUUUGGUCGAGGAGta-3' | (SEQ ID NO: 380) |
|  | 3'-CAAGACCAGGAAAAACCAGCUCCUCAU-5' | (SEQ ID NO: 1489) |
| βc-3095 Target: | 5'-GTTCTGGTCCTTTTTGGTCGAGGAGTA-3' | (SEQ ID NO: 2598) |
|  | 5'-UGGUCCUUUUUGGUCGAGGAGUAac-3' | (SEQ ID NO: 381) |
|  | 3'-AGACCAGGAAAAACCAGCUCCUCAUUG-5' | (SEQ ID NO: 1490) |
| βc-3097 Target: | 5'-TCTGGTCCTTTTTGGTCGAGGAGTAAC-3' | (SEQ ID NO: 2599) |
|  | 5'-GUCCUUUUUGGUCGAGGAGUAACaa-3' | (SEQ ID NO: 382) |
|  | 3'-ACCAGGAAAAACCAGCUCCUCAUUGUU-5' | (SEQ ID NO: 1491) |
| βc-3099 Target: | 5'-TGGTCCTTTTTGGTCGAGGAGTAACAA-3' | (SEQ ID NO: 2600) |
|  | 5'-CCUUUUUGGUCGAGGAGUAACAAta-3' | (SEQ ID NO: 383) |
|  | 3'-CAGGAAAAACCAGCUCCUCAUUGUUAU-5' | (SEQ ID NO: 1492) |
| βc-3101 Target: | 5'-GTCCTTTTTGGTCGAGGAGTAACAATA-3' | (SEQ ID NO: 2601) |
|  | 5'-UUUUUGGUCGAGGAGUAACAAUAca-3' | (SEQ ID NO: 384) |
|  | 3'-GGAAAAACCAGCUCCUCAUUGUUAUGU-5' | (SEQ ID NO: 1493) |
| βc-3103 Target: | 5'-CCTTTTTGGTCGAGGAGTAACAATACA-3' | (SEQ ID NO: 2602) |
|  | 5'-UUUGGUCGAGGAGUAACAAUACAaa-3' | (SEQ ID NO: 385) |
|  | 3'-AAAACCAGCUCCUCAUUGUUAUGUUU-5' | (SEQ ID NO: 1494) |
| βc-3105 Target: | 5'-TTTTTGGTCGAGGAGTAACAATACAAA-3' | (SEQ ID NO: 2603) |
|  | 5'-UGGUCGAGGAGUAACAAUACAAAtg-3' | (SEQ ID NO: 386) |
|  | 3'-AAACCAGCUCCUCAUUGUUAUGUUUAC-5' | (SEQ ID NO: 1495) |
| βc-3107 Target: | 5'-TTTGGTCGAGGAGTAACAATACAAATG-3' | (SEQ ID NO: 2604) |
|  | 5'-GUCGAGGAGUAACAAUACAAAUGga-3' | (SEQ ID NO: 387) |
|  | 3'-ACCAGCUCCUCAUUGUUAUGUUUACCU-5' | (SEQ ID NO: 1496) |
| βc-3109 Target: | 5'-TGGTCGAGGAGTAACAATACAAATGGA-3' | (SEQ ID NO: 2605) |
|  | 5'-CGAGGAGUAACAAUACAAAUGGAtt-3' | (SEQ ID NO: 388) |
|  | 3'-CAGCUCCUCAUUGUUAUGUUUACCUAA-5' | (SEQ ID NO: 1497) |
| βc-3111 Target: | 5'-GTCGAGGAGTAACAATACAAATGGATT-3' | (SEQ ID NO: 2606) |
|  | 5'-AGGAGUAACAAUACAAAUGGAUUtt-3' | (SEQ ID NO: 389) |
|  | 3'-GCUCCUCAUUGUUAUGUUUACCUAAAA-5' | (SEQ ID NO: 1498) |
| βc-3113 Target: | 5'-CGAGGAGTAACAATACAAATGGATTTT-3' | (SEQ ID NO: 2607) |
|  | 5'-GAGUAACAAUACAAAUGGAUUUUgg-3' | (SEQ ID NO: 390) |
|  | 3'-UCCUCAUUGUUAUGUUUACCUAAAACC-5' | (SEQ ID NO: 1499) |
| βc-3115 Target: | 5'-AGGAGTAACAATACAAATGGATTTTGG-3' | (SEQ ID NO: 2608) |
|  | 5'-UAUCAAACCCUAGCCUUGCUUGUta-3' | (SEQ ID NO: 391) |
|  | 3'-AAAUAGUUUGGGAUCGGAACGAACAAU-5' | (SEQ ID NO: 1500) |
| βc-3191 Target: | 5'-TTTATCAAACCCTAGCCTTGCTTGTTA-3' | (SEQ ID NO: 2609) |

TABLE 3-continued

Selected Anti-β-catenin DsiRNAs, Duplexes Targeting Both Human and Mouse Sequences

| | | | |
|---|---|---|---|
| | | 5'-UCAAACCCUAGCCUUGCUUGUUAaa-3' | (SEQ ID NO: 392) |
| | | 3'-AUAGUUUGGGAUCGGAACGAACAAUUU-5' | (SEQ ID NO: 1501) |
| βc-3193 | Target: | 5'-TATCAAACCCTAGCCTTGCTTGTTAAA-3' | (SEQ ID NO: 2610) |
| | | 5'-AAACCCUAGCCUUGCUUGUUAAAtt-3' | (SEQ ID NO: 393) |
| | | 3'-AGUUUGGGAUCGGAACGAACAAUUUAA-5' | (SEQ ID NO: 1502) |
| βc-3195 | Target: | 5'-TCAAACCCTAGCCTTGCTTGTTAAATT-3' | (SEQ ID NO: 2611) |
| | | 5'-GAGUAAUGGUGUAGAACACUAAUtc-3' | (SEQ ID NO: 394) |
| | | 3'-AACUCAUUACCACAUCUUGUGAUUAAG-5' | (SEQ ID NO: 1503) |
| βc-3387 | Target: | 5'-TTGAGTAATGGTGTAGAACACTAATTC-3' | (SEQ ID NO: 2612) |
| | | 5'-GUAAUGGUGUAGAACACUAAUUCat-3' | (SEQ ID NO: 395) |
| | | 3'-CUCAUUACCACAUCUUGUGAUUAAGUA-5' | (SEQ ID NO: 1504) |
| βc-3389 | Target: | 5'-GAGTAATGGTGTAGAACACTAATTC-3' | (SEQ ID NO: 2613) |
| | | 5'-AAUGGUGUAGAACACUAAUUCAUaa-3' | (SEQ ID NO: 396) |
| | | 3'-CAUUACCACAUCUUGUGAUUAAGUAUU-5' | (SEQ ID NO: 1505) |
| βc-3391 | Target: | 5'-GTAATGGTGTAGAACACTAATTCATAA-3' | (SEQ ID NO: 2614) |
| | | 5'-UGGUGUAGAACACUAAUUCAUAAtc-3' | (SEQ ID NO: 397) |
| | | 3'-UUACCACAUCUUGUGAUUAAGUAUUAG-5' | (SEQ ID NO: 1506) |
| βc-3393 | Target: | 5'-AATGGTGTAGAACACTAATTCATAATC-3' | (SEQ ID NO: 2615) |
| | | 5'-GUGUAGAACACUAAUUCAUAAUCac-3' | (SEQ ID NO: 398) |
| | | 3'-ACCACAUCUUGUGAUUAAGUAUUAGUG-5' | (SEQ ID NO: 1507) |
| βc-3395 | Target: | 5'-TGGTGTAGAACACTAATTCATAATCAC-3' | (SEQ ID NO: 2616) |
| | | 5'-GUAGAACACUAAUUCAUAAUCACtc-3' | (SEQ ID NO: 399) |
| | | 3'-CACAUCUUGUGAUUAAGUAUUAGUGAG-5' | (SEQ ID NO: 1508) |
| βc-3397 | Target: | 5'-GTGTAGAACACTAATTCATAATCACTC-3' | (SEQ ID NO: 2617) |
| | | 5'-AGAACACUAAUUCAUAAUCACUCta-3' | (SEQ ID NO: 400) |
| | | 3'-CAUCUUGUGAUUAAGUAUUAGUGAGAU-5' | (SEQ ID NO: 1509) |
| βc-3399 | Target: | 5'-GTAGAACACTAATTCATAATCACTCTA-3' | (SEQ ID NO: 2618) |
| | | 5'-AACACUAAUUCAUAAUCACUCUAat-3' | (SEQ ID NO: 401) |
| | | 3'-UCUUGUGAUUAAGUAUUAGUGAGAUUA-5' | (SEQ ID NO: 1510) |
| βc-3401 | Target: | 5'-AGAACACTAATTCATAATCACTCTAAT-3' | (SEQ ID NO: 2619) |
| | | 5'-UUAGUUUCCUUUUUAAUAUGCUUaa-3' | (SEQ ID NO: 402) |
| | | 3'-UUAAUCAAAGGAAAAAUUAUACGAAUU-5' | (SEQ ID NO: 1511) |
| βc-3500 | Target: | 5'-AATTAGTTTCCTTTTTAATATGCTTAA-3' | (SEQ ID NO: 2620) |
| | | 5'-AGUUUCCUUUUUAAUAUGCUUAAaa-3' | (SEQ ID NO: 403) |
| | | 3'-AAUCAAAGGAAAAAUUAUACGAAUUUU-5' | (SEQ ID NO: 1512) |
| βc-3502 | Target: | 5'-TTAGTTTCCTTTTTAATATGCTTAAAA-3' | (SEQ ID NO: 2621) |
| | | 5'-UUUCCUUUUUAAUAUGCUUAAAAta-3' | (SEQ ID NO: 404) |
| | | 3'-UCAAAGGAAAAAUUAUACGAAUUUUAU-5' | (SEQ ID NO: 1513) |
| βc-3504 | Target: | 5'-AGTTTCCTTTTTAATATGCTTAAAATA-3' | (SEQ ID NO: 2622) |

TABLE 3-continued

Selected Anti-β-catenin DsiRNAs, Duplexes Targeting Both Human and Mouse Sequences

|             |         |                                             |                   |
|-------------|---------|---------------------------------------------|-------------------|
|             |         | 5'-UCCUUUUAAUAUGCUUAAAAUAag-3'              | (SEQ ID NO: 405)  |
|             |         | 3'-AAAGGAAAAAUUAUACGAAUUUUAUUC-5'           | (SEQ ID NO: 1514) |
| βc-3506     | Target: | 5'-TTTCCTTTTTAATATGCTTAAAATAAG-3'           | (SEQ ID NO: 2623) |
|             |         | 5'-CUUUUUAAUAUGCUUAAAAUAAGca-3'             | (SEQ ID NO: 406)  |
|             |         | 3'-AGGAAAAAUUAUACGAAUUUUAUUCGU-5'           | (SEQ ID NO: 1515) |
| βc-3508     | Target: | 5'-TCCTTTTTAATATGCTTAAAATAAGCA-3'           | (SEQ ID NO: 2624) |
|             |         | 5'-UUUUUAAUAUGCUUAAAAUAAGCag-3'             | (SEQ ID NO: 407)  |
|             |         | 3'-GGAAAAAUUAUACGAAUUUUAUUCGUC-5'           | (SEQ ID NO: 1516) |
| βc-3509     | Target: | 5'-CCTTTTTAATATGCTTAAAATAAGCAG-3'           | (SEQ ID NO: 2625) |
|             |         | 5'-UUUUAAUAUGCUUAAAAUAAGCAgg-3'             | (SEQ ID NO: 408)  |
|             |         | 3'-GAAAAAUUAUACGAAUUUUAUUCGUCC-5'           | (SEQ ID NO: 1517) |
| βc-3510     | Target: | 5'-CTTTTTAATATGCTTAAAATAAGCAGG-3'           | (SEQ ID NO: 2626) |
|             |         | 5'-UUAAUAUGCUUAAAAUAAGCAGGtg-3'             | (SEQ ID NO: 409)  |
|             |         | 3'-AAAAUUAUACGAAUUUUAUUCGUCCAC-5'           | (SEQ ID NO: 1518) |
| βc-3512     | Target: | 5'-TTTTAATATGCTTAAAATAAGCAGGTG-3'           | (SEQ ID NO: 2627) |
|             |         | 5'-AAUAUGCUUAAAAUAAGCAGGUGga-3'             | (SEQ ID NO: 410)  |
|             |         | 3'-AAUUAUACGAAUUUUAUUCGUCCACCU-5'           | (SEQ ID NO: 1519) |
| βc-3514     | Target: | 5'-TTAATATGCTTAAAATAAGCAGGTGGA-3'           | (SEQ ID NO: 2628) |
|             |         | 5'-UAUGCUUAAAAUAAGCAGGUGGAtc-3'             | (SEQ ID NO: 411)  |
|             |         | 3'-UUAUACGAAUUUUAUUCGUCCACCUAG-5'           | (SEQ ID NO: 1520) |
| βc-3516     | Target: | 5'-AATATGCTTAAAATAAGCAGGTGGATC-3'           | (SEQ ID NO: 2629) |
|             |         | 5'-UGCUUAAAAUAAGCAGGUGGAUCta-3'             | (SEQ ID NO: 412)  |
|             |         | 3'-AUACGAAUUUUAUUCGUCCACCUAGAU-5'           | (SEQ ID NO: 1521) |
| βc-3518     | Target: | 5'-TATGCTTAAAATAAGCAGGTGGATCTA-3'           | (SEQ ID NO: 2630) |
|             |         | 5'-CUUAAAAUAAGCAGGUGGAUCUAtt-3'             | (SEQ ID NO: 413)  |
|             |         | 3'-ACGAAUUUUAUUCGUCCACCUAGAUAA-5'           | (SEQ ID NO: 1522) |
| βc-3520     | Target: | 5'-TGCTTAAAATAAGCAGGTGGATCTATT-3'           | (SEQ ID NO: 2631) |
|             |         | 5'-UAAAAUAAGCAGGUGGAUCUAUUtc-3'             | (SEQ ID NO: 414)  |
|             |         | 3'-GAAUUUUAUUCGUCCACCUAGAUAAAG-5'           | (SEQ ID NO: 1523) |
| βc-3522     | Target: | 5'-CTTAAAATAAGCAGGTGGATCTATTTC-3'           | (SEQ ID NO: 2632) |
|             |         | 5'-AAAUAAGCAGGUGGAUCUAUUUCat-3'             | (SEQ ID NO: 415)  |
|             |         | 3'-AUUUUAUUCGUCCACCUAGAUAAAGUA-5'           | (SEQ ID NO: 1524) |
| βc-3524     | Target: | 5'-TAAAATAAGCAGGTGGATCTATTTC-3'             | (SEQ ID NO: 2633) |
|             |         | 5'-AUAAGCAGGUGGAUCUAUUUCAUgt-3'             | (SEQ ID NO: 416)  |
|             |         | 3'-UUUAUUCGUCCACCUAGAUAAAGUACA-5'           | (SEQ ID NO: 1525) |
| βc-3526     | Target: | 5'-AAATAAGCAGGTGGATCTATTTCATGT-3'           | (SEQ ID NO: 2634) |
|             |         | 5'-AAGCAGGUGGAUCUAUUUCAUGUtt-3'             | (SEQ ID NO: 417)  |
|             |         | 3'-UAUUCGUCCACCUAGAUAAAGUACAAA-5'           | (SEQ ID NO: 1526) |
| βc-3528     | Target: | 5'-ATAAGCAGGTGGATCTATTTCATGTTT-3'           | (SEQ ID NO: 2635) |

TABLE 3-continued

Selected Anti-β-catenin DsiRNAs, Duplexes Targeting Both Human and Mouse Sequences

|   |   |   |   |
|---|---|---|---|
|   | 5'-GCAGGUGGAUCUAUUUCAUGUUUtt-3' | (SEQ ID NO: 418) |   |
|   | 3'-UUCGUCCACCUAGAUAAAGUACAAAAA-5' | (SEQ ID NO: 1527) |   |
| βc-3530 Target: | 5'-AAGCAGGTGGATCTATTTCATGTTTTT-3' | (SEQ ID NO: 2636) |   |
|   | 5'-AGGUGGAUCUAUUUCAUGUUUUUga-3' | (SEQ ID NO: 419) |   |
|   | 3'-CGUCCACCUAGAUAAAGUACAAAAACU-5' | (SEQ ID NO: 1528) |   |
| βc-3532 Target: | 5'-GCAGGTGGATCTATTTCATGTTTTTGA-3' | (SEQ ID NO: 2637) |   |
|   | 5'-GUGGAUCUAUUUCAUGUUUUUGAtc-3' | (SEQ ID NO: 420) |   |
|   | 3'-UCCACCUAGAUAAAGUACAAAAACUAG-5' | (SEQ ID NO: 1529) |   |
| βc-3534 Target: | 5'-AGGTGGATCTATTTCATGTTTTTGATC-3' | (SEQ ID NO: 2638) |   |
|   | 5'-GGAUCUAUUUCAUGUUUUUGAUCaa-3' | (SEQ ID NO: 421) |   |
|   | 3'-CACCUAGAUAAAGUACAAAAACUAGUU-5' | (SEQ ID NO: 1530) |   |
| βc-3536 Target: | 5'-GTGGATCTATTTCATGTTTTTGATCAA-3' | (SEQ ID NO: 2639) |   |
|   | 5'-AUCUAUUUCAUGUUUUUGAUCAAaa-3' | (SEQ ID NO: 422) |   |
|   | 3'-CCUAGAUAAAGUACAAAAACUAGUUUU-5' | (SEQ ID NO: 1531) |   |
| βc-3538 Target: | 5'-GGATCTATTTCATGTTTTTGATCAAAA-3' | (SEQ ID NO: 2640) |   |
|   | 5'-GUAGGGUAAAUCAGUAAGAGGUGtt-3' | (SEQ ID NO: 423) |   |
|   | 3'-CCCAUCCCAUUUAGUCAUUCUCCACAA-5' | (SEQ ID NO: 1532) |   |
| βc-3583 Target: | 5'-GGGTAGGGTAAATCAGTAAGAGGTGTT-3' | (SEQ ID NO: 2641) |   |
|   | 5'-AGGGUAAAUCAGUAAGAGGUGUUat-3' | (SEQ ID NO: 424) |   |
|   | 3'-CAUCCCAUUUAGUCAUUCUCCACAAUA-5' | (SEQ ID NO: 1533) |   |
| βc-3585 Target: | 5'-GTAGGGTAAATCAGTAAGAGGTGTTAT-3' | (SEQ ID NO: 2642) |   |
|   | 5'-GGUAAAUCAGUAAGAGGUGUUAUtt-3' | (SEQ ID NO: 425) |   |
|   | 3'-UCCCAUUUAGUCAUUCUCCACAAUAAA-5' | (SEQ ID NO: 1534) |   |
| βc-3587 Target: | 5'-AGGGTAAATCAGTAAGAGGTGTTATTT-3' | (SEQ ID NO: 2643) |   |
|   | 5'-UAAAUCAGUAAGAGGUGUUAUUUgg-3' | (SEQ ID NO: 426) |   |
|   | 3'-CCAUUUAGUCAUUCUCCACAAUAAACC-5' | (SEQ ID NO: 1535) |   |
| βc-3589 Target: | 5'-GGTAAATCAGTAAGAGGTGTTATTTGG-3' | (SEQ ID NO: 2644) |   |
|   | 5'-AAUCAGUAAGAGGUGUUAUUUGGaa-3' | (SEQ ID NO: 427) |   |
|   | 3'-AUUUAGUCAUUCUCCACAAUAAACCUU-5' | (SEQ ID NO: 1536) |   |
| βc-3591 Target: | 5'-TAAATCAGTAAGAGGTGTTATTTGGAA-3' | (SEQ ID NO: 2645) |   |
|   | 5'-UCAGUAAGAGGUGUUAUUUGGAAcc-3' | (SEQ ID NO: 428) |   |
|   | 3'-UUAGUCAUUCUCCACAAUAAACCUUGG-5' | (SEQ ID NO: 1537) |   |
| βc-3593 Target: | 5'-AATCAGTAAGAGGTGTTATTTGGAACC-3' | (SEQ ID NO: 2646) |   |
|   | 5'-UACCAGUUGCCUUUUAUCCCAAAgt-3' | (SEQ ID NO: 429) |   |
|   | 3'-AAAUGGUCAACGGAAAAUAGGGUUUCA-5' | (SEQ ID NO: 1538) |   |
| βc-3633 Target: | 5'-TTTACCAGTTGCCTTTTATCCCAAAGT-3' | (SEQ ID NO: 2647) |   |
|   | 5'-CCAGUUGCCUUUUAUCCCAAAGUtg-3' | (SEQ ID NO: 430) |   |
|   | 3'-AUGGUCAACGGAAAAUAGGGUUUCAAC-5' | (SEQ ID NO: 1539) |   |
| βc-3635 Target: | 5'-TACCAGTTGCCTTTTATCCCAAAGTTG-3' | (SEQ ID NO: 2648) |   |

TABLE 3-continued

Selected Anti-β-catenin DsiRNAs, Duplexes Targeting Both Human and Mouse Sequences

|  |  |  |  |
|---|---|---|---|
|  |  | 5'-AGUUGCCUUUUAUCCCAAAGUUGtt-3' | (SEQ ID NO: 431) |
|  |  | 3'-GGUCAACGGAAAAUAGGGUUUCAACAA-5' | (SEQ ID NO: 1540) |
| βc-3637 | Target: | 5'-CCAGTTGCCTTTTATCCCAAAGTTGTT-3' | (SEQ ID NO: 2649) |
|  |  | 5'-UUGCCUUUUAUCCCAAAGUUGUUgt-3' | (SEQ ID NO: 432) |
|  |  | 3'-UCAACGGAAAAUAGGGUUUCAACAACA-5' | (SEQ ID NO: 1541) |
| βc-3639 | Target: | 5'-AGTTGCCTTTTATCCCAAAGTTGTTGT-3' | (SEQ ID NO: 2650) |
|  |  | 5'-GCCUUUUAUCCCAAAGUUGUUGUaa-3' | (SEQ ID NO: 433) |
|  |  | 3'-AACGGAAAAUAGGGUUUCAACAACAUU-5' | (SEQ ID NO: 1542) |
| βc-3641 | Target: | 5'-TTGCCTTTTATCCCAAAGTTGTTGTAA-3' | (SEQ ID NO: 2651) |
|  |  | 5'-CUUUUAUCCCAAAGUUGUUGUAAcc-3' | (SEQ ID NO: 434) |
|  |  | 3'-CGGAAAAUAGGGUUUCAACAACAUUGG-5' | (SEQ ID NO: 1543) |
| βc-3643 | Target: | 5'-GCCTTTTATCCCAAAGTTGTTGTAACC-3' | (SEQ ID NO: 2652) |
|  |  | 5'-UUUAUCCCAAAGUUGUUGUAACCtg-3' | (SEQ ID NO: 435) |
|  |  | 3'-GAAAAUAGGGUUUCAACAACAUUGGAC-5' | (SEQ ID NO: 1544) |
| βc-3645 | Target: | 5'-CTTTTATCCCAAAGTTGTTGTAACCTG-3' | (SEQ ID NO: 2653) |
|  |  | 5'-UAUCCCAAAGUUGUUGUAACCUGct-3' | (SEQ ID NO: 436) |
|  |  | 3'-AAAUAGGGUUUCAACAACAUUGGACGA-5' | (SEQ ID NO: 1545) |
| βc-3647 | Target: | 5'-TTTATCCCAAAGTTGTTGTAACCTGCT-3' | (SEQ ID NO: 2654) |
|  |  | 5'-UCCCAAAGUUGUUGUAACCUGCUgt-3' | (SEQ ID NO: 437) |
|  |  | 3'-AUAGGGUUUCAACAACAUUGGACGACA-5' | (SEQ ID NO: 1546) |
| βc-3649 | Target: | 5'-TATCCCAAAGTTGTTGTAACCTGCTGT-3' | (SEQ ID NO: 2655) |
|  |  | 5'-CCAAAGUUGUUGUAACCUGCUGUga-3' | (SEQ ID NO: 438) |
|  |  | 3'-AGGGUUUCAACAACAUUGGACGACACU-5' | (SEQ ID NO: 1547) |
| βc-3651 | Target: | 5'-TCCCAAAGTTGTTGTAACCTGCTGTGA-3' | (SEQ ID NO: 2656) |
|  |  | 5'-AAAGUUGUUGUAACCUGCUGUGAta-3' | (SEQ ID NO: 439) |
|  |  | 3'-GGUUUCAACAACAUUGGACGACACUAU-5' | (SEQ ID NO: 1548) |
| βc-3653 | Target: | 5'-CCAAAGTTGTTGTAACCTGCTGTGATA-3' | (SEQ ID NO: 2657) |
|  |  | 5'-AGUUGUUGUAACCUGCUGUGAUAcg-3' | (SEQ ID NO: 440) |
|  |  | 3'-UUUCAACAACAUUGGACGACACUAUGC-5' | (SEQ ID NO: 1549) |
| βc-3655 | Target: | 5'-AAAGTTGTTGTAACCTGCTGTGATACG-3' | (SEQ ID NO: 2658) |
|  |  | 5'-UUGUUGUAACCUGCUGUGAUACGat-3' | (SEQ ID NO: 441) |
|  |  | 3'-UCAACAACAUUGGACGACACUAUGCUA-5' | (SEQ ID NO: 1550) |
| βc-3657 | Target: | 5'-AGTTGTTGTAACCTGCTGTGATACGAT-3' | (SEQ ID NO: 2659) |
|  |  | 5'-GUUGUAACCUGCUGUGAUACGAUgc-3' | (SEQ ID NO: 442) |
|  |  | 3'-AACAACAUUGGACGACACUAUGCUACG-5' | (SEQ ID NO: 1551) |
| βc-3659 | Target: | 5'-TTGTTGTAACCTGCTGTGATACGATGC-3' | (SEQ ID NO: 2660) |
|  |  | 5'-AAAUGGUUCAGAAUUAAACUUUUaa-3' | (SEQ ID NO: 443) |
|  |  | 3'-UUUUUACCAAGUCUUAAUUUGAAAAUU-5' | (SEQ ID NO: 1552) |
| βc-3708 | Target: | 5'-AAAAATGGTTCAGAATTAAACTTTTAA-3' | (SEQ ID NO: 2661) |

TABLE 3-continued

Selected Anti-β-catenin DsiRNAs, Duplexes Targeting Both Human and Mouse Sequences

|  |  |  |
|---|---|---|
|  | 5'-AUGGUUCAGAAUUAAACUUUUAAtt-3' | (SEQ ID NO: 444) |
|  | 3'-UUUACCAAGUCUUAAUUUGAAAAUUAA-5' | (SEQ ID NO: 1553) |
| βc-3710 Target: | 5'-AAATGGTTCAGAATTAAACTTTTAATT-3' | (SEQ ID NO: 2662) |
|  | 5'-GGUUCAGAAUUAAACUUUUAAUUca-3' | (SEQ ID NO: 445) |
|  | 3'-UACCAAGUCUUAAUUUGAAAAUUAAGU-5' | (SEQ ID NO: 1554) |
| βc-3712 Target: | 5'-ATGGTTCAGAATTAAACTTTTAATTCA-3' | (SEQ ID NO: 2663) |
|  | 5'-UUCAGAAUUAAACUUUUAAUUCAtt-3' | (SEQ ID NO: 446) |
|  | 3'-CCAAGUCUUAAUUUGAAAAUUAAGUAA-5' | (SEQ ID NO: 1555) |
| βc-3714 Target: | 5'-GGTTCAGAATTAAACTTTTAATTCATT-3' | (SEQ ID NO: 2664) |
|  | 5'-CAGAAUUAAACUUUUAAUUCAUUcg-3' | (SEQ ID NO: 447) |
|  | 3'-AAGUCUUAAUUUGAAAAUUAAGUAAGC-5' | (SEQ ID NO: 1556) |
| βc-3716 Target: | 5'-TTCAGAATTAAACTTTTAATTCATTCG-3' | (SEQ ID NO: 2665) |

TABLE 4

Selected Anti-β-catenin DsiRNAs, *Mus musculus* Unique Duplexes

|  |  |  |
|---|---|---|
|  | 5'-GCAGCAGUCUUACUUGGAUUCUGga-3' | (SEQ ID NO: 448) |
|  | 3'-GUCGUCGUCAGAAUGAACCUAAGACCU-5' | (SEQ ID NO: 1557) |
| βc-m314 Target: | 5'-CAGCAGCAGTCTTACTTGGATTCTGGA-3' | (SEQ ID NO: 2666) |
|  | 5'-ACUUGGAUUCUGGAAUCCAUUCUgg-3' | (SEQ ID NO: 449) |
|  | 3'-AAUGAACCUAAGACCUUAGGUAAGACC-5' | (SEQ ID NO: 1558) |
| βc-m325 Target: | 5'-TTACTTGGATTCTGGAATCCATTCTGG-3' | (SEQ ID NO: 2667) |
|  | 5'-GACACCUCCCAAGUCCUUUAUGAat-3' | (SEQ ID NO: 450) |
|  | 3'-AACUGUGGAGGGUUCAGGAAAUACUUA-5' | (SEQ ID NO: 1559) |
| βc-m408 Target: | 5'-TTGACACCTCCCAAGTCCTTTATGAAT-3' | (SEQ ID NO: 2668) |
|  | 5'-CGCAAGAGCAAGUAGCUGAUAUUga-3' | (SEQ ID NO: 451) |
|  | 3'-GUGCGUUCUCGUUCAUCGACUAUAACU-5' | (SEQ ID NO: 1560) |
| βc-m460 Target: | 5'-CACGCAAGAGCAAGTAGCTGATATTGA-3' | (SEQ ID NO: 2669) |
|  | 5'-CCAUGUUCCCUGAGACGCUAGAUga-3' | (SEQ ID NO: 452) |
|  | 3'-ACGGUACAAGGGACUCUGCGAUCUACU-5' | (SEQ ID NO: 1561) |
| βc-m526 Target: | 5'-TGCCATGTTCCCTGAGACGCTAGATGA-3' | (SEQ ID NO: 2670) |
|  | 5'-UGAAACAUGCAGUUGUCAAUUUGat-3' | (SEQ ID NO: 453) |
|  | 3'-CAACUUUGUACGUCAACAGUUAAACUA-5' | (SEQ ID NO: 1562) |
| βc-m631 Target: | 5'-GTTGAAACATGCAGTTGTCAATTTGAT-3' | (SEQ ID NO: 2671) |
|  | 5'-CAUGCAGUUGUCAAUUUGAUUAAct-3' | (SEQ ID NO: 454) |
|  | 3'-UUGUACGUCAACAGUUAAACUAAUUGA-5' | (SEQ ID NO: 1563) |
| βc-m636 Target: | 5'-AACATGCAGTTGTCAATTTGATTAACT-3' | (SEQ ID NO: 2672) |

TABLE 4-continued

Selected Anti-β-catenin DsiRNAs, *Mus musculus* Unique Duplexes

|  |  |  |
|---|---|---|
|  | 5'-GUUGUCAAUUUGAUUAACUAUCAgg-3' | (SEQ ID NO: 455) |
|  | 3'-GUCAACAGUUAAACUAAUUGAUAGUCC-5' | (SEQ ID NO: 1564) |
| βc-m642 Target: | 5'-CAGTTGTCAATTTGATTAACTATCAGG-3' | (SEQ ID NO: 2673) |
|  | 5'-GAGGACCAGGUGGUAGUUAAUAAag-3' | (SEQ ID NO: 456) |
|  | 3'-UACUCCUGGUCCACCAUCAAUUAUUUC-5' | (SEQ ID NO: 1565) |
| βc-m723 Target: | 5'-ATGAGGACCAGGTGGTAGTTAATAAAG-3' | (SEQ ID NO: 2674) |
|  | 5'-GGUCACCAGUGGAUUCUGUACUGtt-3' | (SEQ ID NO: 457) |
|  | 3'-ACCCAGUGGUCACCUAAGACAUGACAA-5' | (SEQ ID NO: 1566) |
| βc-m970 Target: | 5'-TGGGTCACCAGTGGATTCTGTACTGTT-3' | (SEQ ID NO: 2675) |
|  | 5'-CAGUGGAUUCUGUACUGUUCUACgc-3' | (SEQ ID NO: 458) |
|  | 3'-UGGUCACCUAAGACAUGACAAGAUGCG-5' | (SEQ ID NO: 1567) |
| βc-m976 Target: | 5'-ACCAGTGGATTCTGTACTGTTCTACGC-3' | (SEQ ID NO: 2676) |
|  | 5'-GAUUCUGUACUGUUCUACGCCAUca-3' | (SEQ ID NO: 459) |
|  | 3'-ACCUAAGACAUGACAAGAUGCGGUAGU-5' | (SEQ ID NO: 1568) |
| βc-m981 Target: | 5'-TGGATTCTGTACTGTTCTACGCCATCA-3' | (SEQ ID NO: 2677) |
|  | 5'-GUGGACUGCAGAAAAUGGUUGCUtt-3' | (SEQ ID NO: 460) |
|  | 3'-ACCACCUGACGUCUUUUACCAACGAAA-5' | (SEQ ID NO: 1569) |
| βc-m1066 Target: | 5'-TGGTGGACTGCAGAAAATGGTTGCTTT-3' | (SEQ ID NO: 2678) |
|  | 5'-CGUGAAAUUCUUGGCUAUUACAAca-3' | (SEQ ID NO: 461) |
|  | 3'-UUGCACUUUAAGAACCGAUAAUGUUGU-5' | (SEQ ID NO: 1570) |
| βc-m1106 Target: | 5'-AACGTGAAATTCTTGGCTATTACAACA-3' | (SEQ ID NO: 2679) |
|  | 5'-CAAGUCAGCGACUUGUUCAAAACtg-3' | (SEQ ID NO: 462) |
|  | 3'-GGGUUCAGUCGCUGAACAAGUUUUGAC-5' | (SEQ ID NO: 1571) |
| βc-m1354 Target: | 5'-CCCAAGTCAGCGACTTGTTCAAAACTG-3' | (SEQ ID NO: 2680) |
|  | 5'-GACUUGUUCAAAACUGUCUUUGGac-3' | (SEQ ID NO: 463) |
|  | 3'-CGCUGAACAAGUUUUGACAGAAACCUG-5' | (SEQ ID NO: 1572) |
| βc-m1363 Target: | 5'-GCGACTTGTTCAAAACTGTCTTTGGAC-3' | (SEQ ID NO: 2681) |
|  | 5'-AAACUGUCUUUGGACUCUCAGAAac-3' | (SEQ ID NO: 464) |
|  | 3'-GUUUUGACAGAAACCUGAGAGUCUUUG-5' | (SEQ ID NO: 1573) |
| βc-m1373 Target: | 5'-CAAAACTGTCTTTGGACTCTCAGAAAC-3' | (SEQ ID NO: 2682) |
|  | 5'-CUCUAACCUCACUUGCAAUAAUUac-3' | (SEQ ID NO: 465) |
|  | 3'-GAGAGAUUGGAGUGAACGUUAUUAAUG-5' | (SEQ ID NO: 1574) |
| βc-m1508 Target: | 5'-CTCTCTAACCTCACTTGCAATAATTAC-3' | (SEQ ID NO: 2683) |
|  | 5'-CUCACUUGCAAUAAUUACAAAAAca-3' | (SEQ ID NO: 466) |
|  | 3'-UGGAGUGAACGUUAUUAAUGUUUUUGU-5' | (SEQ ID NO: 1575) |
| βc-m1515 Target: | 5'-ACCTCACTTGCAATAATTACAAAAACA-3' | (SEQ ID NO: 2684) |
|  | 5'-GAAUGCCGUUCGCCUUCAUUAUGga-3' | (SEQ ID NO: 467) |
|  | 3'-GUCUUACGGCAAGCGGAAGUAAUACCU-5' | (SEQ ID NO: 1576) |
| βc-m1682 Target: | 5'-CAGAATGCCGTTCGCCTTCATTATGGA-3' | (SEQ ID NO: 2685) |

TABLE 4-continued

Selected Anti-β-catenin DsiRNAs, *Mus musculus* Unique Duplexes

|  |  |  |
| --- | --- | --- |
|  | 5'-GCCUUCAUUAUGGACUGCCUGUUgt-3' | (SEQ ID NO: 468) |
|  | 3'-<u>AGC</u>GGAAGUAAUACCUGACGGACAACA-5' | (SEQ ID NO: 1577) |
| βc-m1693 Target: | 5'-TCGCCTTCATTATGGACTGCCTGTTGT-3' | (SEQ ID NO: 2686) |
|  | 5'-CAUUAUGGACUGCCUGUUGUGGUta-3' | (SEQ ID NO: 469) |
|  | 3'-<u>AAG</u>UAAUACCUGACGGACAACACCAAU-5' | (SEQ ID NO: 1578) |
| βc-m1698 Target: | 5'-TTCATTATGGACTGCCTGTTGTGGTTA-3' | (SEQ ID NO: 2687) |
|  | 5'-GACUGCCUGUUGUGGUUAAACUCct-3' | (SEQ ID NO: 470) |
|  | 3'-<u>ACC</u>UGACGGACAACACCAAUUUGAGGA-5' | (SEQ ID NO: 1579) |
| βc-m1705 Target: | 5'-TGGACTGCCTGTTGTGGTTAAACTCCT-3' | (SEQ ID NO: 2688) |
|  | 5'-AACUGUUGGAUUGAUUCGAAACCtt-3' | (SEQ ID NO: 471) |
|  | 3'-<u>CGU</u>UGACAACCUAACUAAGCUUUGGAA-5' | (SEQ ID NO: 1580) |
| βc-m1763 Target: | 5'-GCAACTGTTGGATTGATTCGAAACCTT-3' | (SEQ ID NO: 2689) |
|  | 5'-GAGGACUCAAUACCAUUCCAUUGtt-3' | (SEQ ID NO: 472) |
|  | 3'-<u>GGC</u>UCCUGAGUUAUGGUAAGGUAACAA-5' | (SEQ ID NO: 1581) |
| βc-m2008 Target: | 5'-CCGAGGACTCAATACCATTCCATTGTT-3' | (SEQ ID NO: 2690) |
|  | 5'-GAGGACAAGCCACAGGAUUACAAga-3' | (SEQ ID NO: 473) |
|  | 3'-<u>GAC</u>UCCUGUUCGGUGUCCUAAUGUUCU-5' | (SEQ ID NO: 1582) |
| βc-m2226 Target: | 5'-CTGAGGACAAGCCACAGGATTACAAGA-3' | (SEQ ID NO: 2691) |
|  | 5'-AUGGACCCUAUGAUGGAGCAUGAga-3' | (SEQ ID NO: 474) |
|  | 3'-<u>CCU</u>ACCUGGGAUACUACCUCGUACUCU-5' | (SEQ ID NO: 1583) |
| βc-m2427 Target: | 5'-GGATGGACCCTATGATGGAGCATGAGA-3' | (SEQ ID NO: 2692) |
|  | 5'-GAUACUGACCUGUAAAUCGUCCUtt-3' | (SEQ ID NO: 475) |
|  | 3'-<u>AAC</u>UAUGACUGGACAUUUAGCAGGAAA-5' | (SEQ ID NO: 1584) |
| βc-m2568 Target: | 5'-TTGATACTGACCTGTAAATCGTCCTTT-3' | (SEQ ID NO: 2693) |
|  | 5'-CCAGUGUGGGUGAAUACUUUACUct-3' | (SEQ ID NO: 476) |
|  | 3'-<u>UCG</u>GUCACACCCACUUAUGAAAUGAGA-5' | (SEQ ID NO: 1585) |
| βc-m2614 Target: | 5'-AGCCAGTGTGGGTGAATACTTTACTCT-3' | (SEQ ID NO: 2694) |
|  | 5'-CCACAGCUUUUGCAGCGUUAUACtc-3' | (SEQ ID NO: 477) |
|  | 3'-<u>ACG</u>GUGUCGAAAACGUCGCAAUAUGAG-5' | (SEQ ID NO: 1586) |
| βc-m2770 Target: | 5'-TGCCACAGCTTTTGCAGCGTTATACTC-3' | (SEQ ID NO: 2695) |
|  | 5'-UUUUGCAGCGUUAUACUCAGAUGag-3' | (SEQ ID NO: 478) |
|  | 3'-<u>CGA</u>AAACGUCGCAAUAUGAGUCUACUC-5' | (SEQ ID NO: 1587) |
| βc-m2777 Target: | 5'-GCTTTTGCAGCGTTATACTCAGATGAG-3' | (SEQ ID NO: 2696) |
|  | 5'-GCGUUAUACUCAGAUGAGUAACAtt-3' | (SEQ ID NO: 479) |
|  | 3'-<u>GUC</u>GCAAUAUGAGUCUACUCAUUGUAA-5' | (SEQ ID NO: 1588) |
| βc-m2784 Target: | 5'-CAGCGTTATACTCAGATGAGTAACATT-3' | (SEQ ID NO: 2697) |
|  | 5'-AUUUGCUGUUUUCAACAUUAAUAgc-3' | (SEQ ID NO: 480) |
|  | 3'-<u>UGU</u>AAACGACAAAAGUUGUAAUUAUCG-5' | (SEQ ID NO: 1589) |
| βc-m2806 Target: | 5'-ACATTTGCTGTTTTCAACATTAATAGC-3' | (SEQ ID NO: 2698) |

TABLE 4-continued

Selected Anti-β-catenin DsiRNAs, *Mus musculus* Unique Duplexes

```
                5'-CUGUAGUGUCUGAACGUGCAUUGtg-3'    (SEQ ID NO: 481)
                3'-UCGACAUCACAGACUUGCACGUAACAC-5'  (SEQ ID NO: 1590)
βc-m2850 Target: 5'-AGCTGTAGTGTCTGAACGTGCATTGTG-3' (SEQ ID NO: 2699)

5'-GAACAGUCGAAGUACGCUUUUUGtt-3'    (SEQ ID NO: 482)
                3'-CCCUUGUCAGCUUCAUGCGAAAAACAA-5'  (SEQ ID NO: 1591)
βc-m2965 Target: 5'-GGGAACAGTCGAAGTACGCTTTTTGTT-3' (SEQ ID NO: 2700)

5'-GUCGAAGUACGCUUUUUGUUCUGgt-3'    (SEQ ID NO: 483)
                3'-GUCAGCUUCAUGCGAAAAACAAGACCA-5'  (SEQ ID NO: 1592)
βc-m2970 Target: 5'-CAGTCGAAGTACGCTTTTTGTTCTGGT-3' (SEQ ID NO: 2701)

5'-GUACGCUUUUUGUUCUGGUCCUUtt-3'    (SEQ ID NO: 484)
                3'-UUCAUGCGAAAAACAAGACCAGGAAAA-5'  (SEQ ID NO: 1593)
βc-m2976 Target: 5'-AAGTACGCTTTTTGTTCTGGTCCTTTT-3' (SEQ ID NO: 2702)

5'-CCUAGCCUUGCUUGUUCUUUGUUtt-3'    (SEQ ID NO: 485)
                3'-UGGGAUCGGAACGAACAAGAAACAAAA-5'  (SEQ ID NO: 1594)
βc-m3092 Target: 5'-ACCCTAGCCTTGCTTGTTCTTTGTTTT-3' (SEQ ID NO: 2703)

5'-CCUUGCUUGUUCUUUGUUUUAAUat-3'    (SEQ ID NO: 486)
                3'-UCGGAACGAACAAGAAACAAAAUUAUA-5'  (SEQ ID NO: 1595)
βc-m3097 Target: 5'-AGCCTTGCTTGTTCTTTGTTTTAATAT-3' (SEQ ID NO: 2704)

5'-AACCUGCUACAGCAAUUUCUGAUtt-3'    (SEQ ID NO: 487)
                3'-ACUUGGACGAUGUCGUUAAAGACUAAA-5'  (SEQ ID NO: 1596)
βc-m3198 Target: 5'-TGAACCTGCTACAGCAATTTCTGATTT-3' (SEQ ID NO: 2705)

5'-CAGCAAUUUCUGAUUUCUAAGAAcc-3'    (SEQ ID NO: 488)
                3'-AUGUCGUUAAAGACUAAAGAUUCUUGG-5'  (SEQ ID NO: 1597)
βc-m3207 Target: 5'-TACAGCAATTTCTGATTTCTAAGAACC-3' (SEQ ID NO: 2706)

5'-GUAAGAGGUGUUAUUUGAGCCUUgt-3'    (SEQ ID NO: 489)
                3'-GUCAUUCUCCACAAUAAACUCGGAACA-5'  (SEQ ID NO: 1598)
βc-m3433 Target: 5'-CAGTAAGAGGTGTTATTTGAGCCTTGT-3' (SEQ ID NO: 2707)

5'-GGUGUUAUUUGAGCCUUGUUUUGga-3'    (SEQ ID NO: 490)
                3'-CUCCACAAUAAACUCGGAACAAAACCU-5'  (SEQ ID NO: 1599)
βc-m3439 Target: 5'-GAGGTGTTATTTGAGCCTTGTTTTGGA-3' (SEQ ID NO: 2708)

5'-UAUUUGAGCCUUGUUUUGGACAGta-3'    (SEQ ID NO: 491)
                3'-CAAUAAACUCGGAACAAAACCUGUCAU-5'  (SEQ ID NO: 1600)
βc-m3444 Target: 5'-GTTATTTGAGCCTTGTTTTGGACAGTA-3' (SEQ ID NO: 2709)

5'-GAGCCUUGUUUUGGACAGUAUACca-3'    (SEQ ID NO: 492)
                3'-AACUCGGAACAAAACCUGUCAUAUGGU-5'  (SEQ ID NO: 1601)
βc-m3449 Target: 5'-TTGAGCCTTGTTTTGGACAGTATACCA-3' (SEQ ID NO: 2710)

5'-CAACAGAUGCGGUUAUAGAAAUGgt-3'    (SEQ ID NO: 493)
                3'-AAGUUGUCUACGCCAAUAUCUUUACCA-5'  (SEQ ID NO: 1602)
βc-m3522 Target: 5'-TTCAACAGATGCGGTTATAGAAATGGT-3' (SEQ ID NO: 2711)
```

TABLE 4-continued

Selected Anti-β-catenin DsiRNAs, *Mus musculus* Unique Duplexes

|  |  |  |
|---|---|---|
|  | 5'-GUUAUAGAAAUGGUUCAGAAUUAaa-3' | (SEQ ID NO: 494) |
|  | 3'-GCCAAUAUCUUUACCAAGUCUUAAUUU-5' | (SEQ ID NO: 1603) |
| βc-m3533 Target: | 5'-CGGTTATAGAAATGGTTCAGAATTAAA-3' | (SEQ ID NO: 2712) |
|  | 5'-AGAAAUGGUUCAGAAUUAAACUUtt-3' | (SEQ ID NO: 495) |
|  | 3'-UAUCUUUACCAAGUCUUAAUUUGAAAA-5' | (SEQ ID NO: 1604) |
| βc-m3538 Target: | 5'-ATAGAAATGGTTCAGAATTAAACTTTT-3' | (SEQ ID NO: 2713) |

Projected 21 nucleotide target sequences for each DsiRNA of Tables 2-4 above and of Tables 6-8 below are presented in Table 5.

TABLE 5

21 Nucleotide Target Sequences of Selected DsiRNAs

| | | |
|---|---|---|
| βc-240 21 nt Target: | 5'-CCCTGAGGGTATTTGAAGTAT-3' | (SEQ ID NO: 4444) |
| βc-244 21 nt Target: | 5'-GAGGGTATTTGAAGTATACCA-3' | (SEQ ID NO: 4445) |
| βc-253 21 nt Target: | 5'-TGAAGTATACCATACAACTGT-3' | (SEQ ID NO: 4446) |
| βc-259 21 nt Target: | 5'-ATACCATACAACTGTTTTGAA-3' | (SEQ ID NO: 4447) |
| βc-264 21 nt Target: | 5'-ATACAACTGTTTTGAAAATCC-3' | (SEQ ID NO: 4448) |
| βc-496 21 nt Target: | 5'-CAGGGATTTTCTCAGTCCTTC-3' | (SEQ ID NO: 4449) |
| βc-516 21 nt Target: | 5'-CACTCAAGAACAAGTAGCTGA-3' | (SEQ ID NO: 4450) |
| βc-522 21 nt Target: | 5'-AGAACAAGTAGCTGATATTGA-3' | (SEQ ID NO: 4451) |
| βc-524 21 nt Target: | 5'-AACAAGTAGCTGATATTGATG-3' | (SEQ ID NO: 4452) |
| βc-540 21 nt Target: | 5'-TGATGGACAGTATGCAATGAC-3' | (SEQ ID NO: 4453) |
| βc-582 21 nt Target: | 5'-TGCTATGTTCCCTGAGACATT-3' | (SEQ ID NO: 4454) |
| βc-686 21 nt Target: | 5'-TGCTGAAACATGCAGTTGTAA-3' | (SEQ ID NO: 4455) |
| βc-692 21 nt Target: | 5'-AACATGCAGTTGTAAACTTGA-3' | (SEQ ID NO: 4456) |
| βc-697 21 nt Target: | 5'-GCAGTTGTAAACTTGATTAAC-3' | (SEQ ID NO: 4457) |
| βc-707 21 nt Target: | 5'-ACTTGATTAACTATCAAGATG-3' | (SEQ ID NO: 4458) |
| βc-753 21 nt Target: | 5'-CCCTGAACTGACAAAACTGCT-3' | (SEQ ID NO: 4459) |
| βc-870 21 nt Target: | 5'-TCAGATGGTGTCTGCTATTGT-3' | (SEQ ID NO: 4460) |
| βc-889 21 nt Target: | 5'-GTACGTACCATGCAGAATACA-3' | (SEQ ID NO: 4461) |
| βc-1060 21 nt Target: | 5'-ATTACAACTCTCCACAACCTT-3' | (SEQ ID NO: 4462) |
| βc-1065 21 nt Target: | 5'-AACTCTCCACAACCTTTTATT-3' | (SEQ ID NO: 4463) |
| βc-1070 21 nt Target: | 5'-TCCACAACCTTTTATTACATC-3' | (SEQ ID NO: 4464) |
| βc-1076 21 nt Target: | 5'-ACCTTTTATTACATCAAGAAG-3' | (SEQ ID NO: 4465) |
| βc-1154 21 nt Target: | 5'-ACAAAACAAATGTTAAATTCT-3' | (SEQ ID NO: 4466) |
| βc-1180 21 nt Target: | 5'-ATTACGACAGACTGCCTTCAA-3' | (SEQ ID NO: 4467) |
| βc-1185 21 nt Target: | 5'-GACAGACTGCCTTCAAATTTT-3' | (SEQ ID NO: 4468) |
| βc-1260 21 nt Target: | 5'-AGCTTTAGTAAATATAATGAG-3' | (SEQ ID NO: 4469) |
| βc-1294 21 nt Target: | 5'-GAAAAACTACTGTGGACCACA-3' | (SEQ ID NO: 4470) |
| βc-1412 21 nt Target: | 5'-CAAGTCAACGTCTTGTTCAGA-3' | (SEQ ID NO: 4471) |

TABLE 5-continued

21 Nucleotide Target Sequences of Selected DsiRNAs

| βc-1418 21 nt Target: | 5'-AACGTCTTGTTCAGAACTGTC-3' (SEQ ID NO: 4472) |
| βc-1423 21 nt Target: | 5'-CTTGTTCAGAACTGTCTTTGG-3' (SEQ ID NO: 4473) |
| βc-1520 21 nt Target: | 5'-TGGGTTCAGATGATATAAATG-3' (SEQ ID NO: 4474) |
| βc-1561 21 nt Target: | 5'-ATTCTTTCTAACCTCACTTGC-3' (SEQ ID NO: 4475) |
| βc-1571 21 nt Target: | 5'-ACCTCACTTGCAATAATTATA-3' (SEQ ID NO: 4476) |
| βc-1579 21 nt Target: | 5'-TGCAATAATTATAAGAACAAG-3' (SEQ ID NO: 4477) |
| βc-1620 21 nt Target: | 5'-TGGTATAGAGGCTCTTGTGCG-3' (SEQ ID NO: 4478) |
| βc-1816 21 nt Target: | 5'-AAGGCTACTGTTGGATTGATT-3' (SEQ ID NO: 4479) |
| βc-1987 21 nt Target: | 5'-CGCATGGAAGAAATAGTTGAA-3' (SEQ ID NO: 4480) |
| βc-1989 21 nt Target: | 5'-CATGGAAGAAATAGTTGAAGG-3' (SEQ ID NO: 4481) |
| βc-2111 21 nt Target: | 5'-CCATTGAAAACATCCAAAGAG-3' (SEQ ID NO: 4482) |
| βc-2282 21 nt Target: | 5'-CTGAGGACAAGCCACAAGATT-3' (SEQ ID NO: 4483) |
| βc-2624 21 nt Target: | 5'-TTGATACTGACCTGTAAATCA-3' (SEQ ID NO: 4484) |
| βc-2647 21 nt Target: | 5'-CTTTAGGTAAGAAGTTTTAAA-3' (SEQ ID NO: 4485) |
| βc-2770 21 nt Target: | 5'-AACAGGTATATACTTTGAAAG-3' (SEQ ID NO: 4486) |
| βc-2848 21 nt Target: | 5'-TGGAAGTTATTAACTTTAATG-3' (SEQ ID NO: 4487) |
| βc-2874 21 nt Target: | 5'-TGCCACAGCTTTTGCAACTTA-3' (SEQ ID NO: 4488) |
| βc-2909 21 nt Target: | 5'-AACATTTGCTGTTTTAAACAT-3' (SEQ ID NO: 4489) |
| βc-3074 21 nt Target: | 5'-AACAATTGAAGTAAACTTTTT-3' (SEQ ID NO: 4490) |
| βc-3197 21 nt Target: | 5'-AAACCCTAGCCTTGCTTGTTA-3' (SEQ ID NO: 4491) |
| βc-3203 21 nt Target: | 5'-TAGCCTTGCTTGTTAAATTTT-3' (SEQ ID NO: 4492) |
| βc-3273 21 nt Target: | 5'-TTGAAGTAGCTCTTTTTTTTT-3' (SEQ ID NO: 4493) |
| βc-3333 21 nt Target: | 5'-TCGTAGTGTTAAGTTATAGTG-3' (SEQ ID NO: 4494) |
| βc-3349 21 nt Target: | 5'-TAGTGAATACTGCTACAGCAA-3' (SEQ ID NO: 4495) |
| βc-3354 21 nt Target: | 5'-AATACTGCTACAGCAATTTCT-3' (SEQ ID NO: 4496) |
| βc-3371 21 nt Target: | 5'-TTCTAATTTTTAAGAATTGAG-3' (SEQ ID NO: 4497) |
| βc-3376 21 nt Target: | 5'-ATTTTTAAGAATTGAGTAATG-3' (SEQ ID NO: 4498) |
| βc-3411 21 nt Target: | 5'-TTCATAATCACTCTAATTAAT-3' (SEQ ID NO: 4499) |
| βc-3426 21 nt Target: | 5'-ATTAATTGTAATCTGAATAAA-3' (SEQ ID NO: 4500) |
| βc-3431 21 nt Target: | 5'-TTGTAATCTGAATAAAGTGTA-3' (SEQ ID NO: 4501) |
| βc-3437 21 nt Target: | 5'-TCTGAATAAAGTGTAACAATT-3' (SEQ ID NO: 4502) |
| βc-3458 21 nt Target: | 5'-GTGTAGCCTTTTGTATAAAA-3' (SEQ ID NO: 4503) |
| βc-3468 21 nt Target: | 5'-TTTGTATAAAATAGACAAATA-3' (SEQ ID NO: 4504) |
| βc-3488 21 nt Target: | 5'-AGAAAATGGTCCAATTAGTTT-3' (SEQ ID NO: 4505) |
| βc-3496 21 nt Target: | 5'-GTCCAATTAGTTTCCTTTTA-3' (SEQ ID NO: 4506) |
| βc-3552 21 nt Target: | 5'-TTTTTGATCAAAAACTATTTG-3' (SEQ ID NO: 4507) |
| βc-3600 21 nt Target: | 5'-AAGAGGTGTTATTTGGAACCT-3' (SEQ ID NO: 4508) |
| βc-3605 21 nt Target: | 5'-GTGTTATTTGGAACCTTGTTT-3' (SEQ ID NO: 4509) |
| βc-3615 21 nt Target: | 5'-GAACCTTGTTTTGGACAGTTT-3' (SEQ ID NO: 4510) |

TABLE 5-continued

| 21 Nucleotide Target Sequences of Selected DsiRNAs | | |
|---|---|---|
| βc-3674 21 nt Target: | 5'-GTGATACGATGCTTCAAGAGA-3' | (SEQ ID NO: 4511) |
| βc-3686 21 nt Target: | 5'-TTCAAGAGAAAATGCGGTTAT-3' | (SEQ ID NO: 4512) |
| βc-3691 21 nt Target: | 5'-GAGAAAATGCGGTTATAAAAA-3' | (SEQ ID NO: 4513) |
| βc-3700 21 nt Target: | 5'-CGGTTATAAAAAATGGTTCAG-3' | (SEQ ID NO: 4514) |
| βc-3707 21 nt Target: | 5'-AAAAAATGGTTCAGAATTAAA-3' | (SEQ ID NO: 4515) |
| βc-284 21 nt Target: | 5'-CAGCGTGGACAATGGCTACTC-3' | (SEQ ID NO: 4516) |
| βc-285 21 nt Target: | 5'-AGCGTGGACAATGGCTACTCA-3' | (SEQ ID NO: 4517) |
| βc-286 21 nt Target: | 5'-GCGTGGACAATGGCTACTCAA-3' | (SEQ ID NO: 4518) |
| βc-287 21 nt Target: | 5'-CGTGGACAATGGCTACTCAAG-3' | (SEQ ID NO: 4519) |
| βc-288 21 nt Target: | 5'-GTGGACAATGGCTACTCAAGC-3' | (SEQ ID NO: 4520) |
| βc-289 21 nt Target: | 5'-TGGACAATGGCTACTCAAGCT-3' | (SEQ ID NO: 4521) |
| βc-290 21 nt Target: | 5'-GGACAATGGCTACTCAAGCTG-3' | (SEQ ID NO: 4522) |
| βc-291 21 nt Target: | 5'-GACAATGGCTACTCAAGCTGA-3' | (SEQ ID NO: 4523) |
| βc-312 21 nt Target: | 5'-TTTGATGGAGTTGGACATGGC-3' | (SEQ ID NO: 4524) |
| βc-313 21 nt Target: | 5'-TTGATGGAGTTGGACATGGCC-3' | (SEQ ID NO: 4525) |
| βc-314 21 nt Target: | 5'-TGATGGAGTTGGACATGGCCA-3' | (SEQ ID NO: 4526) |
| βc-315 21 nt Target: | 5'-GATGGAGTTGGACATGGCCAT-3' | (SEQ ID NO: 4527) |
| βc-316 21 nt Target: | 5'-ATGGAGTTGGACATGGCCATG-3' | (SEQ ID NO: 4528) |
| βc-317 21 nt Target: | 5'-TGGAGTTGGACATGGCCATGG-3' | (SEQ ID NO: 4529) |
| βc-318 21 nt Target: | 5'-GGAGTTGGACATGGCCATGGA-3' | (SEQ ID NO: 4530) |
| βc-389 21 nt Target: | 5'-ACTCTGGAATCCATTCTGGTG-3' | (SEQ ID NO: 4531) |
| βc-390 21 nt Target: | 5'-CTCTGGAATCCATTCTGGTGC-3' | (SEQ ID NO: 4532) |
| βc-391 21 nt Target: | 5'-TCTGGAATCCATTCTGGTGCC-3' | (SEQ ID NO: 4533) |
| βc-392 21 nt Target: | 5'-CTGGAATCCATTCTGGTGCCA-3' | (SEQ ID NO: 4534) |
| βc-393 21 nt Target: | 5'-TGGAATCCATTCTGGTGCCAC-3' | (SEQ ID NO: 4535) |
| βc-600 21 nt Target: | 5'-ATTAGATGAGGGCATGCAGAT-3' | (SEQ ID NO: 4536) |
| βc-601 21 nt Target: | 5'-TTAGATGAGGGCATGCAGATC-3' | (SEQ ID NO: 4537) |
| βc-602 21 nt Target: | 5'-TAGATGAGGGCATGCAGATCC-3' | (SEQ ID NO: 4538) |
| βc-603 21 nt Target: | 5'-AGATGAGGGCATGCAGATCCC-3' | (SEQ ID NO: 4539) |
| βc-604 21 nt Target: | 5'-GATGAGGGCATGCAGATCCCA-3' | (SEQ ID NO: 4540) |
| βc-605 21 nt Target: | 5'-ATGAGGGCATGCAGATCCCAT-3' | (SEQ ID NO: 4541) |
| βc-638 21 nt Target: | 5'-ATGCTGCTCATCCCACTAATG-3' | (SEQ ID NO: 4542) |
| βc-639 21 nt Target: | 5'-TGCTGCTCATCCCACTAATGT-3' | (SEQ ID NO: 4543) |
| βc-640 21 nt Target: | 5'-GCTGCTCATCCCACTAATGTC-3' | (SEQ ID NO: 4544) |
| βc-641 21 nt Target: | 5'-CTGCTCATCCCACTAATGTCC-3' | (SEQ ID NO: 4545) |
| βc-642 21 nt Target: | 5'-TGCTCATCCCACTAATGTCCA-3' | (SEQ ID NO: 4546) |
| βc-643 21 nt Target: | 5'-GCTCATCCCACTAATGTCCAG-3' | (SEQ ID NO: 4547) |
| βc-644 21 nt Target: | 5'-CTCATCCCACTAATGTCCAGC-3' | (SEQ ID NO: 4548) |
| βc-645 21 nt Target: | 5'-TCATCCCACTAATGTCCAGCG-3' | (SEQ ID NO: 4549) |

TABLE 5-continued

21 Nucleotide Target Sequences of Selected DsiRNAs

| | | |
|---|---|---|
| βc-665 21 nt Target: | 5'-GTTTGGCTGAACCATCACAGA-3' | (SEQ ID NO: 4550) |
| βc-666 21 nt Target: | 5'-TTTGGCTGAACCATCACAGAT-3' | (SEQ ID NO: 4551) |
| βc-667 21 nt Target: | 5'-TTGGCTGAACCATCACAGATG-3' | (SEQ ID NO: 4552) |
| βc-731 21 nt Target: | 5'-CAGAACTTGCCACACGTGCAA-3' | (SEQ ID NO: 4553) |
| βc-732 21 nt Target: | 5'-AGAACTTGCCACACGTGCAAT-3' | (SEQ ID NO: 4554) |
| βc-809 21 nt Target: | 5'-CAGTTATGGTCCATCAGCTTT-3' | (SEQ ID NO: 4555) |
| βc-810 21 nt Target: | 5'-AGTTATGGTCCATCAGCTTTC-3' | (SEQ ID NO: 4556) |
| βc-830 21 nt Target: | 5'-CTAAAAGGAAGCTTCCAGAC-3' | (SEQ ID NO: 4557) |
| βc-831 21 nt Target: | 5'-TAAAAGGAAGCTTCCAGACA-3' | (SEQ ID NO: 4558) |
| βc-893 21 nt Target: | 5'-GTACCATGCAGAATACAAATG-3' | (SEQ ID NO: 4559) |
| βc-894 21 nt Target: | 5'-TACCATGCAGAATACAAATGA-3' | (SEQ ID NO: 4560) |
| βc-895 21 nt Target: | 5'-ACCATGCAGAATACAAATGAT-3' | (SEQ ID NO: 4561) |
| βc-896 21 nt Target: | 5'-CCATGCAGAATACAAATGATG-3' | (SEQ ID NO: 4562) |
| βc-897 21 nt Target: | 5'-CATGCAGAATACAAATGATGT-3' | (SEQ ID NO: 4563) |
| βc-898 21 nt Target: | 5'-ATGCAGAATACAAATGATGTA-3' | (SEQ ID NO: 4564) |
| βc-899 21 nt Target: | 5'-TGCAGAATACAAATGATGTAG-3' | (SEQ ID NO: 4565) |
| βc-900 21 nt Target: | 5'-GCAGAATACAAATGATGTAGA-3' | (SEQ ID NO: 4566) |
| βc-977 21 nt Target: | 5'-TACTGGCCATCTTTAAGTCTG-3' | (SEQ ID NO: 4567) |
| βc-978 21 nt Target: | 5'-ACTGGCCATCTTTAAGTCTGG-3' | (SEQ ID NO: 4568) |
| βc-1091 21 nt Target: | 5'-AAGAAGGAGCTAAAATGGCAG-3' | (SEQ ID NO: 4569) |
| βc-1092 21 nt Target: | 5'-AGAAGGAGCTAAAATGGCAGT-3' | (SEQ ID NO: 4570) |
| βc-1093 21 nt Target: | 5'-GAAGGAGCTAAAATGGCAGTG-3' | (SEQ ID NO: 4571) |
| βc-1094 21 nt Target: | 5'-AAGGAGCTAAAATGGCAGTGC-3' | (SEQ ID NO: 4572) |
| βc-1095 21 nt Target: | 5'-AGGAGCTAAAATGGCAGTGCG-3' | (SEQ ID NO: 4573) |
| βc-1301 21 nt Target: | 5'-TACTGTGGACCACAAGCAGAG-3' | (SEQ ID NO: 4574) |
| βc-1302 21 nt Target: | 5'-ACTGTGGACCACAAGCAGAGT-3' | (SEQ ID NO: 4575) |
| βc-1303 21 nt Target: | 5'-CTGTGGACCACAAGCAGAGTG-3' | (SEQ ID NO: 4576) |
| βc-1304 21 nt Target: | 5'-TGTGGACCACAAGCAGAGTGC-3' | (SEQ ID NO: 4577) |
| βc-1305 21 nt Target: | 5'-GTGGACCACAAGCAGAGTGCT-3' | (SEQ ID NO: 4578) |
| βc-1306 21 nt Target: | 5'-TGGACCACAAGCAGAGTGCTG-3' | (SEQ ID NO: 4579) |
| βc-1307 21 nt Target: | 5'-GGACCACAAGCAGAGTGCTGA-3' | (SEQ ID NO: 4580) |
| βc-1308 21 nt Target: | 5'-GACCACAAGCAGAGTGCTGAA-3' | (SEQ ID NO: 4581) |
| βc-1309 21 nt Target: | 5'-ACCACAAGCAGAGTGCTGAAG-3' | (SEQ ID NO: 4582) |
| βc-1310 21 nt Target: | 5'-CCACAAGCAGAGTGCTGAAGG-3' | (SEQ ID NO: 4583) |
| βc-1311 21 nt Target: | 5'-CACAAGCAGAGTGCTGAAGGT-3' | (SEQ ID NO: 4584) |
| βc-1312 21 nt Target: | 5'-ACAAGCAGAGTGCTGAAGGTG-3' | (SEQ ID NO: 4585) |
| βc-1313 21 nt Target: | 5'-CAAGCAGAGTGCTGAAGGTGC-3' | (SEQ ID NO: 4586) |
| βc-1314 21 nt Target: | 5'-AAGCAGAGTGCTGAAGGTGCT-3' | (SEQ ID NO: 4587) |
| βc-1430 21 nt Target: | 5'-AGAACTGTCTTTGGACTCTCA-3' | (SEQ ID NO: 4588) |

TABLE 5-continued

| 21 Nucleotide Target Sequences of Selected DsiRNAs |
|---|

βc-1431 21 nt Target:    5'-GAACTGTCTTTGGACTCTCAG-3'    (SEQ ID NO: 4589)

βc-1526 21 nt Target:    5'-CAGATGATATAAATGTGGTCA-3'    (SEQ ID NO: 4590)

βc-1527 21 nt Target:    5'-AGATGATATAAATGTGGTCAC-3'    (SEQ ID NO: 4591)

βc-1528 21 nt Target:    5'-GATGATATAAATGTGGTCACC-3'    (SEQ ID NO: 4592)

βc-1529 21 nt Target:    5'-ATGATATAAATGTGGTCACCT-3'    (SEQ ID NO: 4593)

βc-1530 21 nt Target:    5'-TGATATAAATGTGGTCACCTG-3'    (SEQ ID NO: 4594)

βc-1531 21 nt Target:    5'-GATATAAATGTGGTCACCTGT-3'    (SEQ ID NO: 4595)

βc-1532 21 nt Target:    5'-ATATAAATGTGGTCACCTGTG-3'    (SEQ ID NO: 4596)

βc-1533 21 nt Target:    5'-TATAAATGTGGTCACCTGTGC-3'    (SEQ ID NO: 4597)

βc-1534 21 nt Target:    5'-ATAAATGTGGTCACCTGTGCA-3'    (SEQ ID NO: 4598)

βc-1535 21 nt Target:    5'-TAAATGTGGTCACCTGTGCAG-3'    (SEQ ID NO: 4599)

βc-1536 21 nt Target:    5'-AAATGTGGTCACCTGTGCAGC-3'    (SEQ ID NO: 4600)

βc-1537 21 nt Target:    5'-AATGTGGTCACCTGTGCAGCT-3'    (SEQ ID NO: 4601)

βc-1538 21 nt Target:    5'-ATGTGGTCACCTGTGCAGCTG-3'    (SEQ ID NO: 4602)

βc-1539 21 nt Target:    5'-TGTGGTCACCTGTGCAGCTGG-3'    (SEQ ID NO: 4603)

βc-1540 21 nt Target:    5'-GTGGTCACCTGTGCAGCTGGA-3'    (SEQ ID NO: 4604)

βc-1541 21 nt Target:    5'-TGGTCACCTGTGCAGCTGGAA-3'    (SEQ ID NO: 4605)

βc-1542 21 nt Target:    5'-GGTCACCTGTGCAGCTGGAAT-3'    (SEQ ID NO: 4606)

βc-1543 21 nt Target:    5'-GTCACCTGTGCAGCTGGAATT-3'    (SEQ ID NO: 4607)

βc-1544 21 nt Target:    5'-TCACCTGTGCAGCTGGAATTC-3'    (SEQ ID NO: 4608)

βc-1545 21 nt Target:    5'-CACCTGTGCAGCTGGAATTCT-3'    (SEQ ID NO: 4609)

βc-1565 21 nt Target:    5'-TTTCTAACCTCACTTGCAATA-3'    (SEQ ID NO: 4610)

βc-1566 21 nt Target:    5'-TTCTAACCTCACTTGCAATAA-3'    (SEQ ID NO: 4611)

βc-1567 21 nt Target:    5'-TCTAACCTCACTTGCAATAAT-3'    (SEQ ID NO: 4612)

βc-1568 21 nt Target:    5'-CTAACCTCACTTGCAATAATT-3'    (SEQ ID NO: 4613)

βc-1569 21 nt Target:    5'-TAACCTCACTTGCAATAATTA-3'    (SEQ ID NO: 4614)

βc-1652 21 nt Target:    5'-GGGCTGGTGACAGGGAAGACA-3'    (SEQ ID NO: 4615)

βc-1653 21 nt Target:    5'-GGCTGGTGACAGGGAAGACAT-3'    (SEQ ID NO: 4616)

βc-1654 21 nt Target:    5'-GCTGGTGACAGGGAAGACATC-3'    (SEQ ID NO: 4617)

βc-1655 21 nt Target:    5'-CTGGTGACAGGGAAGACATCA-3'    (SEQ ID NO: 4618)

βc-1656 21 nt Target:    5'-TGGTGACAGGGAAGACATCAC-3'    (SEQ ID NO: 4619)

βc-1657 21 nt Target:    5'-GGTGACAGGGAAGACATCACT-3'    (SEQ ID NO: 4620)

βc-1658 21 nt Target:    5'-GTGACAGGGAAGACATCACTG-3'    (SEQ ID NO: 4621)

βc-1659 21 nt Target:    5'-TGACAGGGAAGACATCACTGA-3'    (SEQ ID NO: 4622)

βc-1660 21 nt Target:    5'-GACAGGGAAGACATCACTGAG-3'    (SEQ ID NO: 4623)

βc-1661 21 nt Target:    5'-ACAGGGAAGACATCACTGAGC-3'    (SEQ ID NO: 4624)

βc-1662 21 nt Target:    5'-CAGGGAAGACATCACTGAGCC-3'    (SEQ ID NO: 4625)

βc-1663 21 nt Target:    5'-AGGGAAGACATCACTGAGCCT-3'    (SEQ ID NO: 4626)

βc-1664 21 nt Target:    5'-GGGAAGACATCACTGAGCCTG-3'    (SEQ ID NO: 4627)

TABLE 5-continued

21 Nucleotide Target Sequences of Selected DsiRNAs

| | | |
|---|---|---|
| βc-1665 21 nt Target: | 5'-GGAAGACATCACTGAGCCTGC-3' | (SEQ ID NO: 4628) |
| βc-1666 21 nt Target: | 5'-GAAGACATCACTGAGCCTGCC-3' | (SEQ ID NO: 4629) |
| βc-1667 21 nt Target: | 5'-AAGACATCACTGAGCCTGCCA-3' | (SEQ ID NO: 4630) |
| βc-1668 21 nt Target: | 5'-AGACATCACTGAGCCTGCCAT-3' | (SEQ ID NO: 4631) |
| βc-1669 21 nt Target: | 5'-GACATCACTGAGCCTGCCATC-3' | (SEQ ID NO: 4632) |
| βc-1670 21 nt Target: | 5'-ACATCACTGAGCCTGCCATCT-3' | (SEQ ID NO: 4633) |
| βc-1671 21 nt Target: | 5'-CATCACTGAGCCTGCCATCTG-3' | (SEQ ID NO: 4634) |
| βc-1672 21 nt Target: | 5'-ATCACTGAGCCTGCCATCTGT-3' | (SEQ ID NO: 4635) |
| βc-1673 21 nt Target: | 5'-TCACTGAGCCTGCCATCTGTG-3' | (SEQ ID NO: 4636) |
| βc-1674 21 nt Target: | 5'-CACTGAGCCTGCCATCTGTGC-3' | (SEQ ID NO: 4637) |
| βc-1675 21 nt Target: | 5'-ACTGAGCCTGCCATCTGTGCT-3' | (SEQ ID NO: 4638) |
| βc-1676 21 nt Target: | 5'-CTGAGCCTGCCATCTGTGCTC-3' | (SEQ ID NO: 4639) |
| βc-1677 21 nt Target: | 5'-TGAGCCTGCCATCTGTGCTCT-3' | (SEQ ID NO: 4640) |
| βc-1678 21 nt Target: | 5'-GAGCCTGCCATCTGTGCTCTT-3' | (SEQ ID NO: 4641) |
| βc-1679 21 nt Target: | 5'-AGCCTGCCATCTGTGCTCTTC-3' | (SEQ ID NO: 4642) |
| βc-1680 21 nt Target: | 5'-GCCTGCCATCTGTGCTCTTCG-3' | (SEQ ID NO: 4643) |
| βc-1681 21 nt Target: | 5'-CCTGCCATCTGTGCTCTTCGT-3' | (SEQ ID NO: 4644) |
| βc-1682 21 nt Target: | 5'-CTGCCATCTGTGCTCTTCGTC-3' | (SEQ ID NO: 4645) |
| βc-1683 21 nt Target: | 5'-TGCCATCTGTGCTCTTCGTCA-3' | (SEQ ID NO: 4646) |
| βc-1684 21 nt Target: | 5'-GCCATCTGTGCTCTTCGTCAT-3' | (SEQ ID NO: 4647) |
| βc-1685 21 nt Target: | 5'-CCATCTGTGCTCTTCGTCATC-3' | (SEQ ID NO: 4648) |
| βc-1686 21 nt Target: | 5'-CATCTGTGCTCTTCGTCATCT-3' | (SEQ ID NO: 4649) |
| βc-1687 21 nt Target: | 5'-ATCTGTGCTCTTCGTCATCTG-3' | (SEQ ID NO: 4650) |
| βc-1688 21 nt Target: | 5'-TCTGTGCTCTTCGTCATCTGA-3' | (SEQ ID NO: 4651) |
| βc-1689 21 nt Target: | 5'-CTGTGCTCTTCGTCATCTGAC-3' | (SEQ ID NO: 4652) |
| βc-1690 21 nt Target: | 5'-TGTGCTCTTCGTCATCTGACC-3' | (SEQ ID NO: 4653) |
| βc-1691 21 nt Target: | 5'-GTGCTCTTCGTCATCTGACCA-3' | (SEQ ID NO: 4654) |
| βc-1692 21 nt Target: | 5'-TGCTCTTCGTCATCTGACCAG-3' | (SEQ ID NO: 4655) |
| βc-1693 21 nt Target: | 5'-GCTCTTCGTCATCTGACCAGC-3' | (SEQ ID NO: 4656) |
| βc-1694 21 nt Target: | 5'-CTCTTCGTCATCTGACCAGCC-3' | (SEQ ID NO: 4657) |
| βc-1695 21 nt Target: | 5'-TCTTCGTCATCTGACCAGCCG-3' | (SEQ ID NO: 4658) |
| βc-1787 21 nt Target: | 5'-TACACCCACCATCCCACTGGC-3' | (SEQ ID NO: 4659) |
| βc-1788 21 nt Target: | 5'-ACACCCACCATCCCACTGGCC-3' | (SEQ ID NO: 4660) |
| βc-1789 21 nt Target: | 5'-CACCCACCATCCCACTGGCCT-3' | (SEQ ID NO: 4661) |
| βc-1790 21 nt Target: | 5'-ACCCACCATCCCACTGGCCTC-3' | (SEQ ID NO: 4662) |
| βc-1791 21 nt Target: | 5'-CCCACCATCCCACTGGCCTCT-3' | (SEQ ID NO: 4663) |
| βc-1792 21 nt Target: | 5'-CCACCATCCCACTGGCCTCTG-3' | (SEQ ID NO: 4664) |
| βc-1793 21 nt Target: | 5'-CACCATCCCACTGGCCTCTGA-3' | (SEQ ID NO: 4665) |
| βc-1794 21 nt Target: | 5'-ACCATCCCACTGGCCTCTGAT-3' | (SEQ ID NO: 4666) |

TABLE 5-continued

21 Nucleotide Target Sequences of Selected DsiRNAs

| βc-1795 21 nt Target: | 5'-CCATCCCACTGGCCTCTGATA-3' (SEQ ID NO: 4667) |
| βc-1796 21 nt Target: | 5'-CATCCCACTGGCCTCTGATAA-3' (SEQ ID NO: 4668) |
| βc-1797 21 nt Target: | 5'-ATCCCACTGGCCTCTGATAAA-3' (SEQ ID NO: 4669) |
| βc-1798 21 nt Target: | 5'-TCCCACTGGCCTCTGATAAAG-3' (SEQ ID NO: 4670) |
| βc-1799 21 nt Target: | 5'-CCCACTGGCCTCTGATAAAGG-3' (SEQ ID NO: 4671) |
| βc-1800 21 nt Target: | 5'-CCACTGGCCTCTGATAAAGGC-3' (SEQ ID NO: 4672) |
| βc-1820 21 nt Target: | 5'-CTACTGTTGGATTGATTCGAA-3' (SEQ ID NO: 4673) |
| βc-1821 21 nt Target: | 5'-TACTGTTGGATTGATTCGAAA-3' (SEQ ID NO: 4674) |
| βc-2072 21 nt Target: | 5'-TAAATACCATTCCATTGTTTG-3' (SEQ ID NO: 4675) |
| βc-2073 21 nt Target: | 5'-AAATACCATTCCATTGTTTGT-3' (SEQ ID NO: 4676) |
| βc-2074 21 nt Target: | 5'-AATACCATTCCATTGTTTGTG-3' (SEQ ID NO: 4677) |
| βc-2075 21 nt Target: | 5'-ATACCATTCCATTGTTTGTGC-3' (SEQ ID NO: 4678) |
| βc-2076 21 nt Target: | 5'-TACCATTCCATTGTTTGTGCA-3' (SEQ ID NO: 4679) |
| βc-2077 21 nt Target: | 5'-ACCATTCCATTGTTTGTGCAG-3' (SEQ ID NO: 4680) |
| βc-2097 21 nt Target: | 5'-GCTGCTTTATTCTCCCATTGA-3' (SEQ ID NO: 4681) |
| βc-2098 21 nt Target: | 5'-CTGCTTTATTCTCCCATTGAA-3' (SEQ ID NO: 4682) |
| βc-2099 21 nt Target: | 5'-TGCTTTATTCTCCCATTGAAA-3' (SEQ ID NO: 4683) |
| βc-2100 21 nt Target: | 5'-GCTTTATTCTCCCATTGAAAA-3' (SEQ ID NO: 4684) |
| βc-2141 21 nt Target: | 5'-GGGTCCTCTGTGAACTTGCTC-3' (SEQ ID NO: 4685) |
| βc-2142 21 nt Target: | 5'-GGTCCTCTGTGAACTTGCTCA-3' (SEQ ID NO: 4686) |
| βc-2143 21 nt Target: | 5'-GTCCTCTGTGAACTTGCTCAG-3' (SEQ ID NO: 4687) |
| βc-2144 21 nt Target: | 5'-TCCTCTGTGAACTTGCTCAGG-3' (SEQ ID NO: 4688) |
| βc-2145 21 nt Target: | 5'-CCTCTGTGAACTTGCTCAGGA-3' (SEQ ID NO: 4689) |
| βc-2146 21 nt Target: | 5'-CTCTGTGAACTTGCTCAGGAC-3' (SEQ ID NO: 4690) |
| βc-2147 21 nt Target: | 5'-TCTGTGAACTTGCTCAGGACA-3' (SEQ ID NO: 4691) |
| βc-2148 21 nt Target: | 5'-CTGTGAACTTGCTCAGGACAA-3' (SEQ ID NO: 4692) |
| βc-2149 21 nt Target: | 5'-TGTGAACTTGCTCAGGACAAG-3' (SEQ ID NO: 4693) |
| βc-2150 21 nt Target: | 5'-GTGAACTTGCTCAGGACAAGG-3' (SEQ ID NO: 4694) |
| βc-2151 21 nt Target: | 5'-TGAACTTGCTCAGGACAAGGA-3' (SEQ ID NO: 4695) |
| βc-2183 21 nt Target: | 5'-CTATTGAAGCTGAGGGAGCCA-3' (SEQ ID NO: 4696) |
| βc-2184 21 nt Target: | 5'-TATTGAAGCTGAGGGAGCCAC-3' (SEQ ID NO: 4697) |
| βc-2185 21 nt Target: | 5'-ATTGAAGCTGAGGGAGCCACA-3' (SEQ ID NO: 4698) |
| βc-2270 21 nt Target: | 5'-TGTTCCGAATGTCTGAGGACA-3' (SEQ ID NO: 4699) |
| βc-2271 21 nt Target: | 5'-GTTCCGAATGTCTGAGGACAA-3' (SEQ ID NO: 4700) |
| βc-2272 21 nt Target: | 5'-TTCCGAATGTCTGAGGACAAG-3' (SEQ ID NO: 4701) |
| βc-2273 21 nt Target: | 5'-TCCGAATGTCTGAGGACAAGC-3' (SEQ ID NO: 4702) |
| βc-2274 21 nt Target: | 5'-CCGAATGTCTGAGGACAAGCC-3' (SEQ ID NO: 4703) |
| βc-2275 21 nt Target: | 5'-CGAATGTCTGAGGACAAGCCA-3' (SEQ ID NO: 4704) |
| βc-2276 21 nt Target: | 5'-GAATGTCTGAGGACAAGCCAC-3' (SEQ ID NO: 4705) |

TABLE 5-continued

21 Nucleotide Target Sequences of Selected DsiRNAs

| | | |
|---|---|---|
| βc-2277 21 nt Target: | 5'-AATGTCTGAGGACAAGCCACA-3' | (SEQ ID NO: 4706) |
| βc-2345 21 nt Target: | 5'-GAACAGAGCCAATGGCTTGGA-3' | (SEQ ID NO: 4707) |
| βc-2346 21 nt Target: | 5'-AACAGAGCCAATGGCTTGGAA-3' | (SEQ ID NO: 4708) |
| βc-2347 21 nt Target: | 5'-ACAGAGCCAATGGCTTGGAAT-3' | (SEQ ID NO: 4709) |
| βc-2348 21 nt Target: | 5'-CAGAGCCAATGGCTTGGAATG-3' | (SEQ ID NO: 4710) |
| βc-2349 21 nt Target: | 5'-AGAGCCAATGGCTTGGAATGA-3' | (SEQ ID NO: 4711) |
| βc-2350 21 nt Target: | 5'-GAGCCAATGGCTTGGAATGAG-3' | (SEQ ID NO: 4712) |
| βc-2351 21 nt Target: | 5'-AGCCAATGGCTTGGAATGAGA-3' | (SEQ ID NO: 4713) |
| βc-2352 21 nt Target: | 5'-GCCAATGGCTTGGAATGAGAC-3' | (SEQ ID NO: 4714) |
| βc-2353 21 nt Target: | 5'-CCAATGGCTTGGAATGAGACT-3' | (SEQ ID NO: 4715) |
| βc-2354 21 nt Target: | 5'-CAATGGCTTGGAATGAGACTG-3' | (SEQ ID NO: 4716) |
| βc-2355 21 nt Target: | 5'-AATGGCTTGGAATGAGACTGC-3' | (SEQ ID NO: 4717) |
| βc-2411 21 nt Target: | 5'-CCCTTGGATATCGCCAGGATG-3' | (SEQ ID NO: 4718) |
| βc-2412 21 nt Target: | 5'-CCTTGGATATCGCCAGGATGA-3' | (SEQ ID NO: 4719) |
| βc-2413 21 nt Target: | 5'-CTTGGATATCGCCAGGATGAT-3' | (SEQ ID NO: 4720) |
| βc-2414 21 nt Target: | 5'-TTGGATATCGCCAGGATGATC-3' | (SEQ ID NO: 4721) |
| βc-2415 21 nt Target: | 5'-TGGATATCGCCAGGATGATCC-3' | (SEQ ID NO: 4722) |
| βc-2441 21 nt Target: | 5'-ATCGTTCTTTTCACTCTGGTG-3' | (SEQ ID NO: 4723) |
| βc-2442 21 nt Target: | 5'-TCGTTCTTTTCACTCTGGTGG-3' | (SEQ ID NO: 4724) |
| βc-2443 21 nt Target: | 5'-CGTTCTTTTCACTCTGGTGGA-3' | (SEQ ID NO: 4725) |
| βc-2444 21 nt Target: | 5'-GTTCTTTTCACTCTGGTGGAT-3' | (SEQ ID NO: 4726) |
| βc-2445 21 nt Target: | 5'-TTCTTTTCACTCTGGTGGATA-3' | (SEQ ID NO: 4727) |
| βc-2501 21 nt Target: | 5'-AACATGAGATGGGTGGCCACC-3' | (SEQ ID NO: 4728) |
| βc-2502 21 nt Target: | 5'-ACATGAGATGGGTGGCCACCA-3' | (SEQ ID NO: 4729) |
| βc-2503 21 nt Target: | 5'-CATGAGATGGGTGGCCACCAC-3' | (SEQ ID NO: 4730) |
| βc-2504 21 nt Target: | 5'-ATGAGATGGGTGGCCACCACC-3' | (SEQ ID NO: 4731) |
| βc-2505 21 nt Target: | 5'-TGAGATGGGTGGCCACCACCC-3' | (SEQ ID NO: 4732) |
| βc-2506 21 nt Target: | 5'-GAGATGGGTGGCCACCACCCT-3' | (SEQ ID NO: 4733) |
| βc-2507 21 nt Target: | 5'-AGATGGGTGGCCACCACCCTG-3' | (SEQ ID NO: 4734) |
| βc-2508 21 nt Target: | 5'-GATGGGTGGCCACCACCCTGG-3' | (SEQ ID NO: 4735) |
| βc-2509 21 nt Target: | 5'-ATGGGTGGCCACCACCCTGGT-3' | (SEQ ID NO: 4736) |
| βc-2510 21 nt Target: | 5'-TGGGTGGCCACCACCCTGGTG-3' | (SEQ ID NO: 4737) |
| βc-2511 21 nt Target: | 5'-GGGTGGCCACCACCCTGGTGC-3' | (SEQ ID NO: 4738) |
| βc-2512 21 nt Target: | 5'-GGTGGCCACCACCCTGGTGCT-3' | (SEQ ID NO: 4739) |
| βc-2513 21 nt Target: | 5'-GTGGCCACCACCCTGGTGCTG-3' | (SEQ ID NO: 4740) |
| βc-2514 21 nt Target: | 5'-TGGCCACCACCCTGGTGCTGA-3' | (SEQ ID NO: 4741) |
| βc-2515 21 nt Target: | 5'-GGCCACCACCCTGGTGCTGAC-3' | (SEQ ID NO: 4742) |
| βc-2516 21 nt Target: | 5'-GCCACCACCCTGGTGCTGACT-3' | (SEQ ID NO: 4743) |
| βc-2517 21 nt Target: | 5'-CCACCACCCTGGTGCTGACTA-3' | (SEQ ID NO: 4744) |

TABLE 5-continued

21 Nucleotide Target Sequences of Selected DsiRNAs

| βc-2518 21 nt Target: | 5'-CACCACCCTGGTGCTGACTAT-3' | (SEQ ID NO: 4745) |
| βc-2519 21 nt Target: | 5'-ACCACCCTGGTGCTGACTATC-3' | (SEQ ID NO: 4746) |
| βc-2520 21 nt Target: | 5'-CCACCCTGGTGCTGACTATCC-3' | (SEQ ID NO: 4747) |
| βc-2521 21 nt Target: | 5'-CACCCTGGTGCTGACTATCCA-3' | (SEQ ID NO: 4748) |
| βc-2522 21 nt Target: | 5'-ACCCTGGTGCTGACTATCCAG-3' | (SEQ ID NO: 4749) |
| βc-2523 21 nt Target: | 5'-CCCTGGTGCTGACTATCCAGT-3' | (SEQ ID NO: 4750) |
| βc-2524 21 nt Target: | 5'-CCTGGTGCTGACTATCCAGTT-3' | (SEQ ID NO: 4751) |
| βc-2525 21 nt Target: | 5'-CTGGTGCTGACTATCCAGTTG-3' | (SEQ ID NO: 4752) |
| βc-2526 21 nt Target: | 5'-TGGTGCTGACTATCCAGTTGA-3' | (SEQ ID NO: 4753) |
| βc-2527 21 nt Target: | 5'-GGTGCTGACTATCCAGTTGAT-3' | (SEQ ID NO: 4754) |
| βc-2528 21 nt Target: | 5'-GTGCTGACTATCCAGTTGATG-3' | (SEQ ID NO: 4755) |
| βc-2529 21 nt Target: | 5'-TGCTGACTATCCAGTTGATGG-3' | (SEQ ID NO: 4756) |
| βc-2530 21 nt Target: | 5'-GCTGACTATCCAGTTGATGGG-3' | (SEQ ID NO: 4757) |
| βc-2531 21 nt Target: | 5'-CTGACTATCCAGTTGATGGGC-3' | (SEQ ID NO: 4758) |
| βc-2532 21 nt Target: | 5'-TGACTATCCAGTTGATGGGCT-3' | (SEQ ID NO: 4759) |
| βc-2533 21 nt Target: | 5'-GACTATCCAGTTGATGGGCTG-3' | (SEQ ID NO: 4760) |
| βc-2534 21 nt Target: | 5'-ACTATCCAGTTGATGGGCTGC-3' | (SEQ ID NO: 4761) |
| βc-2535 21 nt Target: | 5'-CTATCCAGTTGATGGGCTGCC-3' | (SEQ ID NO: 4762) |
| βc-2567 21 nt Target: | 5'-ATGCCCAGGACCTCATGGATG-3' | (SEQ ID NO: 4763) |
| βc-2568 21 nt Target: | 5'-TGCCCAGGACCTCATGGATGG-3' | (SEQ ID NO: 4764) |
| βc-2569 21 nt Target: | 5'-GCCCAGGACCTCATGGATGGG-3' | (SEQ ID NO: 4765) |
| βc-2603 21 nt Target: | 5'-ACAGCAATCAGCTGGCCTGGT-3' | (SEQ ID NO: 4766) |
| βc-2604 21 nt Target: | 5'-CAGCAATCAGCTGGCCTGGTT-3' | (SEQ ID NO: 4767) |
| βc-2605 21 nt Target: | 5'-AGCAATCAGCTGGCCTGGTTT-3' | (SEQ ID NO: 4768) |
| βc-2606 21 nt Target: | 5'-GCAATCAGCTGGCCTGGTTTG-3' | (SEQ ID NO: 4769) |
| βc-2607 21 nt Target: | 5'-CAATCAGCTGGCCTGGTTTGA-3' | (SEQ ID NO: 4770) |
| βc-2608 21 nt Target: | 5'-AATCAGCTGGCCTGGTTTGAT-3' | (SEQ ID NO: 4771) |
| βc-2609 21 nt Target: | 5'-ATCAGCTGGCCTGGTTTGATA-3' | (SEQ ID NO: 4772) |
| βc-2610 21 nt Target: | 5'-TCAGCTGGCCTGGTTTGATAC-3' | (SEQ ID NO: 4773) |
| βc-2611 21 nt Target: | 5'-CAGCTGGCCTGGTTTGATACT-3' | (SEQ ID NO: 4774) |
| βc-2612 21 nt Target: | 5'-AGCTGGCCTGGTTTGATACTG-3' | (SEQ ID NO: 4775) |
| βc-2613 21 nt Target: | 5'-GCTGGCCTGGTTTGATACTGA-3' | (SEQ ID NO: 4776) |
| βc-2614 21 nt Target: | 5'-CTGGCCTGGTTTGATACTGAC-3' | (SEQ ID NO: 4777) |
| βc-2615 21 nt Target: | 5'-TGGCCTGGTTTGATACTGACC-3' | (SEQ ID NO: 4778) |
| βc-2616 21 nt Target: | 5'-GGCCTGGTTTGATACTGACCT-3' | (SEQ ID NO: 4779) |
| βc-2617 21 nt Target: | 5'-GCCTGGTTTGATACTGACCTG-3' | (SEQ ID NO: 4780) |
| βc-2618 21 nt Target: | 5'-CCTGGTTTGATACTGACCTGT-3' | (SEQ ID NO: 4781) |
| βc-2619 21 nt Target: | 5'-CTGGTTTGATACTGACCTGTA-3' | (SEQ ID NO: 4782) |
| βc-2620 21 nt Target: | 5'-TGGTTTGATACTGACCTGTAA-3' | (SEQ ID NO: 4783) |

TABLE 5-continued

21 Nucleotide Target Sequences of Selected DsiRNAs

| βc-2621 21 nt Target: | 5'-GGTTTGATACTGACCTGTAAA-3' (SEQ ID NO: 4784) |
| βc-2622 21 nt Target: | 5'-GTTTGATACTGACCTGTAAAT-3' (SEQ ID NO: 4785) |
| βc-2623 21 nt Target: | 5'-TTTGATACTGACCTGTAAATC-3' (SEQ ID NO: 4786) |
| βc-2869 21 nt Target: | 5'-TTTTTTGCCACAGCTTTTGCA-3' (SEQ ID NO: 4787) |
| βc-2902 21 nt Target: | 5'-AATGAGTAACATTTGCTGTTT-3' (SEQ ID NO: 4788) |
| βc-2923 21 nt Target: | 5'-TAAACATTAATAGCAGCCTTT-3' (SEQ ID NO: 4789) |
| βc-2925 21 nt Target: | 5'-AACATTAATAGCAGCCTTTCT-3' (SEQ ID NO: 4790) |
| βc-2927 21 nt Target: | 5'-CATTAATAGCAGCCTTTCTCT-3' (SEQ ID NO: 4791) |
| βc-2929 21 nt Target: | 5'-TTAATAGCAGCCTTTCTCTCT-3' (SEQ ID NO: 4792) |
| βc-2973 21 nt Target: | 5'-TTGCATTGTGATTGGCCTGTA-3' (SEQ ID NO: 4793) |
| βc-2975 21 nt Target: | 5'-GCATTGTGATTGGCCTGTAGA-3' (SEQ ID NO: 4794) |
| βc-2977 21 nt Target: | 5'-ATTGTGATTGGCCTGTAGAGT-3' (SEQ ID NO: 4795) |
| βc-2979 21 nt Target: | 5'-TGTGATTGGCCTGTAGAGTTG-3' (SEQ ID NO: 4796) |
| βc-2981 21 nt Target: | 5'-TGATTGGCCTGTAGAGTTGCT-3' (SEQ ID NO: 4797) |
| βc-2983 21 nt Target: | 5'-ATTGGCCTGTAGAGTTGCTGA-3' (SEQ ID NO: 4798) |
| βc-2985 21 nt Target: | 5'-TGGCCTGTAGAGTTGCTGAGA-3' (SEQ ID NO: 4799) |
| βc-2987 21 nt Target: | 5'-GCCTGTAGAGTTGCTGAGAGG-3' (SEQ ID NO: 4800) |
| βc-2989 21 nt Target: | 5'-CTGTAGAGTTGCTGAGAGGGC-3' (SEQ ID NO: 4801) |
| βc-3015 21 nt Target: | 5'-GGGTGGGCTGGTATCTCAGAA-3' (SEQ ID NO: 4802) |
| βc-3017 21 nt Target: | 5'-GTGGGCTGGTATCTCAGAAAG-3' (SEQ ID NO: 4803) |
| βc-3019 21 nt Target: | 5'-GGGCTGGTATCTCAGAAAGTG-3' (SEQ ID NO: 4804) |
| βc-3021 21 nt Target: | 5'-GCTGGTATCTCAGAAAGTGCC-3' (SEQ ID NO: 4805) |
| βc-3046 21 nt Target: | 5'-ACACTAACCAAGCTGAGTTTC-3' (SEQ ID NO: 4806) |
| βc-3048 21 nt Target: | 5'-ACTAACCAAGCTGAGTTTCCT-3' (SEQ ID NO: 4807) |
| βc-3050 21 nt Target: | 5'-TAACCAAGCTGAGTTTCCTAT-3' (SEQ ID NO: 4808) |
| βc-3052 21 nt Target: | 5'-ACCAAGCTGAGTTTCCTATGG-3' (SEQ ID NO: 4809) |
| βc-3054 21 nt Target: | 5'-CAAGCTGAGTTTCCTATGGGA-3' (SEQ ID NO: 4810) |
| βc-3056 21 nt Target: | 5'-AGCTGAGTTTCCTATGGGAAC-3' (SEQ ID NO: 4811) |
| βc-3087 21 nt Target: | 5'-AACTTTTTGTTCTGGTCCTTT-3' (SEQ ID NO: 4812) |
| βc-3089 21 nt Target: | 5'-CTTTTTGTTCTGGTCCTTTTT-3' (SEQ ID NO: 4813) |
| βc-3091 21 nt Target: | 5'-TTTTGTTCTGGTCCTTTTTGG-3' (SEQ ID NO: 4814) |
| βc-3093 21 nt Target: | 5'-TTGTTCTGGTCCTTTTTGGTC-3' (SEQ ID NO: 4815) |
| βc-3095 21 nt Target: | 5'-GTTCTGGTCCTTTTTGGTCGA-3' (SEQ ID NO: 4816) |
| βc-3097 21 nt Target: | 5'-TCTGGTCCTTTTTGGTCGAGG-3' (SEQ ID NO: 4817) |
| βc-3099 21 nt Target: | 5'-TGGTCCTTTTTGGTCGAGGAG-3' (SEQ ID NO: 4818) |
| βc-3101 21 nt Target: | 5'-GTCCTTTTTGGTCGAGGAGTA-3' (SEQ ID NO: 4819) |
| βc-3103 21 nt Target: | 5'-CCTTTTTGGTCGAGGAGTAAC-3' (SEQ ID NO: 4820) |
| βc-3105 21 nt Target: | 5'-TTTTTGGTCGAGGAGTAACAA-3' (SEQ ID NO: 4821) |
| βc-3107 21 nt Target: | 5'-TTTGGTCGAGGAGTAACAATA-3' (SEQ ID NO: 4822) |

TABLE 5-continued

21 Nucleotide Target Sequences of Selected DsiRNAs

| | | |
|---|---|---|
| βc-3109 21 nt Target: | 5'-TGGTCGAGGAGTAACAATACA-3' | (SEQ ID NO: 4823) |
| βc-3111 21 nt Target: | 5'-GTCGAGGAGTAACAATACAAA-3' | (SEQ ID NO: 4824) |
| βc-3113 21 nt Target: | 5'-CGAGGAGTAACAATACAAATG-3' | (SEQ ID NO: 4825) |
| βc-3115 21 nt Target: | 5'-AGGAGTAACAATACAAATGGA-3' | (SEQ ID NO: 4826) |
| βc-3191 21 nt Target: | 5'-TTTATCAAACCCTAGCCTTGC-3' | (SEQ ID NO: 4827) |
| βc-3193 21 nt Target: | 5'-TATCAAACCCTAGCCTTGCTT-3' | (SEQ ID NO: 4828) |
| βc-3195 21 nt Target: | 5'-TCAAACCCTAGCCTTGCTTGT-3' | (SEQ ID NO: 4829) |
| βc-3387 21 nt Target: | 5'-TTGAGTAATGGTGTAGAACAC-3' | (SEQ ID NO: 4830) |
| βc-3389 21 nt Target: | 5'-GAGTAATGGTGTAGAACACTA-3' | (SEQ ID NO: 4831) |
| βc-3391 21 nt Target: | 5'-GTAATGGTGTAGAACACTAAT-3' | (SEQ ID NO: 4832) |
| βc-3393 21 nt Target: | 5'-AATGGTGTAGAACACTAATTC-3' | (SEQ ID NO: 4833) |
| βc-3395 21 nt Target: | 5'-TGGTGTAGAACACTAATTCAT-3' | (SEQ ID NO: 4834) |
| βc-3397 21 nt Target: | 5'-GTGTAGAACACTAATTCATAA-3' | (SEQ ID NO: 4835) |
| βc-3399 21 nt Target: | 5'-GTAGAACACTAATTCATAATC-3' | (SEQ ID NO: 4836) |
| βc-3401 21 nt Target: | 5'-AGAACACTAATTCATAATCAC-3' | (SEQ ID NO: 4837) |
| βc-3500 21 nt Target: | 5'-AATTAGTTTCCTTTTTAATAT-3' | (SEQ ID NO: 4838) |
| βc-3502 21 nt Target: | 5'-TTAGTTTCCTTTTTAATATGC-3' | (SEQ ID NO: 4839) |
| βc-3504 21 nt Target: | 5'-AGTTTCCTTTTTAATATGCTT-3' | (SEQ ID NO: 4840) |
| βc-3506 21 nt Target: | 5'-TTTCCTTTTTAATATGCTTAA-3' | (SEQ ID NO: 4841) |
| βc-3508 21 nt Target: | 5'-TCCTTTTTAATATGCTTAAAA-3' | (SEQ ID NO: 4842) |
| βc-3509 21 nt Target: | 5'-CCTTTTTAATATGCTTAAAAT-3' | (SEQ ID NO: 4843) |
| βc-3510 21 nt Target: | 5'-CTTTTTAATATGCTTAAAATA-3' | (SEQ ID NO: 4844) |
| βc-3512 21 nt Target: | 5'-TTTTAATATGCTTAAAATAAG-3' | (SEQ ID NO: 4845) |
| βc-3514 21 nt Target: | 5'-TTAATATGCTTAAAATAAGCA-3' | (SEQ ID NO: 4846) |
| βc-3516 21 nt Target: | 5'-AATATGCTTAAAATAAGCAGG-3' | (SEQ ID NO: 4847) |
| βc-3518 21 nt Target: | 5'-TATGCTTAAAATAAGCAGGTG-3' | (SEQ ID NO: 4848) |
| βc-3520 21 nt Target: | 5'-TGCTTAAAATAAGCAGGTGGA-3' | (SEQ ID NO: 4849) |
| βc-3522 21 nt Target: | 5'-CTTAAAATAAGCAGGTGGATC-3' | (SEQ ID NO: 4850) |
| βc-3524 21 nt Target: | 5'-TAAAATAAGCAGGTGGATCTA-3' | (SEQ ID NO: 4851) |
| βc-3526 21 nt Target: | 5'-AAATAAGCAGGTGGATCTATT-3' | (SEQ ID NO: 4852) |
| βc-3528 21 nt Target: | 5'-ATAAGCAGGTGGATCTATTTC-3' | (SEQ ID NO: 4853) |
| βc-3530 21 nt Target: | 5'-AAGCAGGTGGATCTATTTCAT-3' | (SEQ ID NO: 4854) |
| βc-3532 21 nt Target: | 5'-GCAGGTGGATCTATTTCATGT-3' | (SEQ ID NO: 4855) |
| βc-3534 21 nt Target: | 5'-AGGTGGATCTATTTCATGTTT-3' | (SEQ ID NO: 4856) |
| βc-3536 21 nt Target: | 5'-GTGGATCTATTTCATGTTTTT-3' | (SEQ ID NO: 4857) |
| βc-3538 21 nt Target: | 5'-GGATCTATTTCATGTTTTTGA-3' | (SEQ ID NO: 4858) |
| βc-3583 21 nt Target: | 5'-GGGTAGGGTAAATCAGTAAGA-3' | (SEQ ID NO: 4859) |
| βc-3585 21 nt Target: | 5'-GTAGGGTAAATCAGTAAGAGG-3' | (SEQ ID NO: 4860) |
| βc-3587 21 nt Target: | 5'-AGGGTAAATCAGTAAGAGGTG-3' | (SEQ ID NO: 4861) |

TABLE 5-continued

21 Nucleotide Target Sequences of Selected DsiRNAs

| βc-3589 21 nt Target: | 5'-GGTAAATCAGTAAGAGGTGTT-3' (SEQ ID NO: 4862) |
| βc-3591 21 nt Target: | 5'-TAAATCAGTAAGAGGTGTTAT-3' (SEQ ID NO: 4863) |
| βc-3593 21 nt Target: | 5'-AATCAGTAAGAGGTGTTATTT-3' (SEQ ID NO: 4864) |
| βc-3633 21 nt Target: | 5'-TTTACCAGTTGCCTTTTATCC-3' (SEQ ID NO: 4865) |
| βc-3635 21 nt Target: | 5'-TACCAGTTGCCTTTTATCCCA-3' (SEQ ID NO: 4866) |
| βc-3637 21 nt Target: | 5'-CCAGTTGCCTTTTATCCCAAA-3' (SEQ ID NO: 4867) |
| βc-3639 21 nt Target: | 5'-AGTTGCCTTTTATCCCAAAGT-3' (SEQ ID NO: 4868) |
| βc-3641 21 nt Target: | 5'-TTGCCTTTTATCCCAAAGTTG-3' (SEQ ID NO: 4869) |
| βc-3643 21 nt Target: | 5'-GCCTTTTATCCCAAAGTTGTT-3' (SEQ ID NO: 4870) |
| βc-3645 21 nt Target: | 5'-CTTTTATCCCAAAGTTGTTGT-3' (SEQ ID NO: 4871) |
| βc-3647 21 nt Target: | 5'-TTTATCCCAAAGTTGTTGTAA-3' (SEQ ID NO: 4872) |
| βc-3649 21 nt Target: | 5'-TATCCCAAAGTTGTTGTAACC-3' (SEQ ID NO: 4873) |
| βc-3651 21 nt Target: | 5'-TCCCAAAGTTGTTGTAACCTG-3' (SEQ ID NO: 4874) |
| βc-3653 21 nt Target: | 5'-CCAAAGTTGTTGTAACCTGCT-3' (SEQ ID NO: 4875) |
| βc-3655 21 nt Target: | 5'-AAAGTTGTTGTAACCTGCTGT-3' (SEQ ID NO: 4876) |
| βc-3657 21 nt Target: | 5'-AGTTGTTGTAACCTGCTGTGA-3' (SEQ ID NO: 4877) |
| βc-3659 21 nt Target: | 5'-TTGTTGTAACCTGCTGTGATA-3' (SEQ ID NO: 4878) |
| βc-3708 21 nt Target: | 5'-AAAAATGGTTCAGAATTAAAC-3' (SEQ ID NO: 4879) |
| βc-3710 21 nt Target: | 5'-AAATGGTTCAGAATTAAACTT-3' (SEQ ID NO: 4880) |
| βc-3712 21 nt Target: | 5'-ATGGTTCAGAATTAAACTTTT-3' (SEQ ID NO: 4881) |
| βc-3714 21 nt Target: | 5'-GGTTCAGAATTAAACTTTTAA-3' (SEQ ID NO: 4882) |
| βc-3716 21 nt Target: | 5'-TTCAGAATTAAACTTTTAATT-3' (SEQ ID NO: 4883) |
| βc-m314 21 nt Target: | 5'-CAGCAGCAGTCTTACTTGGAT-3' (SEQ ID NO: 4884) |
| βc-m325 21 nt Target: | 5'-TTACTTGGATTCTGGAATCCA-3' (SEQ ID NO: 4885) |
| βc-m408 21 nt Target: | 5'-TTGACACCTCCCAAGTCCTTT-3' (SEQ ID NO: 4886) |
| βc-m460 21 nt Target: | 5'-CACGCAAGAGCAAGTAGCTGA-3' (SEQ ID NO: 4887) |
| βc-m526 21 nt Target: | 5'-TGCCATGTTCCCTGAGACGCT-3' (SEQ ID NO: 4888) |
| βc-m631 21 nt Target: | 5'-GTTGAAACATGCAGTTGTCAA-3' (SEQ ID NO: 4889) |
| βc-m636 21 nt Target: | 5'-AACATGCAGTTGTCAATTTGA-3' (SEQ ID NO: 4890) |
| βc-m642 21 nt Target: | 5'-CAGTTGTCAATTTGATTAACT-3' (SEQ ID NO: 4891) |
| βc-m723 21 nt Target: | 5'-ATGAGGACCAGGTGGTAGTTA-3' (SEQ ID NO: 4892) |
| βc-m970 21 nt Target: | 5'-TGGGTCACCAGTGGATTCTGT-3' (SEQ ID NO: 4893) |
| βc-m976 21 nt Target: | 5'-ACCAGTGGATTCTGTACTGTT-3' (SEQ ID NO: 4894) |
| βc-m981 21 nt Target: | 5'-TGGATTCTGTACTGTTCTACG-3' (SEQ ID NO: 4895) |
| βc-m1066 21 nt Target: | 5'-TGGTGGACTGCAGAAAATGGT-3' (SEQ ID NO: 4896) |
| βc-m1106 21 nt Target: | 5'-AACGTGAAATTCTTGGCTATT-3' (SEQ ID NO: 4897) |
| βc-m1354 21 nt Target: | 5'-CCCAAGTCAGCGACTTGTTCA-3' (SEQ ID NO: 4898) |
| βc-m1363 21 nt Target: | 5'-GCGACTTGTTCAAAACTGTCT-3' (SEQ ID NO: 4899) |
| βc-m1373 21 nt Target: | 5'-CAAAACTGTCTTTGGACTCTC-3' (SEQ ID NO: 4900) |

TABLE 5-continued

| 21 Nucleotide Target Sequences of Selected DsiRNAs |
| --- |
| βc-m1508 21 nt Target: 5'-CTCTCTAACCTCACTTGCAAT-3' (SEQ ID NO: 4901) |
| βc-m1515 21 nt Target: 5'-ACCTCACTTGCAATAATTACA-3' (SEQ ID NO: 4902) |
| βc-m1682 21 nt Target: 5'-CAGAATGCCGTTCGCCTTCAT-3' (SEQ ID NO: 4903) |
| βc-m1693 21 nt Target: 5'-TCGCCTTCATTATGGACTGCC-3' (SEQ ID NO: 4904) |
| βc-m1698 21 nt Target: 5'-TTCATTATGGACTGCCTGTTG-3' (SEQ ID NO: 4905) |
| βc-m1705 21 nt Target: 5'-TGGACTGCCTGTTGTGGTTAA-3' (SEQ ID NO: 4906) |
| βc-m1763 21 nt Target: 5'-GCAACTGTTGGATTGATTCGA-3' (SEQ ID NO: 4907) |
| βc-m2008 21 nt Target: 5'-CCGAGGACTCAATACCATTCC-3' (SEQ ID NO: 4908) |
| βc-m2226 21 nt Target: 5'-CTGAGGACAAGCCACAGGATT-3' (SEQ ID NO: 4909) |
| βc-m2427 21 nt Target: 5'-GGATGGACCCTATGATGGAGC-3' (SEQ ID NO: 4910) |
| βc-m2568 21 nt Target: 5'-TTGATACTGACCTGTAAATCG-3' (SEQ ID NO: 4911) |
| βc-m2614 21 nt Target: 5'-AGCCAGTGTGGGTGAATACTT-3' (SEQ ID NO: 4912) |
| βc-m2770 21 nt Target: 5'-TGCCACAGCTTTTGCAGCGTT-3' (SEQ ID NO: 4913) |
| βc-m2777 21 nt Target: 5'-GCTTTTGCAGCGTTATACTCA-3' (SEQ ID NO: 4914) |
| βc-m2784 21 nt Target: 5'-CAGCGTTATACTCAGATGAGT-3' (SEQ ID NO: 4915) |
| βc-m2806 21 nt Target: 5'-ACATTTGCTGTTTTCAACATT-3' (SEQ ID NO: 4916) |
| βc-m2850 21 nt Target: 5'-AGCTGTAGTGTCTGAACGTGC-3' (SEQ ID NO: 4917) |
| βc-m2965 21 nt Target: 5'-GGGAACAGTCGAAGTACGCTT-3' (SEQ ID NO: 4918) |
| βc-m2970 21 nt Target: 5'-CAGTCGAAGTACGCTTTTTGT-3' (SEQ ID NO: 4919) |
| βc-m2976 21 nt Target: 5'-AAGTACGCTTTTTGTTCTGGT-3' (SEQ ID NO: 4920) |
| βc-m3092 21 nt Target: 5'-ACCCTAGCCTTGCTTGTTCTT-3' (SEQ ID NO: 4921) |
| βc-m3097 21 nt Target: 5'-AGCCTTGCTTGTTCTTTGTTT-3' (SEQ ID NO: 4922) |
| βc-m3198 21 nt Target: 5'-TGAACCTGCTACAGCAATTTC-3' (SEQ ID NO: 4923) |
| βc-m3207 21 nt Target: 5'-TACAGCAATTTCTGATTTCTA-3' (SEQ ID NO: 4924) |
| βc-m3433 21 nt Target: 5'-CAGTAAGAGGTGTTATTTGAG-3' (SEQ ID NO: 4925) |
| βc-m3439 21 nt Target: 5'-GAGGTGTTATTTGAGCCTTGT-3' (SEQ ID NO: 4926) |
| βc-m3444 21 nt Target: 5'-GTTATTTGAGCCTTGTTTTGG-3' (SEQ ID NO: 4927) |
| βc-m3449 21 nt Target: 5'-TTGAGCCTTGTTTTGGACAGT-3' (SEQ ID NO: 4928) |
| βc-m3522 21 nt Target: 5'-TTCAACAGATGCGGTTATAGA-3' (SEQ ID NO: 4929) |
| βc-m3533 21 nt Target: 5'-CGGTTATAGAAATGGTTCAGA-3' (SEQ ID NO: 4930) |
| βc-m3538 21 nt Target: 5'-ATAGAAATGGTTCAGAATTAA-3' (SEQ ID NO: 4931) |

TABLE 6

| Selected Anti-β-catenin DsiRNA Agents, Unmodified Duplexes |
| --- |
| 5'-CUGAGGGUAUUUGAAGUAUACCAUA-3' (SEQ ID NO: 3335) |
| 3'-GGGACUCCCAUAAACUUCAUAUGGUAU-5' (SEQ ID NO: 1117) |
| βc-240 Target: 5'-CCCTGAGGGTATTTGAAGTATACCATA-3' (SEQ ID NO: 2226) |

TABLE 6-continued

Selected Anti-β-catenin DsiRNA Agents, Unmodified Duplexes

|              |         |                                            |                    |
|--------------|---------|--------------------------------------------|--------------------|
|              |         | 5'-GGGUAUUUGAAGUAUACCAUACAAC-3'            | (SEQ ID NO: 3336)  |
|              |         | 3'-CUCCCAUAAACUUCAUAUGGUAUGUUG-5'          | (SEQ ID NO: 1118)  |
| βc-244       | Target: | 5'-GAGGGTATTTGAAGTATACCATACAAC-3'          | (SEQ ID NO: 2227)  |
|              |         | 5'-AAGUAUACCAUACAACUGUUUUGAA-3'            | (SEQ ID NO: 3337)  |
|              |         | 3'-ACUUCAUAUGGUAUGUUGACAAAACUU-5'          | (SEQ ID NO: 1119)  |
| βc-253       | Target: | 5'-TGAAGTATACCATACAACTGTTTTGAA-3'          | (SEQ ID NO: 2228)  |
|              |         | 5'-ACCAUACAACUGUUUUGAAAAUCCA-3'            | (SEQ ID NO: 3338)  |
|              |         | 3'-UAUGGUAUGUUGACAAAACUUUUAGGU-5'          | (SEQ ID NO: 1120)  |
| βc-259       | Target: | 5'-ATACCATACAACTGTTTTGAAAATCCA-3'          | (SEQ ID NO: 2229)  |
|              |         | 5'-ACAACUGUUUUGAAAAUCCAGCGUG-3'            | (SEQ ID NO: 3339)  |
|              |         | 3'-UAUGUUGACAAAACUUUUAGGUCGCAC-5'          | (SEQ ID NO: 1121)  |
| βc-264       | Target: | 5'-ATACAACTGTTTTGAAAATCCAGCGTG-3'          | (SEQ ID NO: 2230)  |
|              |         | 5'-GGGAUUUUCUCAGUCCUUCACUCAA-3'            | (SEQ ID NO: 3340)  |
|              |         | 3'-GUCCCUAAAAGAGUCAGGAAGUGAGUU-5'          | (SEQ ID NO: 1122)  |
| βc-496       | Target: | 5'-CAGGGATTTTCTCAGTCCTTCACTCAA-3'          | (SEQ ID NO: 2231)  |
|              |         | 5'-CUCAAGAACAAGUAGCUGAUAUUGA-3'            | (SEQ ID NO: 3341)  |
|              |         | 3'-GUGAGUUCUUGUUCAUCGACUAUAACU-5'          | (SEQ ID NO: 1123)  |
| βc-516       | Target: | 5'-CACTCAAGAACAAGTAGCTGATATTGA-3'          | (SEQ ID NO: 2232)  |
|              |         | 5'-AACAAGUAGCUGAUAUUGAUGGACA-3'            | (SEQ ID NO: 3342)  |
|              |         | 3'-UCUUGUUCAUCGACUAUAACUACCUGU-5'          | (SEQ ID NO: 1124)  |
| βc-522       | Target: | 5'-AGAACAAGTAGCTGATATTGATGGACA-3'          | (SEQ ID NO: 2233)  |
|              |         | 5'-CAAGUAGCUGAUAUUGAUGGACAGU-3'            | (SEQ ID NO: 3343)  |
|              |         | 3'-UUGUUCAUCGACUAUAACUACCUGUCA-5'          | (SEQ ID NO: 1125)  |
| βc-524       | Target: | 5'-AACAAGTAGCTGATATTGATGGACAGT-3'          | (SEQ ID NO: 2234)  |
|              |         | 5'-AUGGACAGUAUGCAAUGACUCGAGC-3'            | (SEQ ID NO: 3344)  |
|              |         | 3'-ACUACCUGUCAUACGUUACUGAGCUCG-5'          | (SEQ ID NO: 1126)  |
| βc-540       | Target: | 5'-TGATGGACAGTATGCAATGACTCGAGC-3'          | (SEQ ID NO: 2235)  |
|              |         | 5'-CUAUGUUCCUGAGACAUUAGAUGA-3'             | (SEQ ID NO: 3345)  |
|              |         | 3'-ACGAUACAAGGGACUCUGUAAUCUACU-5'          | (SEQ ID NO: 1127)  |
| βc-582       | Target: | 5'-TGCTATGTTCCCTGAGACATTAGATGA-3'          | (SEQ ID NO: 2236)  |
|              |         | 5'-CUGAAACAUGCAGUUGUAAACUUGA-3'            | (SEQ ID NO: 3346)  |
|              |         | 3'-ACGACUUUGUACGUCAACAUUUGAACU-5'          | (SEQ ID NO: 1128)  |
| βc-686       | Target: | 5'-TGCTGAAACATGCAGTTGTAAACTTGA-3'          | (SEQ ID NO: 2237)  |
|              |         | 5'-CAUGCAGUUGUAAACUUGAUUAACU-3'            | (SEQ ID NO: 3347)  |
|              |         | 3'-UUGUACGUCAACAUUUGAACUAAUUGA-5'          | (SEQ ID NO: 1129)  |
| βc-692       | Target: | 5'-AACATGCAGTTGTAAACTTGATTAACT-3'          | (SEQ ID NO: 2238)  |
|              |         | 5'-AGUUGUAAACUUGAUUAACUAUCAA-3'            | (SEQ ID NO: 3348)  |
|              |         | 3'-CGUCAACAUUUGAACUAAUUGAUAGUU-5'          | (SEQ ID NO: 1130)  |
| βc-697       | Target: | 5'-GCAGTTGTAAACTTGATTAACTATCAA-3'          | (SEQ ID NO: 2239)  |

TABLE 6-continued

Selected Anti-β-catenin DsiRNA Agents, Unmodified Duplexes

|  |  |  |  |
|---|---|---|---|
|  | 5'-UUGAUUAACUAUCAAGAUGAUGCAG-3' | (SEQ ID NO: 3349) |  |
|  | 3'-UGAACUAAUUGAUAGUUCUACUACGUC-5' | (SEQ ID NO: 1131) |  |
| βc-707 Target: | 5'-ACTTGATTAACTATCAAGATGATGCAG-3' | (SEQ ID NO: 2240) |  |
|  | 5'-CUGAACUGACAAAACUGCUAAAUGA-3' | (SEQ ID NO: 3350) |  |
|  | 3'-GGGACUUGACUGUUUUGACGAUUUACU-5' | (SEQ ID NO: 1132) |  |
| βc-753 Target: | 5'-CCCTGAACTGACAAAACTGCTAAATGA-3' | (SEQ ID NO: 2241) |  |
|  | 5'-AGAUGGUGUCUGCUAUUGUACGUAC-3' | (SEQ ID NO: 3351) |  |
|  | 3'-AGUCUACCACAGACGAUAACAUGCAUG-5' | (SEQ ID NO: 1133) |  |
| βc-870 Target: | 5'-TCAGATGGTGTCTGCTATTGTACGTAC-3' | (SEQ ID NO: 2242) |  |
|  | 5'-ACGUACCAUGCAGAAUACAAAUGAU-3' | (SEQ ID NO: 3352) |  |
|  | 3'-CAUGCAUGGUACGUCUUAUGUUUACUA-5' | (SEQ ID NO: 1134) |  |
| βc-889 Target: | 5'-GTACGTACCATGCAGAATACAAATGAT-3' | (SEQ ID NO: 2243) |  |
|  | 5'-UACAACUCUCCACAACCUUUUAUUA-3' | (SEQ ID NO: 3353) |  |
|  | 3'-UAAUGUUGAGAGGUGUUGGAAAAUAAU-5' | (SEQ ID NO: 1135) |  |
| βc-1060 Target: | 5'-ATTACAACTCTCCACAACCTTTTATTA-3' | (SEQ ID NO: 2244) |  |
|  | 5'-CUCUCCACAACCUUUUAUUACAUCA-3' | (SEQ ID NO: 3354) |  |
|  | 3'-UUGAGAGGUGUUGGAAAAUAAUGUAGU-5' | (SEQ ID NO: 1136) |  |
| βc-1065 Target: | 5'-AACTCTCCACAACCTTTTATTACATCA-3' | (SEQ ID NO: 2245) |  |
|  | 5'-CACAACCUUUUAUUACAUCAAGAAG-3' | (SEQ ID NO: 3355) |  |
|  | 3'-AGGUGUUGGAAAAUAAUGUAGUUCUUC-5' | (SEQ ID NO: 1137) |  |
| βc-1070 Target: | 5'-TCCACAACCTTTTATTACATCAAGAAG-3' | (SEQ ID NO: 2246) |  |
|  | 5'-CUUUUAUUACAUCAAGAAGGAGCUA-3' | (SEQ ID NO: 3356) |  |
|  | 3'-UGGAAAAUAAUGUAGUUCUUCCUCGAU-5' | (SEQ ID NO: 1138) |  |
| βc-1076 Target: | 5'-ACCTTTTATTACATCAAGAAGGAGCTA-3' | (SEQ ID NO: 2247) |  |
|  | 5'-AAAACAAAUGUUAAAUUCUUGGCUA-3' | (SEQ ID NO: 3357) |  |
|  | 3'-UGUUUUGUUUACAAUUUAAGAACCGAU-5' | (SEQ ID NO: 1139) |  |
| βc-1154 Target: | 5'-ACAAAACAAATGTTAAATTCTTGGCTA-3' | (SEQ ID NO: 2248) |  |
|  | 5'-UACGACAGACUGCCUUCAAAUUUUA-3' | (SEQ ID NO: 3358) |  |
|  | 3'-UAAUGCUGUCUGACGGAAGUUUAAAAU-5' | (SEQ ID NO: 1140) |  |
| βc-1180 Target: | 5'-ATTACGACAGACTGCCTTCAAATTTTA-3' | (SEQ ID NO: 2249) |  |
|  | 5'-CAGACUGCCUUCAAAUUUUAGCUUA-3' | (SEQ ID NO: 3359) |  |
|  | 3'-CUGUCUGACGGAAGUUUAAAAUCGAAU-5' | (SEQ ID NO: 1141) |  |
| βc-1185 Target: | 5'-GACAGACTGCCTTCAAATTTTAGCTTA-3' | (SEQ ID NO: 2250) |  |
|  | 5'-CUUUAGUAAAUAUAAUGAGGACCUA-3' | (SEQ ID NO: 3360) |  |
|  | 3'-UCGAAAUCAUUUAUAUUACUCCUGGAU-5' | (SEQ ID NO: 1142) |  |
| βc-1260 Target: | 5'-AGCTTTAGTAAATATAATGAGGACCTA-3' | (SEQ ID NO: 2251) |  |
|  | 5'-AAAACUACUGUGGACCACAAGCAGA-3' | (SEQ ID NO: 3361) |  |
|  | 3'-CUUUUUGAUGACACCUGGUGUUCGUCU-5' | (SEQ ID NO: 1143) |  |
| βc-1294 Target: | 5'-GAAAAACTACTGTGGACCACAAGCAGA-3' | (SEQ ID NO: 2252) |  |

TABLE 6-continued

Selected Anti-β-catenin DsiRNA Agents, Unmodified Duplexes

|  |  |  |  |
|---|---|---|---|
|  | 5'-AGUCAACGUCUUGUUCAGAACUGUC-3' | (SEQ ID NO: 3362) |  |
|  | 3'-GUUCAGUUGCAGAACAAGUCUUGACAG-5' | (SEQ ID NO: 1144) |  |
| βc-1412 Target: | 5'-CAAGTCAACGTCTTGTTCAGAACTGTC-3' | (SEQ ID NO: 2253) |  |
|  | 5'-CGUCUUGUUCAGAACUGUCUUUGGA-3' | (SEQ ID NO: 3363) |  |
|  | 3'-UUGCAGAACAAGUCUUGACAGAAACCU-5' | (SEQ ID NO: 1145) |  |
| βc-1418 Target: | 5'-AACGTCTTGTTCAGAACTGTCTTTGGA-3' | (SEQ ID NO: 2254) |  |
|  | 5'-UGUUCAGAACUGUCUUUGGACUCUC-3' | (SEQ ID NO: 3364) |  |
|  | 3'-GAACAAGUCUUGACAGAAACCUGAGAG-5' | (SEQ ID NO: 1146) |  |
| βc-1423 Target: | 5'-CTTGTTCAGAACTGTCTTTGGACTCTC-3' | (SEQ ID NO: 2255) |  |
|  | 5'-GGUUCAGAUGAUAUAAAUGUGGUCA-3' | (SEQ ID NO: 3365) |  |
|  | 3'-ACCCAAGUCUACUAUAUUUACACCAGU-5' | (SEQ ID NO: 1147) |  |
| βc-1520 Target: | 5'-TGGGTTCAGATGATATAAATGTGGTCA-3' | (SEQ ID NO: 2256) |  |
|  | 5'-UCUUUCUAACCUCACUUGCAAUAAU-3' | (SEQ ID NO: 3366) |  |
|  | 3'-UAAGAAAGAUUGGAGUGAACGUUAUUA-5' | (SEQ ID NO: 1148) |  |
| βc-1561 Target: | 5'-ATTCTTTCTAACCTCACTTGCAATAAT-3' | (SEQ ID NO: 2257) |  |
|  | 5'-CUCACUUGCAAUAAUUAUAAGAACA-3' | (SEQ ID NO: 3367) |  |
|  | 3'-UGGAGUGAACGUUAUUAAUAUUCUUGU-5' | (SEQ ID NO: 1149) |  |
| βc-1571 Target: | 5'-ACCTCACTTGCAATAATTATAAGAACA-3' | (SEQ ID NO: 2258) |  |
|  | 5'-CAAUAAUUAUAAGAACAAGAUGAUG-3' | (SEQ ID NO: 3368) |  |
|  | 3'-ACGUUAUUAAUAUUCUUGUUCUACUAC-5' | (SEQ ID NO: 1150) |  |
| βc-1579 Target: | 5'-TGCAATAATTATAAGAACAAGATGATG-3' | (SEQ ID NO: 2259) |  |
|  | 5'-GUAUAGAGGCUCUUGUGCGUACUGU-3' | (SEQ ID NO: 3369) |  |
|  | 3'-ACCAUAUCUCCGAGAACACGCAUGACA-5' | (SEQ ID NO: 1151) |  |
| βc-1620 Target: | 5'-TGGTATAGAGGCTCTTGTGCGTACTGT-3' | (SEQ ID NO: 2260) |  |
|  | 5'-GGCUACUGUUGGAUUGAUUCGAAAU-3' | (SEQ ID NO: 3370) |  |
|  | 3'-UUCCGAUGACAACCUAACUAAGCUUUA-5' | (SEQ ID NO: 1152) |  |
| βc-1816 Target: | 5'-AAGGCTACTGTTGGATTGATTCGAAAT-3' | (SEQ ID NO: 2261) |  |
|  | 5'-CAUGGAAGAAAUAGUUGAAGGUUGU-3' | (SEQ ID NO: 3371) |  |
|  | 3'-GCGUACCUUCUUUAUCAACUUCCAACA-5' | (SEQ ID NO: 1153) |  |
| βc-1987 Target: | 5'-CGCATGGAAGAAATAGTTGAAGGTTGT-3' | (SEQ ID NO: 2262) |  |
|  | 5'-UGGAAGAAAUAGUUGAAGGUUGUAC-3' | (SEQ ID NO: 3372) |  |
|  | 3'-GUACCUUCUUUAUCAACUUCCAACAUG-5' | (SEQ ID NO: 1154) |  |
| βc-1989 Target: | 5'-CATGGAAGAAATAGTTGAAGGTTGTAC-3' | (SEQ ID NO: 2263) |  |
|  | 5'-AUUGAAAACAUCCAAAGAGUAGCUG-3' | (SEQ ID NO: 3373) |  |
|  | 3'-GGUAACUUUUGUAGGUUUCUCAUCGAC-5' | (SEQ ID NO: 1155) |  |
| βc-2111 Target: | 5'-CCATTGAAAACATCCAAAGAGTAGCTG-3' | (SEQ ID NO: 2264) |  |
|  | 5'-GAGGACAAGCCACAAGAUUACAAGA-3' | (SEQ ID NO: 3374) |  |
|  | 3'-GACUCCUGUUCGGUGUUCUAAUGUUCU-5' | (SEQ ID NO: 1156) |  |
| βc-2282 Target: | 5'-CTGAGGACAAGCCACAAGATTACAAGA-3' | (SEQ ID NO: 2265) |  |

TABLE 6-continued

Selected Anti-β-catenin DsiRNA Agents, Unmodified Duplexes

|  |  |  |  |
|---|---|---|---|
|  | 5'-GAUACUGACCUGUAAAUCAUCCUUU-3' | (SEQ ID NO: 3375) |
|  | 3'-AACUAUGACUGGACAUUUAGUAGGAAA-5' | (SEQ ID NO: 1157) |
| βc-2624 Target: | 5'-TTGATACTGACCTGTAAATCATCCTTT-3' | (SEQ ID NO: 2266) |
|  | 5'-UUAGGUAAGAAGUUUUAAAAAGCCA-3' | (SEQ ID NO: 3376) |
|  | 3'-GAAAUCCAUUCUUCAAAAUUUUUCGGU-5' | (SEQ ID NO: 1158) |
| βc-2647 Target: | 5'-CTTTAGGTAAGAAGTTTTAAAAAGCCA-3' | (SEQ ID NO: 2267) |
|  | 5'-CAGGUAUAUACUUUGAAAGGAGAUG-3' | (SEQ ID NO: 3377) |
|  | 3'-UUGUCCAUAUAUGAAACUUUCCUCUAC-5' | (SEQ ID NO: 1159) |
| βc-2770 Target: | 5'-AACAGGTATATACTTTGAAAGGAGATG-3' | (SEQ ID NO: 2268) |
|  | 5'-GAAGUUAUUAACUUUAAUGUUUUUU-3' | (SEQ ID NO: 3378) |
|  | 3'-ACCUUCAAUAAUUGAAAUUACAAAAAA-5' | (SEQ ID NO: 1160) |
| βc-2848 Target: | 5'-TGGAAGTTATTAACTTTAATGTTTTTT-3' | (SEQ ID NO: 2269) |
|  | 5'-CCACAGCUUUUGCAACUUAAUACUC-3' | (SEQ ID NO: 3379) |
|  | 3'-ACGGUGUCGAAAACGUUGAAUUAUGAG-5' | (SEQ ID NO: 1161) |
| βc-2874 Target: | 5'-TGCCACAGCTTTTGCAACTTAATACTC-3' | (SEQ ID NO: 2270) |
|  | 5'-CAUUUGCUGUUUUAAACAUUAAUAG-3' | (SEQ ID NO: 3380) |
|  | 3'-UUGUAAACGACAAAAUUUGUAAUUAUC-5' | (SEQ ID NO: 1162) |
| βc-2909 Target: | 5'-AACATTTGCTGTTTTAAACATTAATAG-3' | (SEQ ID NO: 2271) |
|  | 5'-CAAUUGAAGUAAACUUUUUGUUCUG-3' | (SEQ ID NO: 3381) |
|  | 3'-UUGUUAACUUCAUUUGAAAAACAAGAC-5' | (SEQ ID NO: 1163) |
| βc-3074 Target: | 5'-AACAATTGAAGTAAACTTTTTGTTCTG-3' | (SEQ ID NO: 2272) |
|  | 5'-ACCCUAGCCUUGCUUGUUAAAUUUU-3' | (SEQ ID NO: 3382) |
|  | 3'-UUUGGGAUCGGAACGAACAAUUUAAAA-5' | (SEQ ID NO: 1164) |
| βc-3197 Target: | 5'-AAACCCTAGCCTTGCTTGTTAAATTTT-3' | (SEQ ID NO: 2273) |
|  | 5'-GCCUUGCUUGUUAAAUUUUUUUUUU-3' | (SEQ ID NO: 3383) |
|  | 3'-AUCGGAACGAACAAUUUAAAAAAAAAA-5' | (SEQ ID NO: 1165) |
| βc-3203 Target: | 5'-TAGCCTTGCTTGTTAAATTTTTTTTTT-3' | (SEQ ID NO: 2274) |
|  | 5'-GAAGUAGCUCUUUUUUUUUUUUUU-3' | (SEQ ID NO: 3384) |
|  | 3'-AACUUCAUCGAGAAAAAAAAAAAAAAA-5' | (SEQ ID NO: 1166) |
| βc-3273 Target: | 5'-TTGAAGTAGCTCTTTTTTTTTTTTTT-3' | (SEQ ID NO: 2275) |
|  | 5'-GUAGUGUUAAGUUAUAGUGAAUACU-3' | (SEQ ID NO: 3385) |
|  | 3'-AGCAUCACAAUUCAAUAUCACUUAUGA-5' | (SEQ ID NO: 1167) |
| βc-3333 Target: | 5'-TCGTAGTGTTAAGTTATAGTGAATACT-3' | (SEQ ID NO: 2276) |
|  | 5'-GUGAAUACUGCUACAGCAAUUUCUA-3' | (SEQ ID NO: 3386) |
|  | 3'-AUCACUUAUGACGAUGUCGUUAAAGAU-5' | (SEQ ID NO: 1168) |
| βc-3349 Target: | 5'-TAGTGAATACTGCTACAGCAATTTCTA-3' | (SEQ ID NO: 2277) |
|  | 5'-UACUGCUACAGCAAUUUCUAAUUUU-3' | (SEQ ID NO: 3387) |
|  | 3'-UUAUGACGAUGUCGUUAAAGAUUAAAA-5' | (SEQ ID NO: 1169) |
| βc-3354 Target: | 5'-AATACTGCTACAGCAATTTCTAATTTT-3' | (SEQ ID NO: 2278) |

TABLE 6-continued

Selected Anti-β-catenin DsiRNA Agents, Unmodified Duplexes

|  |  |  |  |
|---|---|---|---|
|  | 5'-CUAAUUUUUAAGAAUUGAGUAAUGG-3' | (SEQ ID NO: 3388) |  |
|  | 3'-AAGAUUAAAAAUUCUUAACUCAUUACC-5' | (SEQ ID NO: 1170) |  |
| βc-3371 Target: | 5'-TTCTAATTTTTAAGAATTGAGTAATGG-3' | (SEQ ID NO: 2279) |  |
|  | 5'-UUUUAAGAAUUGAGUAAUGGUGUAG-3' | (SEQ ID NO: 3389) |  |
|  | 3'-UAAAAAUUCUUAACUCAUUACCACAUC-5' | (SEQ ID NO: 1171) |  |
| βc-3376 Target: | 5'-ATTTTTAAGAATTGAGTAATGGTGTAG-3' | (SEQ ID NO: 2280) |  |
|  | 5'-CAUAAUCACUCUAAUUAAUUGUAAU-3' | (SEQ ID NO: 3390) |  |
|  | 3'-AAGUAUUAGUGAGAUUAAUUAACAUUA-5' | (SEQ ID NO: 1172) |  |
| βc-3411 Target: | 5'-TTCATAATCACTCTAATTAATTGTAAT-3' | (SEQ ID NO: 2281) |  |
|  | 5'-UAAUUGUAAUCUGAAUAAAGUGUAA-3' | (SEQ ID NO: 3391) |  |
|  | 3'-UAAUUAACAUUAGACUUAUUUCACAUU-5' | (SEQ ID NO: 1173) |  |
| βc-3426 Target: | 5'-ATTAATTGTAATCTGAATAAAGTGTAA-3' | (SEQ ID NO: 2282) |  |
|  | 5'-GUAAUCUGAAUAAAGUGUAACAAUU-3' | (SEQ ID NO: 3392) |  |
|  | 3'-AACAUUAGACUUAUUUCACAUUGUUAA-5' | (SEQ ID NO: 1174) |  |
| βc-3431 Target: | 5'-TTGTAATCTGAATAAAGTGTAACAATT-3' | (SEQ ID NO: 2283) |  |
|  | 5'-UGAAUAAAGUGUAACAAUUGUGUAG-3' | (SEQ ID NO: 3393) |  |
|  | 3'-AGACUUAUUUCACAUUGUUAACACAUC-5' | (SEQ ID NO: 1175) |  |
| βc-3437 Target: | 5'-TCTGAATAAAGTGTAACAATTGTGTAG-3' | (SEQ ID NO: 2284) |  |
|  | 5'-GUAGCCUUUUUGUAUAAAAUAGACA-3' | (SEQ ID NO: 3394) |  |
|  | 3'-CACAUCGGAAAAACAUAUUUUAUCUGU-5' | (SEQ ID NO: 1176) |  |
| βc-3458 Target: | 5'-GTGTAGCCTTTTTGTATAAAATAGACA-3' | (SEQ ID NO: 2285) |  |
|  | 5'-UGUAUAAAAUAGACAAAUAGAAAAU-3' | (SEQ ID NO: 3395) |  |
|  | 3'-AAACAUAUUUUAUCUGUUUAUCUUUUA-5' | (SEQ ID NO: 1177) |  |
| βc-3468 Target: | 5'-TTTGTATAAAATAGACAAATAGAAAAT-3' | (SEQ ID NO: 2286) |  |
|  | 5'-AAAAUGGUCCAAUUAGUUUCCUUUU-3' | (SEQ ID NO: 3396) |  |
|  | 3'-UCUUUUACCAGGUUAAUCAAAGGAAAA-5' | (SEQ ID NO: 1178) |  |
| βc-3488 Target: | 5'-AGAAAATGGTCCAATTAGTTTCCTTTT-3' | (SEQ ID NO: 2287) |  |
|  | 5'-CCAAUUAGUUUCCUUUUUAAUAUGC-3' | (SEQ ID NO: 3397) |  |
|  | 3'-CAGGUUAAUCAAAGGAAAAAUUAUACG-5' | (SEQ ID NO: 1179) |  |
| βc-3496 Target: | 5'-GTCCAATTAGTTTCCTTTTTAATATGC-3' | (SEQ ID NO: 2288) |  |
|  | 5'-UUUGAUCAAAAACUAUUUGGGAUAU-3' | (SEQ ID NO: 3398) |  |
|  | 3'-AAAAACUAGUUUUUGAUAAACCCUAUA-5' | (SEQ ID NO: 1180) |  |
| βc-3552 Target: | 5'-TTTTTGATCAAAAACTATTTGGGATAT-3' | (SEQ ID NO: 2289) |  |
|  | 5'-GAGGUGUUAUUUGGAACCUUGUUUU-3' | (SEQ ID NO: 3399) |  |
|  | 3'-UUCUCCACAAUAAACCUUGGAACAAAA-5' | (SEQ ID NO: 1181) |  |
| βc-3600 Target: | 5'-AAGAGGTGTTATTTGGAACCTTGTTTT-3' | (SEQ ID NO: 2290) |  |
|  | 5'-GUUAUUUGGAACCUUGUUUUGGACA-3' | (SEQ ID NO: 3400) |  |
|  | 3'-CACAAUAAACCUUGGAACAAAACCUGU-5' | (SEQ ID NO: 1182) |  |
| βc-3605 Target: | 5'-GTGTTATTTGGAACCTTGTTTTGGACA-3' | (SEQ ID NO: 2291) |  |

TABLE 6-continued

Selected Anti-β-catenin DsiRNA Agents, Unmodified Duplexes

|  |  |  |  |
|---|---|---|---|
|  | 5'-ACCUUGUUUUGGACAGUUUACCAGU-3' | (SEQ ID NO: 3401) |  |
|  | 3'-CUUGGAACAAAACCUGUCAAAUGGUCA-5' | (SEQ ID NO: 1183) |  |
| βc-3615 Target: | 5'-GAACCTTGTTTTGGACAGTTTACCAGT-3' | (SEQ ID NO: 2292) |  |
|  | 5'-GAUACGAUGCUUCAAGAGAAAAUGC-3' | (SEQ ID NO: 3402) |  |
|  | 3'-CACUAUGCUACGAAGUUCUCUUUUACG-5' | (SEQ ID NO: 1184) |  |
| βc-3674 Target: | 5'-GTGATACGATGCTTCAAGAGAAAATGC-3' | (SEQ ID NO: 2293) |  |
|  | 5'-CAAGAGAAAAUGCGGUUAUAAAAAA-3' | (SEQ ID NO: 3403) |  |
|  | 3'-AAGUUCUCUUUUACGCCAAUAUUUUUU-5' | (SEQ ID NO: 1185) |  |
| βc-3686 Target: | 5'-TTCAAGAGAAAATGCGGTTATAAAAAA-3' | (SEQ ID NO: 2294) |  |
|  | 5'-GAAAAUGCGGUUAUAAAAAAUGGUU-3' | (SEQ ID NO: 3404) |  |
|  | 3'-CUCUUUUACGCCAAUAUUUUUUACCAA-5' | (SEQ ID NO: 1186) |  |
| βc-3691 Target: | 5'-GAGAAAATGCGGTTATAAAAAATGGTT-3' | (SEQ ID NO: 2295) |  |
|  | 5'-GUUAUAAAAAAUGGUUCAGAAUUAA-3' | (SEQ ID NO: 3405) |  |
|  | 3'-GCCAAUAUUUUUUACCAAGUCUUAAUU-5' | (SEQ ID NO: 1187) |  |
| βc-3700 Target: | 5'-CGGTTATAAAAAATGGTTCAGAATTAA-3' | (SEQ ID NO: 2296) |  |
|  | 5'-AAAAUGGUUCAGAAUUAAACUUUUA-3' | (SEQ ID NO: 3406) |  |
|  | 3'-UUUUUUACCAAGUCUUAAUUUGAAAAU-5' | (SEQ ID NO: 1188) |  |
| βc-3707 Target: | 5'-AAAAAATGGTTCAGAATTAAACTTTTA-3' | (SEQ ID NO: 2297) |  |
|  | 5'-GCGUGGACAAUGGCUACUCAAGCUG-3' | (SEQ ID NO: 3407) |  |
|  | 3'-GUCGCACCUGUUACCGAUGAGUUCGAC-5' | (SEQ ID NO: 1189) |  |
| βc-284 Target: | 5'-CAGCGTGGACAATGGCTACTCAAGCTG-3' | (SEQ ID NO: 2298) |  |
|  | 5'-CGUGGACAAUGGCUACUCAAGCUGA-3' | (SEQ ID NO: 3408) |  |
|  | 3'-UCGCACCUGUUACCGAUGAGUUCGACU-5' | (SEQ ID NO: 1190) |  |
| βc-285 Target: | 5'-AGCGTGGACAATGGCTACTCAAGCTGA-3' | (SEQ ID NO: 2299) |  |
|  | 5'-GUGGACAAUGGCUACUCAAGCUGAU-3' | (SEQ ID NO: 3409) |  |
|  | 3'-CGCACCUGUUACCGAUGAGUUCGACUA-5' | (SEQ ID NO: 1191) |  |
| βc-286 Target: | 5'-GCGTGGACAATGGCTACTCAAGCTGAT-3' | (SEQ ID NO: 2300) |  |
|  | 5'-UGGACAAUGGCUACUCAAGCUGAUU-3' | (SEQ ID NO: 3410) |  |
|  | 3'-GCACCUGUUACCGAUGAGUUCGACUAA-5' | (SEQ ID NO: 1192) |  |
| βc-287 Target: | 5'-CGTGGACAATGGCTACTCAAGCTGATT-3' | (SEQ ID NO: 2301) |  |
|  | 5'-GGACAAUGGCUACUCAAGCUGAUUU-3' | (SEQ ID NO: 3411) |  |
|  | 3'-CACCUGUUACCGAUGAGUUCGACUAAA-5' | (SEQ ID NO: 1193) |  |
| βc-288 Target: | 5'-GTGGACAATGGCTACTCAAGCTGATTT-3' | (SEQ ID NO: 2302) |  |
|  | 5'-GACAAUGGCUACUCAAGCUGAUUUG-3' | (SEQ ID NO: 3412) |  |
|  | 3'-ACCUGUUACCGAUGAGUUCGACUAAAC-5' | (SEQ ID NO: 1194) |  |
| βc-289 Target: | 5'-TGGACAATGGCTACTCAAGCTGATTTG-3' | (SEQ ID NO: 2303) |  |
|  | 5'-ACAAUGGCUACUCAAGCUGAUUUGA-3' | (SEQ ID NO: 3413) |  |
|  | 3'-CCUGUUACCGAUGAGUUCGACUAAACU-5' | (SEQ ID NO: 1195) |  |
| βc-290 Target: | 5'-GGACAATGGCTACTCAAGCTGATTTGA-3' | (SEQ ID NO: 2304) |  |

TABLE 6-continued

Selected Anti-β-catenin DsiRNA Agents, Unmodified Duplexes

|  |  |  |  |
|---|---|---|---|
|  | 5'-CAAUGGCUACUCAAGCUGAUUUGAU-3' | (SEQ ID NO: 3414) |  |
|  | 3'-CUGUUACCGAUGAGUUCGACUAAACUA-5' | (SEQ ID NO: 1196) |  |
| βc-291 Target: | 5'-GACAATGGCTACTCAAGCTGATTTGAT-3' | (SEQ ID NO: 2305) |  |
|  | 5'-UGAUGGAGUUGGACAUGGCCAUGGA-3' | (SEQ ID NO: 3415) |  |
|  | 3'-AAACUACCUCAACCUGUACCGGUACCU-5' | (SEQ ID NO: 1197) |  |
| βc-312 Target: | 5'-TTTGATGGAGTTGGACATGGCCATGGA-3' | (SEQ ID NO: 2306) |  |
|  | 5'-GAUGGAGUUGGACAUGGCCAUGGAA-3' | (SEQ ID NO: 3416) |  |
|  | 3'-AACUACCUCAACCUGUACCGGUACCUU-5' | (SEQ ID NO: 1198) |  |
| βc-313 Target: | 5'-TTGATGGAGTTGGACATGGCCATGGAA-3' | (SEQ ID NO: 2307) |  |
|  | 5'-AUGGAGUUGGACAUGGCCAUGGAAC-3' | (SEQ ID NO: 3417) |  |
|  | 3'-ACUACCUCAACCUGUACCGGUACCUUG-5' | (SEQ ID NO: 1199) |  |
| βc-314 Target: | 5'-TGATGGAGTTGGACATGGCCATGGAAC-3' | (SEQ ID NO: 2308) |  |
|  | 5'-UGGAGUUGGACAUGGCCAUGGAACC-3' | (SEQ ID NO: 3418) |  |
|  | 3'-CUACCUCAACCUGUACCGGUACCUUGG-5' | (SEQ ID NO: 1200) |  |
| βc-315 Target: | 5'-GATGGAGTTGGACATGGCCATGGAACC-3' | (SEQ ID NO: 2309) |  |
|  | 5'-GGAGUUGGACAUGGCCAUGGAACCA-3' | (SEQ ID NO: 3419) |  |
|  | 3'-UACCUCAACCUGUACCGGUACCUUGGU-5' | (SEQ ID NO: 1201) |  |
| βc-316 Target: | 5'-ATGGAGTTGGACATGGCCATGGAACCA-3' | (SEQ ID NO: 2310) |  |
|  | 5'-GAGUUGGACAUGGCCAUGGAACCAG-3' | (SEQ ID NO: 3420) |  |
|  | 3'-ACCUCAACCUGUACCGGUACCUUGGUC-5' | (SEQ ID NO: 1202) |  |
| βc-317 Target: | 5'-TGGAGTTGGACATGGCCATGGAACCAG-3' | (SEQ ID NO: 2311) |  |
|  | 5'-AGUUGGACAUGGCCAUGGAACCAGA-3' | (SEQ ID NO: 3421) |  |
|  | 3'-CCUCAACCUGUACCGGUACCUUGGUCU-5' | (SEQ ID NO: 1203) |  |
| βc-318 Target: | 5'-GGAGTTGGACATGGCCATGGAACCAGA-3' | (SEQ ID NO: 2312) |  |
|  | 5'-UCUGGAAUCCAUUCUGGUGCCACUA-3' | (SEQ ID NO: 3422) |  |
|  | 3'-UGAGACCUUAGGUAAGACCACGGUGAU-5' | (SEQ ID NO: 1204) |  |
| βc-389 Target: | 5'-ACTCTGGAATCCATTCTGGTGCCACTA-3' | (SEQ ID NO: 2313) |  |
|  | 5'-CUGGAAUCCAUUCUGGUGCCACUAC-3' | (SEQ ID NO: 3423) |  |
|  | 3'-GAGACCUUAGGUAAGACCACGGUGAUG-5' | (SEQ ID NO: 1205) |  |
| βc-390 Target: | 5'-CTCTGGAATCCATTCTGGTGCCACTAC-3' | (SEQ ID NO: 2314) |  |
|  | 5'-UGGAAUCCAUUCUGGUGCCACUACC-3' | (SEQ ID NO: 3424) |  |
|  | 3'-AGACCUUAGGUAAGACCACGGUGAUGG-5' | (SEQ ID NO: 1206) |  |
| βc-391 Target: | 5'-TCTGGAATCCATTCTGGTGCCACTACC-3' | (SEQ ID NO: 2315) |  |
|  | 5'-GGAAUCCAUUCUGGUGCCACUACCA-3' | (SEQ ID NO: 3425) |  |
|  | 3'-GACCUUAGGUAAGACCACGGUGAUGGU-5' | (SEQ ID NO: 1207) |  |
| βc-392 Target: | 5'-CTGGAATCCATTCTGGTGCCACTACCA-3' | (SEQ ID NO: 2316) |  |
|  | 5'-GAAUCCAUUCUGGUGCCACUACCAC-3' | (SEQ ID NO: 3426) |  |
|  | 3'-ACCUUAGGUAAGACCACGGUGAUGGUG-5' | (SEQ ID NO: 1208) |  |
| βc-393 Target: | 5'-TGGAATCCATTCTGGTGCCACTACCAC-3' | (SEQ ID NO: 2317) |  |

TABLE 6-continued

Selected Anti-β-catenin DsiRNA Agents, Unmodified Duplexes

|  |  |  |  |
|---|---|---|---|
|  | 5'-UAGAUGAGGGCAUGCAGAUCCCAUC-3' | (SEQ ID NO: 3427) |  |
|  | 3'-UAAUCUACUCCCGUACGUCUAGGGUAG-5' | (SEQ ID NO: 1209) |  |
| βc-600 Target: | 5'-ATTAGATGAGGGCATGCAGATCCCATC-3' | (SEQ ID NO: 2318) |  |
|  | 5'-AGAUGAGGGCAUGCAGAUCCCAUCU-3' | (SEQ ID NO: 3428) |  |
|  | 3'-AAUCUACUCCCGUACGUCUAGGGUAGA-5' | (SEQ ID NO: 1210) |  |
| βc-601 Target: | 5'-TTAGATGAGGGCATGCAGATCCCATCT-3' | (SEQ ID NO: 2319) |  |
|  | 5'-GAUGAGGGCAUGCAGAUCCCAUCUA-3' | (SEQ ID NO: 3429) |  |
|  | 3'-AUCUACUCCCGUACGUCUAGGGUAGAU-5' | (SEQ ID NO: 1211) |  |
| βc-602 Target: | 5'-TAGATGAGGGCATGCAGATCCCATCTA-3' | (SEQ ID NO: 2320) |  |
|  | 5'-AUGAGGGCAUGCAGAUCCCAUCUAC-3' | (SEQ ID NO: 3430) |  |
|  | 3'-UCUACUCCCGUACGUCUAGGGUAGAUG-5' | (SEQ ID NO: 1212) |  |
| βc-603 Target: | 5'-AGATGAGGGCATGCAGATCCCATCTAC-3' | (SEQ ID NO: 2321) |  |
|  | 5'-UGAGGGCAUGCAGAUCCCAUCUACA-3' | (SEQ ID NO: 3431) |  |
|  | 3'-CUACUCCCGUACGUCUAGGGUAGAUGU-5' | (SEQ ID NO: 1213) |  |
| βc-604 Target: | 5'-GATGAGGGCATGCAGATCCCATCTACA-3' | (SEQ ID NO: 2322) |  |
|  | 5'-GAGGGCAUGCAGAUCCCAUCUACAC-3' | (SEQ ID NO: 3432) |  |
|  | 3'-UACUCCCGUACGUCUAGGGUAGAUGUG-5' | (SEQ ID NO: 1214) |  |
| βc-605 Target: | 5'-ATGAGGGCATGCAGATCCCATCTACAC-3' | (SEQ ID NO: 2323) |  |
|  | 5'-GCUGCUCAUCCCACUAAUGUCCAGC-3' | (SEQ ID NO: 3433) |  |
|  | 3'-UACGACGAGUAGGGUGAUUACAGGUCG-5' | (SEQ ID NO: 1215) |  |
| βc-638 Target: | 5'-ATGCTGCTCATCCCACTAATGTCCAGC-3' | (SEQ ID NO: 2324) |  |
|  | 5'-CUGCUCAUCCCACUAAUGUCCAGCG-3' | (SEQ ID NO: 3434) |  |
|  | 3'-ACGACGAGUAGGGUGAUUACAGGUCGC-5' | (SEQ ID NO: 1216) |  |
| βc-639 Target: | 5'-TGCTGCTCATCCCACTAATGTCCAGCG-3' | (SEQ ID NO: 2325) |  |
|  | 5'-UGCUCAUCCCACUAAUGUCCAGCGU-3' | (SEQ ID NO: 3435) |  |
|  | 3'-CGACGAGUAGGGUGAUUACAGGUCGCA-5' | (SEQ ID NO: 1217) |  |
| βc-640 Target: | 5'-GCTGCTCATCCCACTAATGTCCAGCGT-3' | (SEQ ID NO: 2326) |  |
|  | 5'-GCUCAUCCCACUAAUGUCCAGCGUU-3' | (SEQ ID NO: 3436) |  |
|  | 3'-GACGAGUAGGGUGAUUACAGGUCGCAA-5' | (SEQ ID NO: 1218) |  |
| βc-641 Target: | 5'-CTGCTCATCCCACTAATGTCCAGCGTT-3' | (SEQ ID NO: 2327) |  |
|  | 5'-CUCAUCCCACUAAUGUCCAGCGUUU-3' | (SEQ ID NO: 3437) |  |
|  | 3'-ACGAGUAGGGUGAUUACAGGUCGCAAA-5' | (SEQ ID NO: 1219) |  |
| βc-642 Target: | 5'-TGCTCATCCCACTAATGTCCAGCGTTT-3' | (SEQ ID NO: 2328) |  |
|  | 5'-UCAUCCCACUAAUGUCCAGCGUUUG-3' | (SEQ ID NO: 3438) |  |
|  | 3'-CGAGUAGGGUGAUUACAGGUCGCAAAC-5' | (SEQ ID NO: 1220) |  |
| βc-643 Target: | 5'-GCTCATCCCACTAATGTCCAGCGTTTG-3' | (SEQ ID NO: 2329) |  |
|  | 5'-CAUCCCACUAAUGUCCAGCGUUUGG-3' | (SEQ ID NO: 3439) |  |
|  | 3'-GAGUAGGGUGAUUACAGGUCGCAAACC-5' | (SEQ ID NO: 1221) |  |
| βc-644 Target: | 5'-CTCATCCCACTAATGTCCAGCGTTTGG-3' | (SEQ ID NO: 2330) |  |

TABLE 6-continued

Selected Anti-β-catenin DsiRNA Agents, Unmodified Duplexes

|  |  |  |  |
|---|---|---|---|
|  | 5'-AUCCCACUAAUGUCCAGCGUUUGGC-3' | (SEQ ID NO: 3440) |
|  | 3'-AGUAGGGUGAUUACAGGUCGCAAACCG-5' | (SEQ ID NO: 1222) |
| βc-645 Target: | 5'-TCATCCCACTAATGTCCAGCGTTTGGC-3' | (SEQ ID NO: 2331) |
|  | 5'-UUGGCUGAACCAUCACAGAUGCUGA-3' | (SEQ ID NO: 3441) |
|  | 3'-CAAACCGACUUGGUAGUGUCUACGACU-5' | (SEQ ID NO: 1223) |
| βc-665 Target: | 5'-GTTTGGCTGAACCATCACAGATGCTGA-3' | (SEQ ID NO: 2332) |
|  | 5'-UGGCUGAACCAUCACAGAUGCUGAA-3' | (SEQ ID NO: 3442) |
|  | 3'-AAACCGACUUGGUAGUGUCUACGACUU-5' | (SEQ ID NO: 1224) |
| βc-666 Target: | 5'-TTTGGCTGAACCATCACAGATGCTGAA-3' | (SEQ ID NO: 2333) |
|  | 5'-GGCUGAACCAUCACAGAUGCUGAAA-3' | (SEQ ID NO: 3443) |
|  | 3'-AACCGACUUGGUAGUGUCUACGACUUU-5' | (SEQ ID NO: 1225) |
| βc-667 Target: | 5'-TTGGCTGAACCATCACAGATGCTGAAA-3' | (SEQ ID NO: 2334) |
|  | 5'-GAACUUGCCACACGUGCAAUCCCUG-3' | (SEQ ID NO: 3444) |
|  | 3'-GUCUUGAACGGUGUGCACGUUAGGGAC-5' | (SEQ ID NO: 1226) |
| βc-731 Target: | 5'-CAGAACTTGCCACACGTGCAATCCCTG-3' | (SEQ ID NO: 2335) |
|  | 5'-AACUUGCCACACGUGCAAUCCCUGA-3' | (SEQ ID NO: 3445) |
|  | 3'-UCUUGAACGGUGUGCACGUUAGGGACU-5' | (SEQ ID NO: 1227) |
| βc-732 Target: | 5'-AGAACTTGCCACACGTGCAATCCCTGA-3' | (SEQ ID NO: 2336) |
|  | 5'-GUUAUGGUCCAUCAGCUUUCUAAAA-3' | (SEQ ID NO: 3446) |
|  | 3'-GUCAAUACCAGGUAGUCGAAAGAUUUU-5' | (SEQ ID NO: 1228) |
| βc-809 Target: | 5'-CAGTTATGGTCCATCAGCTTTCTAAAA-3' | (SEQ ID NO: 2337) |
|  | 5'-UUAUGGUCCAUCAGCUUUCUAAAAA-3' | (SEQ ID NO: 3447) |
|  | 3'-UCAAUACCAGGUAGUCGAAAGAUUUUU-5' | (SEQ ID NO: 1229) |
| βc-810 Target: | 5'-AGTTATGGTCCATCAGCTTTCTAAAAA-3' | (SEQ ID NO: 2338) |
|  | 5'-AAAAAGGAAGCUUCCAGACACGCUA-3' | (SEQ ID NO: 3448) |
|  | 3'-GAUUUUUCCUUCGAAGGUCUGUGCGAU-5' | (SEQ ID NO: 1230) |
| βc-830 Target: | 5'-CTAAAAAGGAAGCTTCCAGACACGCTA-3' | (SEQ ID NO: 2339) |
|  | 5'-AAAAGGAAGCUUCCAGACACGCUAU-3' | (SEQ ID NO: 3449) |
|  | 3'-AUUUUUCCUUCGAAGGUCUGUGCGAUA-5' | (SEQ ID NO: 1231) |
| βc-831 Target: | 5'-TAAAAAGGAAGCTTCCAGACACGCTAT-3' | (SEQ ID NO: 2340) |
|  | 5'-ACCAUGCAGAAUACAAAUGAUGUAG-3' | (SEQ ID NO: 3450) |
|  | 3'-CAUGGUACGUCUUAUGUUUACUACAUC-5' | (SEQ ID NO: 1232) |
| βc-893 Target: | 5'-GTACCATGCAGAATACAAATGATGTAG-3' | (SEQ ID NO: 2341) |
|  | 5'-CCAUGCAGAAUACAAAUGAUGUAGA-3' | (SEQ ID NO: 3451) |
|  | 3'-AUGGUACGUCUUAUGUUUACUACAUCU-5' | (SEQ ID NO: 1233) |
| βc-894 Target: | 5'-TACCATGCAGAATACAAATGATGTAGA-3' | (SEQ ID NO: 2342) |
|  | 5'-CAUGCAGAAUACAAAUGAUGUAGAA-3' | (SEQ ID NO: 3452) |
|  | 3'-UGGUACGUCUUAUGUUUACUACAUCUU-5' | (SEQ ID NO: 1234) |
| βc-895 Target: | 5'-ACCATGCAGAATACAAATGATGTAGAA-3' | (SEQ ID NO: 2343) |

TABLE 6-continued

Selected Anti-β-catenin DsiRNA Agents, Unmodified Duplexes

|  |  |  |  |
|---|---|---|---|
|  | 5'-AUGCAGAAUACAAAUGAUGUAGAAA-3' | (SEQ ID NO: 3453) |  |
|  | 3'-GGUACGUCUUAUGUUUACUACAUCUUU-5' | (SEQ ID NO: 1235) |  |
| βc-896 Target: | 5'-CCATGCAGAATACAAATGATGTAGAAA-3' | (SEQ ID NO: 2344) |  |
|  | 5'-UGCAGAAUACAAAUGAUGUAGAAAC-3' | (SEQ ID NO: 3454) |  |
|  | 3'-GUACGUCUUAUGUUUACUACAUCUUUG-5' | (SEQ ID NO: 1236) |  |
| βc-897 Target: | 5'-CATGCAGAATACAAATGATGTAGAAAC-3' | (SEQ ID NO: 2345) |  |
|  | 5'-GCAGAAUACAAAUGAUGUAGAAACA-3' | (SEQ ID NO: 3455) |  |
|  | 3'-UACGUCUUAUGUUUACUACAUCUUUGU-5' | (SEQ ID NO: 1237) |  |
| βc-898 Target: | 5'-ATGCAGAATACAAATGATGTAGAAACA-3' | (SEQ ID NO: 2346) |  |
|  | 5'-CAGAAUACAAAUGAUGUAGAAACAG-3' | (SEQ ID NO: 3456) |  |
|  | 3'-ACGUCUUAUGUUUACUACAUCUUUGUC-5' | (SEQ ID NO: 1238) |  |
| βc-899 Target: | 5'-TGCAGAATACAAATGATGTAGAAACAG-3' | (SEQ ID NO: 2347) |  |
|  | 5'-AGAAUACAAAUGAUGUAGAAACAGC-3' | (SEQ ID NO: 3457) |  |
|  | 3'-CGUCUUAUGUUUACUACAUCUUUGUCG-5' | (SEQ ID NO: 1239) |  |
| βc-900 Target: | 5'-GCAGAATACAAATGATGTAGAAACAGC-3' | (SEQ ID NO: 2348) |  |
|  | 5'-CUGGCCAUCUUUAAGUCUGGAGGCA-3' | (SEQ ID NO: 3458) |  |
|  | 3'-AUGACCGGUAGAAAUUCAGACCUCCGU-5' | (SEQ ID NO: 1240) |  |
| βc-977 Target: | 5'-TACTGGCCATCTTTAAGTCTGGAGGCA-3' | (SEQ ID NO: 2349) |  |
|  | 5'-UGGCCAUCUUUAAGUCUGGAGGCAU-3' | (SEQ ID NO: 3459) |  |
|  | 3'-UGACCGGUAGAAAUUCAGACCUCCGUA-5' | (SEQ ID NO: 1241) |  |
| βc-978 Target: | 5'-ACTGGCCATCTTTAAGTCTGGAGGC-3' | (SEQ ID NO: 2350) |  |
|  | 5'-GAAGGAGCUAAAAUGGCAGUGCGUU-3' | (SEQ ID NO: 3460) |  |
|  | 3'-UUCUUCCUCGAUUUUACCGUCACGCAA-5' | (SEQ ID NO: 1242) |  |
| βc-1091 Target: | 5'-AAGAAGGAGCTAAAATGGCAGTGCGTT-3' | (SEQ ID NO: 2351) |  |
|  | 5'-AAGGAGCUAAAAUGGCAGUGCGUUU-3' | (SEQ ID NO: 3461) |  |
|  | 3'-UCUUCCUCGAUUUUACCGUCACGCAAA-5' | (SEQ ID NO: 1243) |  |
| βc-1092 Target: | 5'-AGAAGGAGCTAAAATGGCAGTGCGTTT-3' | (SEQ ID NO: 2352) |  |
|  | 5'-AGGAGCUAAAAUGGCAGUGCGUUUA-3' | (SEQ ID NO: 3462) |  |
|  | 3'-CUUCCUCGAUUUUACCGUCACGCAAAU-5' | (SEQ ID NO: 1244) |  |
| βc-1093 Target: | 5'-GAAGGAGCTAAAATGGCAGTGCGTTTA-3' | (SEQ ID NO: 2353) |  |
|  | 5'-GGAGCUAAAAUGGCAGUGCGUUUAG-3' | (SEQ ID NO: 3463) |  |
|  | 3'-UUCCUCGAUUUUACCGUCACGCAAAUC-5' | (SEQ ID NO: 1245) |  |
| βc-1094 Target: | 5'-AAGGAGCTAAAATGGCAGTGCGTTTAG-3' | (SEQ ID NO: 2354) |  |
|  | 5'-GAGCUAAAAUGGCAGUGCGUUUAGC-3' | (SEQ ID NO: 3464) |  |
|  | 3'-UCCUCGAUUUUACCGUCACGCAAAUCG-5' | (SEQ ID NO: 1246) |  |
| βc-1095 Target: | 5'-AGGAGCTAAAATGGCAGTGCGTTTAGC-3' | (SEQ ID NO: 2355) |  |
|  | 5'-CUGUGGACCACAAGCAGAGUGCUGA-3' | (SEQ ID NO: 3465) |  |
|  | 3'-AUGACACCUGGUGUUCGUCUCACGACU-5' | (SEQ ID NO: 1247) |  |
| βc-1301 Target: | 5'-TACTGTGGACCACAAGCAGAGTGCTGA-3' | (SEQ ID NO: 2356) |  |

TABLE 6-continued

Selected Anti-β-catenin DsiRNA Agents, Unmodified Duplexes

|  |  |  |  |
|---|---|---|---|
|  | 5'-UGUGGACCACAAGCAGAGUGCUGAA-3' | (SEQ ID NO: 3466) |  |
|  | 3'-UGACACCUGGUGUUCGUCUCACGACUU-5' | (SEQ ID NO: 1248) |  |
| βc-1302 Target: | 5'-ACTGTGGACCACAAGCAGAGTGCTGAA-3' | (SEQ ID NO: 2357) |  |
|  | 5'-GUGGACCACAAGCAGAGUGCUGAAG-3' | (SEQ ID NO: 3467) |  |
|  | 3'-GACACCUGGUGUUCGUCUCACGACUUC-5' | (SEQ ID NO: 1249) |  |
| βc-1303 Target: | 5'-CTGTGGACCACAAGCAGAGTGCTGAAG-3' | (SEQ ID NO: 2358) |  |
|  | 5'-UGGACCACAAGCAGAGUGCUGAAGG-3' | (SEQ ID NO: 3468) |  |
|  | 3'-ACACCUGGUGUUCGUCUCACGACUUCC-5' | (SEQ ID NO: 1250) |  |
| βc-1304 Target: | 5'-TGTGGACCACAAGCAGAGTGCTGAAGG-3' | (SEQ ID NO: 2359) |  |
|  | 5'-GGACCACAAGCAGAGUGCUGAAGGU-3' | (SEQ ID NO: 3469) |  |
|  | 3'-CACCUGGUGUUCGUCUCACGACUUCCA-5' | (SEQ ID NO: 1251) |  |
| βc-1305 Target: | 5'-GTGGACCACAAGCAGAGTGCTGAAGGT-3' | (SEQ ID NO: 2360) |  |
|  | 5'-GACCACAAGCAGAGUGCUGAAGGUG-3' | (SEQ ID NO: 3470) |  |
|  | 3'-ACCUGGUGUUCGUCUCACGACUUCCAC-5' | (SEQ ID NO: 1252) |  |
| βc-1306 Target: | 5'-TGGACCACAAGCAGAGTGCTGAAGGTG-3' | (SEQ ID NO: 2361) |  |
|  | 5'-ACCACAAGCAGAGUGCUGAAGGUGC-3' | (SEQ ID NO: 3471) |  |
|  | 3'-CCUGGUGUUCGUCUCACGACUUCCACG-5' | (SEQ ID NO: 1253) |  |
| βc-1307 Target: | 5'-GGACCACAAGCAGAGTGCTGAAGGTGC-3' | (SEQ ID NO: 2362) |  |
|  | 5'-CCACAAGCAGAGUGCUGAAGGUGCU-3' | (SEQ ID NO: 3472) |  |
|  | 3'-CUGGUGUUCGUCUCACGACUUCCACGA-5' | (SEQ ID NO: 1254) |  |
| βc-1308 Target: | 5'-GACCACAAGCAGAGTGCTGAAGGTGCT-3' | (SEQ ID NO: 2363) |  |
|  | 5'-CACAAGCAGAGUGCUGAAGGUGCUA-3' | (SEQ ID NO: 3473) |  |
|  | 3'-UGGUGUUCGUCUCACGACUUCCACGAU-5' | (SEQ ID NO: 1255) |  |
| βc-1309 Target: | 5'-ACCACAAGCAGAGTGCTGAAGGTGCTA-3' | (SEQ ID NO: 2364) |  |
|  | 5'-ACAAGCAGAGUGCUGAAGGUGCUAU-3' | (SEQ ID NO: 3474) |  |
|  | 3'-GGUGUUCGUCUCACGACUUCCACGAUA-5' | (SEQ ID NO: 1256) |  |
| βc-1310 Target: | 5'-CCACAAGCAGAGTGCTGAAGGTGCTAT-3' | (SEQ ID NO: 2365) |  |
|  | 5'-CAAGCAGAGUGCUGAAGGUGCUAUC-3' | (SEQ ID NO: 3475) |  |
|  | 3'-GUGUUCGUCUCACGACUUCCACGAUAG-5' | (SEQ ID NO: 1257) |  |
| βc-1311 Target: | 5'-CACAAGCAGAGTGCTGAAGGTGCTATC-3' | (SEQ ID NO: 2366) |  |
|  | 5'-AAGCAGAGUGCUGAAGGUGCUAUCU-3' | (SEQ ID NO: 3476) |  |
|  | 3'-UGUUCGUCUCACGACUUCCACGAUAGA-5' | (SEQ ID NO: 1258) |  |
| βc-1312 Target: | 5'-ACAAGCAGAGTGCTGAAGGTGCTATCT-3' | (SEQ ID NO: 2367) |  |
|  | 5'-AGCAGAGUGCUGAAGGUGCUAUCUG-3' | (SEQ ID NO: 3477) |  |
|  | 3'-GUUCGUCUCACGACUUCCACGAUAGAC-5' | (SEQ ID NO: 1259) |  |
| βc-1313 Target: | 5'-CAAGCAGAGTGCTGAAGGTGCTATCTG-3' | (SEQ ID NO: 2368) |  |
|  | 5'-GCAGAGUGCUGAAGGUGCUAUCUGU-3' | (SEQ ID NO: 3478) |  |
|  | 3'-UUCGUCUCACGACUUCCACGAUAGACA-5' | (SEQ ID NO: 1260) |  |
| βc-1314 Target: | 5'-AAGCAGAGTGCTGAAGGTGCTATCTGT-3' | (SEQ ID NO: 2369) |  |

TABLE 6-continued

Selected Anti-β-catenin DsiRNA Agents, Unmodified Duplexes

```
                   5'-AACUGUCUUUGGACUCUCAGGAAUC-3'    (SEQ ID NO: 3479)
                   3'-UCUUGACAGAAACCUGAGAGUCCUUAG-5'  (SEQ ID NO: 1261)
βc-1430 Target:    5'-AGAACTGTCTTTGGACTCTCAGGAATC-3'  (SEQ ID NO: 2370)
                   5'-ACUGUCUUUGGACUCUCAGGAAUCU-3'    (SEQ ID NO: 3480)
                   3'-CUUGACAGAAACCUGAGAGUCCUUAGA-5'  (SEQ ID NO: 1262)
βc-1431 Target:    5'-GAACTGTCTTTGGACTCTCAGGAATCT-3'  (SEQ ID NO: 2371)
                   5'-GAUGAUAUAAAUGUGGUCACCUGUG-3'    (SEQ ID NO: 3481)
                   3'-GUCUACUAUAUUUACACCAGUGGACAC-5'  (SEQ ID NO: 1263)
βc-1526 Target:    5'-CAGATGATATAAATGTGGTCACCTGTG-3'  (SEQ ID NO: 2372)
                   5'-AUGAUAUAAAUGUGGUCACCUGUGC-3'    (SEQ ID NO: 3482)
                   3'-UCUACUAUAUUUACACCAGUGGACACG-5'  (SEQ ID NO: 1264)
βc-1527 Target:    5'-AGATGATATAAATGTGGTCACCTGTGC-3'  (SEQ ID NO: 2373)
                   5'-UGAUAUAAAUGUGGUCACCUGUGCA-3'    (SEQ ID NO: 3483)
                   3'-CUACUAUAUUUACACCAGUGGACACGU-5'  (SEQ ID NO: 1265)
βc-1528 Target:    5'-GATGATATAAATGTGGTCACCTGTGCA-3'  (SEQ ID NO: 2374)
                   5'-GAUAUAAAUGUGGUCACCUGUGCAG-3'    (SEQ ID NO: 3484)
                   3'-UACUAUAUUUACACCAGUGGACACGUC-5'  (SEQ ID NO: 1266)
βc-1529 Target:    5'-ATGATATAAATGTGGTCACCTGTGCAG-3'  (SEQ ID NO: 2375)
                   5'-AUAUAAAUGUGGUCACCUGUGCAGC-3'    (SEQ ID NO: 3485)
                   3'-ACUAUAUUUACACCAGUGGACACGUCG-5'  (SEQ ID NO: 1267)
βc-1530 Target:    5'-TGATATAAATGTGGTCACCTGTGCAGC-3'  (SEQ ID NO: 2376)
                   5'-UAUAAAUGUGGUCACCUGUGCAGCU-3'    (SEQ ID NO: 3486)
                   3'-CUAUAUUUACACCAGUGGACACGUCGA-5'  (SEQ ID NO: 1268)
βc-1531 Target:    5'-GATATAAATGTGGTCACCTGTGCAGCT-3'  (SEQ ID NO: 2377)
                   5'-AUAAAUGUGGUCACCUGUGCAGCUG-3'    (SEQ ID NO: 3487)
                   3'-UAUAUUUACACCAGUGGACACGUCGAC-5'  (SEQ ID NO: 1269)
βc-1532 Target:    5'-ATATAAATGTGGTCACCTGTGCAGCTG-3'  (SEQ ID NO: 2378)
                   5'-UAAAUGUGGUCACCUGUGCAGCUGG-3'    (SEQ ID NO: 3488)
                   3'-AUAUUUACACCAGUGGACACGUCGACC-5'  (SEQ ID NO: 1270)
βc-1533 Target:    5'-TATAAATGTGGTCACCTGTGCAGCTGG-3'  (SEQ ID NO: 2379)
                   5'-AAAUGUGGUCACCUGUGCAGCUGGA-3'    (SEQ ID NO: 3489)
                   3'-UAUUUACACCAGUGGACACGUCGACCU-5'  (SEQ ID NO: 1271)
βc-1534 Target:    5'-ATAAATGTGGTCACCTGTGCAGCTGGA-3'  (SEQ ID NO: 2380)
                   5'-AAUGUGGUCACCUGUGCAGCUGGAA-3'    (SEQ ID NO: 3490)
                   3'-AUUUACACCAGUGGACACGUCGACCUU-5'  (SEQ ID NO: 1272)
βc-1535 Target:    5'-TAAATGTGGTCACCTGTGCAGCTGGAA-3'  (SEQ ID NO: 2381)
                   5'-AUGUGGUCACCUGUGCAGCUGGAAU-3'    (SEQ ID NO: 3491)
                   3'-UUUACACCAGUGGACACGUCGACCUUA-5'  (SEQ ID NO: 1273)
βc-1536 Target:    5'-AAATGTGGTCACCTGTGCAGCTGGAAT-3'  (SEQ ID NO: 2382)
```

TABLE 6-continued

Selected Anti-β-catenin DsiRNA Agents, Unmodified Duplexes

|  |  |  |  |
|---|---|---|---|
|  | 5'-UGUGGUCACCUGUGCAGCUGGAAUU-3' | (SEQ ID NO: 3492) |  |
|  | 3'-UUACACCAGUGGACACGUCGACCUUAA-5' | (SEQ ID NO: 1274) |  |
| βc-1537 Target: | 5'-AATGTGGTCACCTGTGCAGCTGGAATT-3' | (SEQ ID NO: 2383) |  |
|  | 5'-GUGGUCACCUGUGCAGCUGGAAUUC-3' | (SEQ ID NO: 3493) |  |
|  | 3'-UACACCAGUGGACACGUCGACCUUAAG-5' | (SEQ ID NO: 1275) |  |
| βc-1538 Target: | 5'-ATGTGGTCACCTGTGCAGCTGGAATTC-3' | (SEQ ID NO: 2384) |  |
|  | 5'-UGGUCACCUGUGCAGCUGGAAUUCU-3' | (SEQ ID NO: 3494) |  |
|  | 3'-ACACCAGUGGACACGUCGACCUUAAGA-5' | (SEQ ID NO: 1276) |  |
| βc-1539 Target: | 5'-TGTGGTCACCTGTGCAGCTGGAATTCT-3' | (SEQ ID NO: 2385) |  |
|  | 5'-GGUCACCUGUGCAGCUGGAAUUCUU-3' | (SEQ ID NO: 3495) |  |
|  | 3'-CACCAGUGGACACGUCGACCUUAAGAA-5' | (SEQ ID NO: 1277) |  |
| βc-1540 Target: | 5'-GTGGTCACCTGTGCAGCTGGAATTCTT-3' | (SEQ ID NO: 2386) |  |
|  | 5'-GUCACCUGUGCAGCUGGAAUUCUUU-3' | (SEQ ID NO: 3496) |  |
|  | 3'-ACCAGUGGACACGUCGACCUUAAGAAA-5' | (SEQ ID NO: 1278) |  |
| βc-1541 Target: | 5'-TGGTCACCTGTGCAGCTGGAATTCTTT-3' | (SEQ ID NO: 2387) |  |
|  | 5'-UCACCUGUGCAGCUGGAAUUCUUUC-3' | (SEQ ID NO: 3497) |  |
|  | 3'-CCAGUGGACACGUCGACCUUAAGAAAG-5' | (SEQ ID NO: 1279) |  |
| βc-1542 Target: | 5'-GGTCACCTGTGCAGCTGGAATTCTTTC-3' | (SEQ ID NO: 2388) |  |
|  | 5'-CACCUGUGCAGCUGGAAUUCUUUCU-3' | (SEQ ID NO: 3498) |  |
|  | 3'-CAGUGGACACGUCGACCUUAAGAAAGA-5' | (SEQ ID NO: 1280) |  |
| βc-1543 Target: | 5'-GTCACCTGTGCAGCTGGAATTCTTTCT-3' | (SEQ ID NO: 2389) |  |
|  | 5'-ACCUGUGCAGCUGGAAUUCUUUCUA-3' | (SEQ ID NO: 3499) |  |
|  | 3'-AGUGGACACGUCGACCUUAAGAAAGAU-5' | (SEQ ID NO: 1281) |  |
| βc-1544 Target: | 5'-TCACCTGTGCAGCTGGAATTCTTTCTA-3' | (SEQ ID NO: 2390) |  |
|  | 5'-CCUGUGCAGCUGGAAUUCUUUCUAA-3' | (SEQ ID NO: 3500) |  |
|  | 3'-GUGGACACGUCGACCUUAAGAAAGAUU-5' | (SEQ ID NO: 1282) |  |
| βc-1545 Target: | 5'-CACCTGTGCAGCTGGAATTCTTTCTAA-3' | (SEQ ID NO: 2391) |  |
|  | 5'-UCUAACCUCACUUGCAAUAAUUAUA-3' | (SEQ ID NO: 3501) |  |
|  | 3'-AAAGAUUGGAGUGAACGUUAUUAAUAU-5' | (SEQ ID NO: 1283) |  |
| βc-1565 Target: | 5'-TTTCTAACCTCACTTGCAATAATTATA-3' | (SEQ ID NO: 2392) |  |
|  | 5'-CUAACCUCACUUGCAAUAAUUAUAA-3' | (SEQ ID NO: 3502) |  |
|  | 3'-AAGAUUGGAGUGAACGUUAUUAAUAUU-5' | (SEQ ID NO: 1284) |  |
| βc-1566 Target: | 5'-TTCTAACCTCACTTGCAATAATTATAA-3' | (SEQ ID NO: 2393) |  |
|  | 5'-UAACCUCACUUGCAAUAAUUAUAAG-3' | (SEQ ID NO: 3503) |  |
|  | 3'-AGAUUGGAGUGAACGUUAUUAAUAUUC-5' | (SEQ ID NO: 1285) |  |
| βc-1567 Target: | 5'-TCTAACCTCACTTGCAATAATTATAAG-3' | (SEQ ID NO: 2394) |  |
|  | 5'-AACCUCACUUGCAAUAAUUAUAAGA-3' | (SEQ ID NO: 3504) |  |
|  | 3'-GAUUGGAGUGAACGUUAUUAAUAUUCU-5' | (SEQ ID NO: 1286) |  |
| βc-1568 Target: | 5'-CTAACCTCACTTGCAATAATTATAAGA-3' | (SEQ ID NO: 2395) |  |

TABLE 6-continued

Selected Anti-β-catenin DsiRNA Agents, Unmodified Duplexes

|  |  |  |
|---|---|---|
|  | 5'-ACCUCACUUGCAAUAAUUAUAAGAA-3' | (SEQ ID NO: 3505) |
|  | 3'-AUUGGAGUGAACGUUAUUAAUAUUCUU-5' | (SEQ ID NO: 1287) |
| βc-1569 Target: | 5'-TAACCTCACTTGCAATAATTATAAGAA-3' | (SEQ ID NO: 2396) |
|  | 5'-GCUGGUGACAGGGAAGACAUCACUG-3' | (SEQ ID NO: 3506) |
|  | 3'-CCCGACCACUGUCCCUUCUGUAGUGAC-5' | (SEQ ID NO: 1288) |
| βc-1652 Target: | 5'-GGGCTGGTGACAGGGAAGACATCACTG-3' | (SEQ ID NO: 2397) |
|  | 5'-CUGGUGACAGGGAAGACAUCACUGA-3' | (SEQ ID NO: 3507) |
|  | 3'-CCGACCACUGUCCCUUCUGUAGUGACU-5' | (SEQ ID NO: 1289) |
| βc-1653 Target: | 5'-GGCTGGTGACAGGGAAGACATCACTGA-3' | (SEQ ID NO: 2398) |
|  | 5'-UGGUGACAGGGAAGACAUCACUGAG-3' | (SEQ ID NO: 3508) |
|  | 3'-CGACCACUGUCCCUUCUGUAGUGACUC-5' | (SEQ ID NO: 1290) |
| βc-1654 Target: | 5'-GCTGGTGACAGGGAAGACATCACTGAG-3' | (SEQ ID NO: 2399) |
|  | 5'-GGUGACAGGGAAGACAUCACUGAGC-3' | (SEQ ID NO: 3509) |
|  | 3'-GACCACUGUCCCUUCUGUAGUGACUCG-5' | (SEQ ID NO: 1291) |
| βc-1655 Target: | 5'-CTGGTGACAGGGAAGACATCACTGAGC-3' | (SEQ ID NO: 2400) |
|  | 5'-GUGACAGGGAAGACAUCACUGAGCC-3' | (SEQ ID NO: 3510) |
|  | 3'-ACCACUGUCCCUUCUGUAGUGACUCGG-5' | (SEQ ID NO: 1292) |
| βc-1656 Target: | 5'-TGGTGACAGGGAAGACATCACTGAGCC-3' | (SEQ ID NO: 2401) |
|  | 5'-UGACAGGGAAGACAUCACUGAGCCU-3' | (SEQ ID NO: 3511) |
|  | 3'-CCACUGUCCCUUCUGUAGUGACUCGGA-5' | (SEQ ID NO: 1293) |
| βc-1657 Target: | 5'-GGTGACAGGGAAGACATCACTGAGCCT-3' | (SEQ ID NO: 2402) |
|  | 5'-GACAGGGAAGACAUCACUGAGCCUG-3' | (SEQ ID NO: 3512) |
|  | 3'-CACUGUCCCUUCUGUAGUGACUCGGAC-5' | (SEQ ID NO: 1294) |
| βc-1658 Target: | 5'-GTGACAGGGAAGACATCACTGAGCCTG-3' | (SEQ ID NO: 2403) |
|  | 5'-ACAGGGAAGACAUCACUGAGCCUGC-3' | (SEQ ID NO: 3513) |
|  | 3'-ACUGUCCCUUCUGUAGUGACUCGGACG-5' | (SEQ ID NO: 1295) |
| βc-1659 Target: | 5'-TGACAGGGAAGACATCACTGAGCCTGC-3' | (SEQ ID NO: 2404) |
|  | 5'-CAGGGAAGACAUCACUGAGCCUGCC-3' | (SEQ ID NO: 3514) |
|  | 3'-CUGUCCCUUCUGUAGUGACUCGGACGG-5' | (SEQ ID NO: 1296) |
| βc-1660 Target: | 5'-GACAGGGAAGACATCACTGAGCCTGCC-3' | (SEQ ID NO: 2405) |
|  | 5'-AGGGAAGACAUCACUGAGCCUGCCA-3' | (SEQ ID NO: 3515) |
|  | 3'-UGUCCCUUCUGUAGUGACUCGGACGGU-5' | (SEQ ID NO: 1297) |
| βc-1661 Target: | 5'-ACAGGGAAGACATCACTGAGCCTGCCA-3' | (SEQ ID NO: 2406) |
|  | 5'-GGGAAGACAUCACUGAGCCUGCCAU-3' | (SEQ ID NO: 3516) |
|  | 3'-GUCCCUUCUGUAGUGACUCGGACGGUA-5' | (SEQ ID NO: 1298) |
| βc-1662 Target: | 5'-CAGGGAAGACATCACTGAGCCTGCC-3' | (SEQ ID NO: 2407) |
|  | 5'-GGAAGACAUCACUGAGCCUGCCAUC-3' | (SEQ ID NO: 3517) |
|  | 3'-UCCCUUCUGUAGUGACUCGGACGGUAG-5' | (SEQ ID NO: 1299) |
| βc-1663 Target: | 5'-AGGGAAGACATCACTGAGCCTGCCATC-3' | (SEQ ID NO: 2408) |

TABLE 6-continued

Selected Anti-β-catenin DsiRNA Agents, Unmodified Duplexes

|  |  |  |  |
|---|---|---|---|
|  | 5'-GAAGACAUCACUGAGCCUGCCAUCU-3' | (SEQ ID NO: 3518) |  |
|  | 3'-CCCUUCUGUAGUGACUCGGACGGUAGA-5' | (SEQ ID NO: 1300) |  |
| βc-1664 Target: | 5'-GGGAAGACATCACTGAGCCTGCCATCT-3' | (SEQ ID NO: 2409) |  |
|  | 5'-AAGACAUCACUGAGCCUGCCAUCUG-3' | (SEQ ID NO: 3519) |  |
|  | 3'-CCUUCUGUAGUGACUCGGACGGUAGAC-5' | (SEQ ID NO: 1301) |  |
| βc-1665 Target: | 5'-GGAAGACATCACTGAGCCTGCCATCTG-3' | (SEQ ID NO: 2410) |  |
|  | 5'-AGACAUCACUGAGCCUGCCAUCUGU-3' | (SEQ ID NO: 3520) |  |
|  | 3'-CUUCUGUAGUGACUCGGACGGUAGACA-5' | (SEQ ID NO: 1302) |  |
| βc-1666 Target: | 5'-GAAGACATCACTGAGCCTGCCATCTGT-3' | (SEQ ID NO: 2411) |  |
|  | 5'-GACAUCACUGAGCCUGCCAUCUGUG-3' | (SEQ ID NO: 3521) |  |
|  | 3'-UUCUGUAGUGACUCGGACGGUAGACAC-5' | (SEQ ID NO: 1303) |  |
| βc-1667 Target: | 5'-AAGACATCACTGAGCCTGCCATCTGTG-3' | (SEQ ID NO: 2412) |  |
|  | 5'-ACAUCACUGAGCCUGCCAUCUGUGC-3' | (SEQ ID NO: 3522) |  |
|  | 3'-UCUGUAGUGACUCGGACGGUAGACACG-5' | (SEQ ID NO: 1304) |  |
| βc-1668 Target: | 5'-AGACATCACTGAGCCTGCCATCTGTGC-3' | (SEQ ID NO: 2413) |  |
|  | 5'-CAUCACUGAGCCUGCCAUCUGUGCU-3' | (SEQ ID NO: 3523) |  |
|  | 3'-CUGUAGUGACUCGGACGGUAGACACGA-5' | (SEQ ID NO: 1305) |  |
| βc-1669 Target: | 5'-GACATCACTGAGCCTGCCATCTGTGCT-3' | (SEQ ID NO: 2414) |  |
|  | 5'-AUCACUGAGCCUGCCAUCUGUGCUC-3' | (SEQ ID NO: 3524) |  |
|  | 3'-UGUAGUGACUCGGACGGUAGACACGAG-5' | (SEQ ID NO: 1306) |  |
| βc-1670 Target: | 5'-ACATCACTGAGCCTGCCATCTGTGCTC-3' | (SEQ ID NO: 2415) |  |
|  | 5'-UCACUGAGCCUGCCAUCUGUGCUCU-3' | (SEQ ID NO: 3525) |  |
|  | 3'-GUAGUGACUCGGACGGUAGACACGAGA-5' | (SEQ ID NO: 1307) |  |
| βc-1671 Target: | 5'-CATCACTGAGCCTGCCATCTGTGCTCT-3' | (SEQ ID NO: 2416) |  |
|  | 5'-CACUGAGCCUGCCAUCUGUGCUCUU-3' | (SEQ ID NO: 3526) |  |
|  | 3'-UAGUGACUCGGACGGUAGACACGAGAA-5' | (SEQ ID NO: 1308) |  |
| βc-1672 Target: | 5'-ATCACTGAGCCTGCCATCTGTGCTCTT-3' | (SEQ ID NO: 2417) |  |
|  | 5'-ACUGAGCCUGCCAUCUGUGCUCUUC-3' | (SEQ ID NO: 3527) |  |
|  | 3'-AGUGACUCGGACGGUAGACACGAGAAG-5' | (SEQ ID NO: 1309) |  |
| βc-1673 Target: | 5'-TCACTGAGCCTGCCATCTGTGCTCTTC-3' | (SEQ ID NO: 2418) |  |
|  | 5'-CUGAGCCUGCCAUCUGUGCUCUUCG-3' | (SEQ ID NO: 3528) |  |
|  | 3'-GUGACUCGGACGGUAGACACGAGAAGC-5' | (SEQ ID NO: 1310) |  |
| βc-1674 Target: | 5'-CACTGAGCCTGCCATCTGTGCTCTTCG-3' | (SEQ ID NO: 2419) |  |
|  | 5'-UGAGCCUGCCAUCUGUGCUCUUCGU-3' | (SEQ ID NO: 3529) |  |
|  | 3'-UGACUCGGACGGUAGACACGAGAAGCA-5' | (SEQ ID NO: 1311) |  |
| βc-1675 Target: | 5'-ACTGAGCCTGCCATCTGTGCTCTTCGT-3' | (SEQ ID NO: 2420) |  |
|  | 5'-GAGCCUGCCAUCUGUGCUCUUCGUC-3' | (SEQ ID NO: 3530) |  |
|  | 3'-GACUCGGACGGUAGACACGAGAAGCAG-5' | (SEQ ID NO: 1312) |  |
| βc-1676 Target: | 5'-CTGAGCCTGCCATCTGTGCTCTTCGTC-3' | (SEQ ID NO: 2421) |  |

TABLE 6-continued

Selected Anti-β-catenin DsiRNA Agents, Unmodified Duplexes

|  |  |  |  |
|---|---|---|---|
|  | 5'-AGCCUGCCAUCUGUGCUCUUCGUCA-3' | (SEQ ID NO: 3531) |  |
|  | 3'-ACUCGGACGGUAGACACGAGAAGCAGU-5' | (SEQ ID NO: 1313) |  |
| βc-1677 Target: | 5'-TGAGCCTGCCATCTGTGCTCTTCGTCA-3' | (SEQ ID NO: 2422) |  |
|  | 5'-GCCUGCCAUCUGUGCUCUUCGUCAU-3' | (SEQ ID NO: 3532) |  |
|  | 3'-CUCGGACGGUAGACACGAGAAGCAGUA-5' | (SEQ ID NO: 1314) |  |
| βc-1678 Target: | 5'-GAGCCTGCCATCTGTGCTCTTCGTC-3' | (SEQ ID NO: 2423) |  |
|  | 5'-CCUGCCAUCUGUGCUCUUCGUCAUC-3' | (SEQ ID NO: 3533) |  |
|  | 3'-UCGGACGGUAGACACGAGAAGCAGUAG-5' | (SEQ ID NO: 1315) |  |
| βc-1679 Target: | 5'-AGCCTGCCATCTGTGCTCTTCGTCATC-3' | (SEQ ID NO: 2424) |  |
|  | 5'-CUGCCAUCUGUGCUCUUCGUCAUCU-3' | (SEQ ID NO: 3534) |  |
|  | 3'-CGGACGGUAGACACGAGAAGCAGUAGA-5' | (SEQ ID NO: 1316) |  |
| βc-1680 Target: | 5'-GCCTGCCATCTGTGCTCTTCGTCATCT-3' | (SEQ ID NO: 2425) |  |
|  | 5'-UGCCAUCUGUGCUCUUCGUCAUCUG-3' | (SEQ ID NO: 3535) |  |
|  | 3'-GGACGGUAGACACGAGAAGCAGUAGAC-5' | (SEQ ID NO: 1317) |  |
| βc-1681 Target: | 5'-CCTGCCATCTGTGCTCTTCGTCATCTG-3' | (SEQ ID NO: 2426) |  |
|  | 5'-GCCAUCUGUGCUCUUCGUCAUCUGA-3' | (SEQ ID NO: 3536) |  |
|  | 3'-GACGGUAGACACGAGAAGCAGUAGACU-5' | (SEQ ID NO: 1318) |  |
| βc-1682 Target: | 5'-CTGCCATCTGTGCTCTTCGTCATCTGA-3' | (SEQ ID NO: 2427) |  |
|  | 5'-CCAUCUGUGCUCUUCGUCAUCUGAC-3' | (SEQ ID NO: 3537) |  |
|  | 3'-ACGGUAGACACGAGAAGCAGUAGACUG-5' | (SEQ ID NO: 1319) |  |
| βc-1683 Target: | 5'-TGCCATCTGTGCTCTTCGTCATCTGAC-3' | (SEQ ID NO: 2428) |  |
|  | 5'-CAUCUGUGCUCUUCGUCAUCUGACC-3' | (SEQ ID NO: 3538) |  |
|  | 3'-CGGUAGACACGAGAAGCAGUAGACUGG-5' | (SEQ ID NO: 1320) |  |
| βc-1684 Target: | 5'-GCCATCTGTGCTCTTCGTCATCTGACC-3' | (SEQ ID NO: 2429) |  |
|  | 5'-AUCUGUGCUCUUCGUCAUCUGACCA-3' | (SEQ ID NO: 3539) |  |
|  | 3'-GGUAGACACGAGAAGCAGUAGACUGGU-5' | (SEQ ID NO: 1321) |  |
| βc-1685 Target: | 5'-CCATCTGTGCTCTTCGTCATCTGACCA-3' | (SEQ ID NO: 2430) |  |
|  | 5'-UCUGUGCUCUUCGUCAUCUGACCAG-3' | (SEQ ID NO: 3540) |  |
|  | 3'-GUAGACACGAGAAGCAGUAGACUGGUC-5' | (SEQ ID NO: 1322) |  |
| βc-1686 Target: | 5'-CATCTGTGCTCTTCGTCATCTGACCAG-3' | (SEQ ID NO: 2431) |  |
|  | 5'-CUGUGCUCUUCGUCAUCUGACCAGC-3' | (SEQ ID NO: 3541) |  |
|  | 3'-UAGACACGAGAAGCAGUAGACUGGUCG-5' | (SEQ ID NO: 1323) |  |
| βc-1687 Target: | 5'-ATCTGTGCTCTTCGTCATCTGACCAGC-3' | (SEQ ID NO: 2432) |  |
|  | 5'-UGUGCUCUUCGUCAUCUGACCAGCC-3' | (SEQ ID NO: 3542) |  |
|  | 3'-AGACACGAGAAGCAGUAGACUGGUCGG-5' | (SEQ ID NO: 1324) |  |
| βc-1688 Target: | 5'-TCTGTGCTCTTCGTCATCTGACCAGCC-3' | (SEQ ID NO: 2433) |  |
|  | 5'-GUGCUCUUCGUCAUCUGACCAGCCG-3' | (SEQ ID NO: 3543) |  |
|  | 3'-GACACGAGAAGCAGUAGACUGGUCGGC-5' | (SEQ ID NO: 1325) |  |
| βc-1689 Target: | 5'-CTGTGCTCTTCGTCATCTGACCAGCCG-3' | (SEQ ID NO: 2434) |  |

TABLE 6-continued

Selected Anti-β-catenin DsiRNA Agents, Unmodified Duplexes

```
                    5'-UGCUCUUCGUCAUCUGACCAGCCGA-3'       (SEQ ID NO: 3544)
                    3'-ACACGAGAAGCAGUAGACUGGUCGGCU-5'     (SEQ ID NO: 1326)
βc-1690 Target:     5'-TGTGCTCTTCGTCATCTGACCAGCCGA-3'     (SEQ ID NO: 2435)
                    5'-GCUCUUCGUCAUCUGACCAGCCGAC-3'      (SEQ ID NO: 3545)
                    3'-CACGAGAAGCAGUAGACUGGUCGGCUG-5'     (SEQ ID NO: 1327)
βc-1691 Target:     5'-GTGCTCTTCGTCATCTGACCAGCCGAC-3'     (SEQ ID NO: 2436)
                    5'-CUCUUCGUCAUCUGACCAGCCGACA-3'      (SEQ ID NO: 3546)
                    3'-ACGAGAAGCAGUAGACUGGUCGGCUGU-5'     (SEQ ID NO: 1328)
βc-1692 Target:     5'-TGCTCTTCGTCATCTGACCAGCCGACA-3'     (SEQ ID NO: 2437)
                    5'-UCUUCGUCAUCUGACCAGCCGACAC-3'      (SEQ ID NO: 3547)
                    3'-CGAGAAGCAGUAGACUGGUCGGCUGUG-5'     (SEQ ID NO: 1329)
βc-1693 Target:     5'-GCTCTTCGTCATCTGACCAGCCGACAC-3'     (SEQ ID NO: 2438)
                    5'-CUUCGUCAUCUGACCAGCCGACACC-3'      (SEQ ID NO: 3548)
                    3'-GAGAAGCAGUAGACUGGUCGGCUGUGG-5'     (SEQ ID NO: 1330)
βc-1694 Target:     5'-CTCTTCGTCATCTGACCAGCCGACACC-3'     (SEQ ID NO: 2439)
                    5'-UUCGUCAUCUGACCAGCCGACACCA-3'      (SEQ ID NO: 3549)
                    3'-AGAAGCAGUAGACUGGUCGGCUGUGGU-5'     (SEQ ID NO: 1331)
βc-1695 Target:     5'-TCTTCGTCATCTGACCAGCCGACACCA-3'     (SEQ ID NO: 2440)
                    5'-CACCCACCAUCCCACUGGCCUCUGA-3'      (SEQ ID NO: 3550)
                    3'-AUGUGGGUGGUAGGGUGACCGGAGACU-5'     (SEQ ID NO: 1332)
βc-1787 Target:     5'-TACACCCACCATCCCACTGGCCTCTGA-3'     (SEQ ID NO: 2441)
                    5'-ACCCACCAUCCCACUGGCCUCUGAU-3'      (SEQ ID NO: 3551)
                    3'-UGUGGGUGGUAGGGUGACCGGAGACUA-5'     (SEQ ID NO: 1333)
βc-1788 Target:     5'-ACACCCACCATCCCACTGGCCTCTGAT-3'     (SEQ ID NO: 2442)
                    5'-CCCACCAUCCCACUGGCCUCUGAUA-3'      (SEQ ID NO: 3552)
                    3'-GUGGGUGGUAGGGUGACCGGAGACUAU-5'     (SEQ ID NO: 1334)
βc-1789 Target:     5'-CACCCACCATCCCACTGGCCTCTGATA-3'     (SEQ ID NO: 2443)
                    5'-CCACCAUCCCACUGGCCUCUGAUAA-3'      (SEQ ID NO: 3553)
                    3'-UGGGUGGUAGGGUGACCGGAGACUAUU-5'     (SEQ ID NO: 1335)
βc-1790 Target:     5'-ACCCACCATCCCACTGGCCTCTGATAA-3'     (SEQ ID NO: 2444)
                    5'-CACCAUCCCACUGGCCUCUGAUAAA-3'      (SEQ ID NO: 3554)
                    3'-GGGUGGUAGGGUGACCGGAGACUAUUU-5'     (SEQ ID NO: 1336)
βc-1791 Target:     5'-CCCACCATCCCACTGGCCTCTGATAAA-3'     (SEQ ID NO: 2445)
                    5'-ACCAUCCCACUGGCCUCUGAUAAAG-3'      (SEQ ID NO: 3555)
                    3'-GGUGGUAGGGUGACCGGAGACUAUUUC-5'     (SEQ ID NO: 1337)
βc-1792 Target:     5'-CCACCATCCCACTGGCCTCTGATAAAG-3'     (SEQ ID NO: 2446)
                    5'-CCAUCCCACUGGCCUCUGAUAAAGG-3'      (SEQ ID NO: 3556)
                    3'-GUGGUAGGGUGACCGGAGACUAUUUCC-5'     (SEQ ID NO: 1338)
βc-1793 Target:     5'-CACCATCCCACTGGCCTCTGATAAAGG-3'     (SEQ ID NO: 2447)
```

TABLE 6-continued

Selected Anti-β-catenin DsiRNA Agents, Unmodified Duplexes

|  |  |  |  |
|---|---|---|---|
|  | 5'-CAUCCCACUGGCCUCUGAUAAAGGC-3' | (SEQ ID NO: 3557) |  |
|  | 3'-UGGUAGGGUGACCGGAGACUAUUUCCG-5' | (SEQ ID NO: 1339) |  |
| βc-1794 Target: | 5'-ACCATCCCACTGGCCTCTGATAAAGGC-3' | (SEQ ID NO: 2448) |  |
|  | 5'-AUCCCACUGGCCUCUGAUAAAGGCU-3' | (SEQ ID NO: 3558) |  |
|  | 3'-GGUAGGGUGACCGGAGACUAUUUCCGA-5' | (SEQ ID NO: 1340) |  |
| βc-1795 Target: | 5'-CCATCCCACTGGCCTCTGATAAAGGCT-3' | (SEQ ID NO: 2449) |  |
|  | 5'-UCCCACUGGCCUCUGAUAAAGGCUA-3' | (SEQ ID NO: 3559) |  |
|  | 3'-GUAGGGUGACCGGAGACUAUUUCCGAU-5' | (SEQ ID NO: 1341) |  |
| βc-1796 Target: | 5'-CATCCCACTGGCCTCTGATAAAGGCTA-3' | (SEQ ID NO: 2450) |  |
|  | 5'-CCCACUGGCCUCUGAUAAAGGCUAC-3' | (SEQ ID NO: 3560) |  |
|  | 3'-UAGGGUGACCGGAGACUAUUUCCGAUG-5' | (SEQ ID NO: 1342) |  |
| βc-1797 Target: | 5'-ATCCCACTGGCCTCTGATAAAGGCTAC-3' | (SEQ ID NO: 2451) |  |
|  | 5'-CCACUGGCCUCUGAUAAAGGCUACU-3' | (SEQ ID NO: 3561) |  |
|  | 3'-AGGGUGACCGGAGACUAUUUCCGAUGA-5' | (SEQ ID NO: 1343) |  |
| βc-1798 Target: | 5'-TCCCACTGGCCTCTGATAAAGGCTACT-3' | (SEQ ID NO: 2452) |  |
|  | 5'-CACUGGCCUCUGAUAAAGGCUACUG-3' | (SEQ ID NO: 3562) |  |
|  | 3'-GGGUGACCGGAGACUAUUUCCGAUGAC-5' | (SEQ ID NO: 1344) |  |
| βc-1799 Target: | 5'-CCCACTGGCCTCTGATAAAGGCTACTG-3' | (SEQ ID NO: 2453) |  |
|  | 5'-ACUGGCCUCUGAUAAAGGCUACUGU-3' | (SEQ ID NO: 3563) |  |
|  | 3'-GGUGACCGGAGACUAUUUCCGAUGACA-5' | (SEQ ID NO: 1345) |  |
| βc-1800 Target: | 5'-CCACTGGCCTCTGATAAAGGCTACTGT-3' | (SEQ ID NO: 2454) |  |
|  | 5'-ACUGUUGGAUUGAUUCGAAAUCUUG-3' | (SEQ ID NO: 3564) |  |
|  | 3'-GAUGACAACCUAACUAAGCUUUAGAAC-5' | (SEQ ID NO: 1346) |  |
| βc-1820 Target: | 5'-CTACTGTTGGATTGATTCGAAATCTTG-3' | (SEQ ID NO: 2455) |  |
|  | 5'-CUGUUGGAUUGAUUCGAAAUCUUGC-3' | (SEQ ID NO: 3565) |  |
|  | 3'-AUGACAACCUAACUAAGCUUUAGAACG-5' | (SEQ ID NO: 1347) |  |
| βc-1821 Target: | 5'-TACTGTTGGATTGATTCGAAATCTTGC-3' | (SEQ ID NO: 2456) |  |
|  | 5'-AAUACCAUUCCAUUGUUUGUGCAGC-3' | (SEQ ID NO: 3566) |  |
|  | 3'-AUUUAUGGUAAGGUAACAAACACGUCG-5' | (SEQ ID NO: 1348) |  |
| βc-2072 Target: | 5'-TAAATACCATTCCATTGTTTGTGCAGC-3' | (SEQ ID NO: 2457) |  |
|  | 5'-AUACCAUUCCAUUGUUUGUGCAGCU-3' | (SEQ ID NO: 3567) |  |
|  | 3'-UUUAUGGUAAGGUAACAAACACGUCGA-5' | (SEQ ID NO: 1349) |  |
| βc-2073 Target: | 5'-AAATACCATTCCATTGTTTGTGCAGCT-3' | (SEQ ID NO: 2458) |  |
|  | 5'-UACCAUUCCAUUGUUUGUGCAGCUG-3' | (SEQ ID NO: 3568) |  |
|  | 3'-UUAUGGUAAGGUAACAAACACGUCGAC-5' | (SEQ ID NO: 1350) |  |
| βc-2074 Target: | 5'-AATACCATTCCATTGTTTGTGCAGCTG-3' | (SEQ ID NO: 2459) |  |
|  | 5'-ACCAUUCCAUUGUUUGUGCAGCUGC-3' | (SEQ ID NO: 3569) |  |
|  | 3'-UAUGGUAAGGUAACAAACACGUCGACG-5' | (SEQ ID NO: 1351) |  |
| βc-2075 Target: | 5'-ATACCATTCCATTGTTTGTGCAGCTGC-3' | (SEQ ID NO: 2460) |  |

TABLE 6-continued

Selected Anti-β-catenin DsiRNA Agents, Unmodified Duplexes

|  |  |  |  |
|---|---|---|---|
|  | 5'-CCAUUCCAUUGUUUGUGCAGCUGCU-3' | (SEQ ID NO: 3570) |  |
|  | 3'-AUGGUAAGGUAACAAACACGUCGACGA-5' | (SEQ ID NO: 1352) |  |
| βc-2076 Target: | 5'-TACCATTCCATTGTTTGTGCAGCTGCT-3' | (SEQ ID NO: 2461) |  |
|  | 5'-CAUUCCAUUGUUUGUGCAGCUGCUU-3' | (SEQ ID NO: 3571) |  |
|  | 3'-UGGUAAGGUAACAAACACGUCGACGAA-5' | (SEQ ID NO: 1353) |  |
| βc-2077 Target: | 5'-ACCATTCCATTGTTTGTGCAGCTGCTT-3' | (SEQ ID NO: 2462) |  |
|  | 5'-UGCUUUAUUCUCCCAUUGAAAACAU-3' | (SEQ ID NO: 3572) |  |
|  | 3'-CGACGAAAUAAGAGGGUAACUUUUGUA-5' | (SEQ ID NO: 1354) |  |
| βc-2097 Target: | 5'-GCTGCTTTATTCTCCCATTGAAAAC-3' | (SEQ ID NO: 2463) |  |
|  | 5'-GCUUUAUUCUCCCAUUGAAAACAUC-3' | (SEQ ID NO: 3573) |  |
|  | 3'-GACGAAAUAAGAGGGUAACUUUUGUAG-5' | (SEQ ID NO: 1355) |  |
| βc-2098 Target: | 5'-CTGCTTTATTCTCCCATTGAAAACATC-3' | (SEQ ID NO: 2464) |  |
|  | 5'-CUUUAUUCUCCCAUUGAAAACAUCC-3' | (SEQ ID NO: 3574) |  |
|  | 3'-ACGAAAUAAGAGGGUAACUUUUGUAGG-5' | (SEQ ID NO: 1356) |  |
| βc-2099 Target: | 5'-TGCTTTATTCTCCCATTGAAAACATCC-3' | (SEQ ID NO: 2465) |  |
|  | 5'-UUUAUUCUCCCAUUGAAAACAUCCA-3' | (SEQ ID NO: 3575) |  |
|  | 3'-CGAAAUAAGAGGGUAACUUUUGUAGGU-5' | (SEQ ID NO: 1357) |  |
| βc-2100 Target: | 5'-GCTTTATTCTCCCATTGAAAACATCCA-3' | (SEQ ID NO: 2466) |  |
|  | 5'-GUCCUCUGUGAACUUGCUCAGGACA-3' | (SEQ ID NO: 3576) |  |
|  | 3'-CCCAGGAGACACUUGAACGAGUCCUGU-5' | (SEQ ID NO: 1358) |  |
| βc-2141 Target: | 5'-GGGTCCTCTGTGAACTTGCTCAGGACA-3' | (SEQ ID NO: 2467) |  |
|  | 5'-UCCUCUGUGAACUUGCUCAGGACAA-3' | (SEQ ID NO: 3577) |  |
|  | 3'-CCAGGAGACACUUGAACGAGUCCUGUU-5' | (SEQ ID NO: 1359) |  |
| βc-2142 Target: | 5'-GGTCCTCTGTGAACTTGCTCAGGACAA-3' | (SEQ ID NO: 2468) |  |
|  | 5'-CCUCUGUGAACUUGCUCAGGACAAG-3' | (SEQ ID NO: 3578) |  |
|  | 3'-CAGGAGACACUUGAACGAGUCCUGUUC-5' | (SEQ ID NO: 1360) |  |
| βc-2143 Target: | 5'-GTCCTCTGTGAACTTGCTCAGGACAAG-3' | (SEQ ID NO: 2469) |  |
|  | 5'-CUCUGUGAACUUGCUCAGGACAAGG-3' | (SEQ ID NO: 3579) |  |
|  | 3'-AGGAGACACUUGAACGAGUCCUGUUCC-5' | (SEQ ID NO: 1361) |  |
| βc-2144 Target: | 5'-TCCTCTGTGAACTTGCTCAGGACAAGG-3' | (SEQ ID NO: 2470) |  |
|  | 5'-UCUGUGAACUUGCUCAGGACAAGGA-3' | (SEQ ID NO: 3580) |  |
|  | 3'-GGAGACACUUGAACGAGUCCUGUUCCU-5' | (SEQ ID NO: 1362) |  |
| βc-2145 Target: | 5'-CCTCTGTGAACTTGCTCAGGACAAGGA-3' | (SEQ ID NO: 2471) |  |
|  | 5'-CUGUGAACUUGCUCAGGACAAGGAA-3' | (SEQ ID NO: 3581) |  |
|  | 3'-GAGACACUUGAACGAGUCCUGUUCCUU-5' | (SEQ ID NO: 1363) |  |
| βc-2146 Target: | 5'-CTCTGTGAACTTGCTCAGGACAAGGAA-3' | (SEQ ID NO: 2472) |  |
|  | 5'-UGUGAACUUGCUCAGGACAAGGAAG-3' | (SEQ ID NO: 3582) |  |
|  | 3'-AGACACUUGAACGAGUCCUGUUCCUUC-5' | (SEQ ID NO: 1364) |  |
| βc-2147 Target: | 5'-TCTGTGAACTTGCTCAGGACAAGGAAG-3' | (SEQ ID NO: 2473) |  |

TABLE 6-continued

Selected Anti-β-catenin DsiRNA Agents, Unmodified Duplexes

|  |  |  |  |
|---|---|---|---|
|  | 5'-GUGAACUUGCUCAGGACAAGGAAGC-3' | (SEQ ID NO: 3583) |  |
|  | 3'-GACACUUGAACGAGUCCUGUUCCUUCG-5' | (SEQ ID NO: 1365) |  |
| βc-2148 Target: | 5'-CTGTGAACTTGCTCAGGACAAGGAAGC-3' | (SEQ ID NO: 2474) |  |
|  | 5'-UGAACUUGCUCAGGACAAGGAAGCU-3' | (SEQ ID NO: 3584) |  |
|  | 3'-ACACUUGAACGAGUCCUGUUCCUUCGA-5' | (SEQ ID NO: 1366) |  |
| βc-2149 Target: | 5'-TGTGAACTTGCTCAGGACAAGGAAGCT-3' | (SEQ ID NO: 2475) |  |
|  | 5'-GAACUUGCUCAGGACAAGGAAGCUG-3' | (SEQ ID NO: 3585) |  |
|  | 3'-CACUUGAACGAGUCCUGUUCCUUCGAC-5' | (SEQ ID NO: 1367) |  |
| βc-2150 Target: | 5'-GTGAACTTGCTCAGGACAAGGAAGCTG-3' | (SEQ ID NO: 2476) |  |
|  | 5'-AACUUGCUCAGGACAAGGAAGCUGC-3' | (SEQ ID NO: 3586) |  |
|  | 3'-ACUUGAACGAGUCCUGUUCCUUCGACG-5' | (SEQ ID NO: 1368) |  |
| βc-2151 Target: | 5'-TGAACTTGCTCAGGACAAGGAAGCTGC-3' | (SEQ ID NO: 2477) |  |
|  | 5'-AUUGAAGCUGAGGGAGCCACAGCUC-3' | (SEQ ID NO: 3587) |  |
|  | 3'-GAUAACUUCGACUCCCUCGGUGUCGAG-5' | (SEQ ID NO: 1369) |  |
| βc-2183 Target: | 5'-CTATTGAAGCTGAGGGAGCCACAGCTC-3' | (SEQ ID NO: 2478) |  |
|  | 5'-UUGAAGCUGAGGGAGCCACAGCUCC-3' | (SEQ ID NO: 3588) |  |
|  | 3'-AUAACUUCGACUCCCUCGGUGUCGAGG-5' | (SEQ ID NO: 1370) |  |
| βc-2184 Target: | 5'-TATTGAAGCTGAGGGAGCCACAGCTCC-3' | (SEQ ID NO: 2479) |  |
|  | 5'-UGAAGCUGAGGGAGCCACAGCUCCU-3' | (SEQ ID NO: 3589) |  |
|  | 3'-UAACUUCGACUCCCUCGGUGUCGAGGA-5' | (SEQ ID NO: 1371) |  |
| βc-2185 Target: | 5'-ATTGAAGCTGAGGGAGCCACAGCTCCT-3' | (SEQ ID NO: 2480) |  |
|  | 5'-UUCCGAAUGUCUGAGGACAAGCCAC-3' | (SEQ ID NO: 3590) |  |
|  | 3'-ACAAGGCUUACAGACUCCUGUUCGGUG-5' | (SEQ ID NO: 1372) |  |
| βc-2270 Target: | 5'-TGTTCCGAATGTCTGAGGACAAGCCAC-3' | (SEQ ID NO: 2481) |  |
|  | 5'-UCCGAAUGUCUGAGGACAAGCCACA-3' | (SEQ ID NO: 3591) |  |
|  | 3'-CAAGGCUUACAGACUCCUGUUCGGUGU-5' | (SEQ ID NO: 1373) |  |
| βc-2271 Target: | 5'-GTTCCGAATGTCTGAGGACAAGCCACA-3' | (SEQ ID NO: 2482) |  |
|  | 5'-CCGAAUGUCUGAGGACAAGCCACAA-3' | (SEQ ID NO: 3592) |  |
|  | 3'-AAGGCUUACAGACUCCUGUUCGGUGUU-5' | (SEQ ID NO: 1374) |  |
| βc-2272 Target: | 5'-TTCCGAATGTCTGAGGACAAGCCACAA-3' | (SEQ ID NO: 2483) |  |
|  | 5'-CGAAUGUCUGAGGACAAGCCACAAG-3' | (SEQ ID NO: 3593) |  |
|  | 3'-AGGCUUACAGACUCCUGUUCGGUGUUC-5' | (SEQ ID NO: 1375) |  |
| βc-2273 Target: | 5'-TCCGAATGTCTGAGGACAAGCCACAAG-3' | (SEQ ID NO: 2484) |  |
|  | 5'-GAAUGUCUGAGGACAAGCCACAAGA-3' | (SEQ ID NO: 3594) |  |
|  | 3'-GGCUUACAGACUCCUGUUCGGUGUUCU-5' | (SEQ ID NO: 1376) |  |
| βc-2274 Target: | 5'-CCGAATGTCTGAGGACAAGCCACAAGA-3' | (SEQ ID NO: 2485) |  |
|  | 5'-AAUGUCUGAGGACAAGCCACAAGAU-3' | (SEQ ID NO: 3595) |  |
|  | 3'-GCUUACAGACUCCUGUUCGGUGUUCUA-5' | (SEQ ID NO: 1377) |  |
| βc-2275 Target: | 5'-CGAATGTCTGAGGACAAGCCACAAGAT-3' | (SEQ ID NO: 2486) |  |

TABLE 6-continued

Selected Anti-β-catenin DsiRNA Agents, Unmodified Duplexes

|  |  |  |  |
|---|---|---|---|
|  | 5'-AUGUCUGAGGACAAGCCACAAGAUU-3' | (SEQ ID NO: 3596) |  |
|  | 3'-CUUACAGACUCCUGUUCGGUGUUCUAA-5' | (SEQ ID NO: 1378) |  |
| βc-2276 Target: | 5'-GAATGTCTGAGGACAAGCCACAAGATT-3' | (SEQ ID NO: 2487) |  |
|  | 5'-UGUCUGAGGACAAGCCACAAGAUUA-3' | (SEQ ID NO: 3597) |  |
|  | 3'-UUACAGACUCCUGUUCGGUGUUCUAAU-5' | (SEQ ID NO: 1379) |  |
| βc-2277 Target: | 5'-AATGTCTGAGGACAAGCCACAAGATTA-3' | (SEQ ID NO: 2488) |  |
|  | 5'-ACAGAGCCAAUGGCUUGGAAUGAGA-3' | (SEQ ID NO: 3598) |  |
|  | 3'-CUUGUCUCGGUUACCGAACCUUACUCU-5' | (SEQ ID NO: 1380) |  |
| βc-2345 Target: | 5'-GAACAGAGCCAATGGCTTGGAATGAGA-3' | (SEQ ID NO: 2489) |  |
|  | 5'-CAGAGCCAAUGGCUUGGAAUGAGAC-3' | (SEQ ID NO: 3599) |  |
|  | 3'-UUGUCUCGGUUACCGAACCUUACUCUG-5' | (SEQ ID NO: 1381) |  |
| βc-2346 Target: | 5'-AACAGAGCCAATGGCTTGGAATGAGAC-3' | (SEQ ID NO: 2490) |  |
|  | 5'-AGAGCCAAUGGCUUGGAAUGAGACU-3' | (SEQ ID NO: 3600) |  |
|  | 3'-UGUCUCGGUUACCGAACCUUACUCUGA-5' | (SEQ ID NO: 1382) |  |
| βc-2347 Target: | 5'-ACAGAGCCAATGGCTTGGAATGAGACT-3' | (SEQ ID NO: 2491) |  |
|  | 5'-GAGCCAAUGGCUUGGAAUGAGACUG-3' | (SEQ ID NO: 3601) |  |
|  | 3'-GUCUCGGUUACCGAACCUUACUCUGAC-5' | (SEQ ID NO: 1383) |  |
| βc-2348 Target: | 5'-CAGAGCCAATGGCTTGGAATGAGACTG-3' | (SEQ ID NO: 2492) |  |
|  | 5'-AGCCAAUGGCUUGGAAUGAGACUGC-3' | (SEQ ID NO: 3602) |  |
|  | 3'-UCUCGGUUACCGAACCUUACUCUGACG-5' | (SEQ ID NO: 1384) |  |
| βc-2349 Target: | 5'-AGAGCCAATGGCTTGGAATGAGACTGC-3' | (SEQ ID NO: 2493) |  |
|  | 5'-GCCAAUGGCUUGGAAUGAGACUGCU-3' | (SEQ ID NO: 3603) |  |
|  | 3'-CUCGGUUACCGAACCUUACUCUGACGA-5' | (SEQ ID NO: 1385) |  |
| βc-2350 Target: | 5'-GAGCCAATGGCTTGGAATGAGACTGCT-3' | (SEQ ID NO: 2494) |  |
|  | 5'-CCAAUGGCUUGGAAUGAGACUGCUG-3' | (SEQ ID NO: 3604) |  |
|  | 3'-UCGGUUACCGAACCUUACUCUGACGAC-5' | (SEQ ID NO: 1386) |  |
| βc-2351 Target: | 5'-AGCCAATGGCTTGGAATGAGACTGCTG-3' | (SEQ ID NO: 2495) |  |
|  | 5'-CAAUGGCUUGGAAUGAGACUGCUGA-3' | (SEQ ID NO: 3605) |  |
|  | 3'-CGGUUACCGAACCUUACUCUGACGACU-5' | (SEQ ID NO: 1387) |  |
| βc-2352 Target: | 5'-GCCAATGGCTTGGAATGAGACTGCTGA-3' | (SEQ ID NO: 2496) |  |
|  | 5'-AAUGGCUUGGAAUGAGACUGCUGAU-3' | (SEQ ID NO: 3606) |  |
|  | 3'-GGUUACCGAACCUUACUCUGACGACUA-5' | (SEQ ID NO: 1388) |  |
| βc-2353 Target: | 5'-CCAATGGCTTGGAATGAGACTGCTGAT-3' | (SEQ ID NO: 2497) |  |
|  | 5'-AUGGCUUGGAAUGAGACUGCUGAUC-3' | (SEQ ID NO: 3607) |  |
|  | 3'-GUUACCGAACCUUACUCUGACGACUAG-5' | (SEQ ID NO: 1389) |  |
| βc-2354 Target: | 5'-CAATGGCTTGGAATGAGACTGCTGATC-3' | (SEQ ID NO: 2498) |  |
|  | 5'-UGGCUUGGAAUGAGACUGCUGAUCU-3' | (SEQ ID NO: 3608) |  |
|  | 3'-UUACCGAACCUUACUCUGACGACUAGA-5' | (SEQ ID NO: 1390) |  |
| βc-2355 Target: | 5'-AATGGCTTGGAATGAGACTGCTGATCT-3' | (SEQ ID NO: 2499) |  |

TABLE 6-continued

Selected Anti-β-catenin DsiRNA Agents, Unmodified Duplexes

|  |  |  |  |
|---|---|---|---|
| | 5'-CUUGGAUAUCGCCAGGAUGAUCCUA-3' | (SEQ ID NO: 3609) |
| | 3'-GGGAACCUAUAGCGGUCCUACUAGGAU-5' | (SEQ ID NO: 1391) |
| βc-2411 Target: | 5'-CCCTTGGATATCGCCAGGATGATCCTA-3' | (SEQ ID NO: 2500) |
| | 5'-UUGGAUAUCGCCAGGAUGAUCCUAG-3' | (SEQ ID NO: 3610) |
| | 3'-GGAACCUAUAGCGGUCCUACUAGGAUC-5' | (SEQ ID NO: 1392) |
| βc-2412 Target: | 5'-CCTTGGATATCGCCAGGATGATCCTAG-3' | (SEQ ID NO: 2501) |
| | 5'-UGGAUAUCGCCAGGAUGAUCCUAGC-3' | (SEQ ID NO: 3611) |
| | 3'-GAACCUAUAGCGGUCCUACUAGGAUCG-5' | (SEQ ID NO: 1393) |
| βc-2413 Target: | 5'-CTTGGATATCGCCAGGATGATCCTAGC-3' | (SEQ ID NO: 2502) |
| | 5'-GGAUAUCGCCAGGAUGAUCCUAGCU-3' | (SEQ ID NO: 3612) |
| | 3'-AACCUAUAGCGGUCCUACUAGGAUCGA-5' | (SEQ ID NO: 1394) |
| βc-2414 Target: | 5'-TTGGATATCGCCAGGATGATCCTAGCT-3' | (SEQ ID NO: 2503) |
| | 5'-GAUAUCGCCAGGAUGAUCCUAGCUA-3' | (SEQ ID NO: 3613) |
| | 3'-ACCUAUAGCGGUCCUACUAGGAUCGAU-5' | (SEQ ID NO: 1395) |
| βc-2415 Target: | 5'-TGGATATCGCCAGGATGATCCTAGCTA-3' | (SEQ ID NO: 2504) |
| | 5'-CGUUCUUUUCACUCUGGUGGAUAUG-3' | (SEQ ID NO: 3614) |
| | 3'-UAGCAAGAAAAGUGAGACCACCUAUAC-5' | (SEQ ID NO: 1396) |
| βc-2441 Target: | 5'-ATCGTTCTTTTCACTCTGGTGGATATG-3' | (SEQ ID NO: 2505) |
| | 5'-GUUCUUUUCACUCUGGUGGAUAUGG-3' | (SEQ ID NO: 3615) |
| | 3'-AGCAAGAAAAGUGAGACCACCUAUACC-5' | (SEQ ID NO: 1397) |
| βc-2442 Target: | 5'-TCGTTCTTTTCACTCTGGTGGATATGG-3' | (SEQ ID NO: 2506) |
| | 5'-UUCUUUUCACUCUGGUGGAUAUGGC-3' | (SEQ ID NO: 3616) |
| | 3'-GCAAGAAAAGUGAGACCACCUAUACCG-5' | (SEQ ID NO: 1398) |
| βc-2443 Target: | 5'-CGTTCTTTTCACTCTGGTGGATATGGC-3' | (SEQ ID NO: 2507) |
| | 5'-UCUUUUCACUCUGGUGGAUAUGGCC-3' | (SEQ ID NO: 3617) |
| | 3'-CAAGAAAAGUGAGACCACCUAUACCGG-5' | (SEQ ID NO: 1399) |
| βc-2444 Target: | 5'-GTTCTTTTCACTCTGGTGGATATGGCC-3' | (SEQ ID NO: 2508) |
| | 5'-CUUUUCACUCUGGUGGAUAUGGCCA-3' | (SEQ ID NO: 3618) |
| | 3'-AAGAAAAGUGAGACCACCUAUACCGGU-5' | (SEQ ID NO: 1400) |
| βc-2445 Target: | 5'-TTCTTTTCACTCTGGTGGATATGGCCA-3' | (SEQ ID NO: 2509) |
| | 5'-CAUGAGAUGGGUGGCCACCACCCUG-3' | (SEQ ID NO: 3619) |
| | 3'-UUGUACUCUACCCACCGGUGGUGGGAC-5' | (SEQ ID NO: 1401) |
| βc-2501 Target: | 5'-AACATGAGATGGGTGGCCACCACCCTG-3' | (SEQ ID NO: 2510) |
| | 5'-AUGAGAUGGGUGGCCACCACCCUGG-3' | (SEQ ID NO: 3620) |
| | 3'-UGUACUCUACCCACCGGUGGUGGGACC-5' | (SEQ ID NO: 1402) |
| βc-2502 Target: | 5'-ACATGAGATGGGTGGCCACCACCCTGG-3' | (SEQ ID NO: 2511) |
| | 5'-UGAGAUGGGUGGCCACCACCCUGGU-3' | (SEQ ID NO: 3621) |
| | 3'-GUACUCUACCCACCGGUGGUGGGACCA-5' | (SEQ ID NO: 1403) |
| βc-2503 Target: | 5'-CATGAGATGGGTGGCCACCACCCTGGT-3' | (SEQ ID NO: 2512) |

TABLE 6-continued

Selected Anti-β-catenin DsiRNA Agents, Unmodified Duplexes

|  |  |  |  |
|---|---|---|---|
|  | 5'-GAGAUGGGUGGCCACCACCCUGGUG-3' | (SEQ ID NO: 3622) |  |
|  | 3'-UACUCUACCCACCGGUGGUGGGACCAC-5' | (SEQ ID NO: 1404) |  |
| βc-2504 Target: | 5'-ATGAGATGGGTGGCCACCACCCTGGTG-3' | (SEQ ID NO: 2513) |  |
|  | 5'-AGAUGGGUGGCCACCACCCUGGUGC-3' | (SEQ ID NO: 3623) |  |
|  | 3'-ACUCUACCCACCGGUGGUGGGACCACG-5' | (SEQ ID NO: 1405) |  |
| βc-2505 Target: | 5'-TGAGATGGGTGGCCACCACCCTGGTGC-3' | (SEQ ID NO: 2514) |  |
|  | 5'-GAUGGGUGGCCACCACCCUGGUGCU-3' | (SEQ ID NO: 3624) |  |
|  | 3'-CUCUACCCACCGGUGGUGGGACCACGA-5' | (SEQ ID NO: 1406) |  |
| βc-2506 Target: | 5'-GAGATGGGTGGCCACCACCCTGGTGCT-3' | (SEQ ID NO: 2515) |  |
|  | 5'-AUGGGUGGCCACCACCCUGGUGCUG-3' | (SEQ ID NO: 3625) |  |
|  | 3'-UCUACCCACCGGUGGUGGGACCACGAC-5' | (SEQ ID NO: 1407) |  |
| βc-2507 Target: | 5'-AGATGGGTGGCCACCACCCTGGTGCTG-3' | (SEQ ID NO: 2516) |  |
|  | 5'-UGGGUGGCCACCACCCUGGUGCUGA-3' | (SEQ ID NO: 3626) |  |
|  | 3'-CUACCCACCGGUGGUGGGACCACGACU-5' | (SEQ ID NO: 1408) |  |
| βc-2508 Target: | 5'-GATGGGTGGCCACCACCCTGGTGCTGA-3' | (SEQ ID NO: 2517) |  |
|  | 5'-GGGUGGCCACCACCCUGGUGCUGAC-3' | (SEQ ID NO: 3627) |  |
|  | 3'-UACCCACCGGUGGUGGGACCACGACUG-5' | (SEQ ID NO: 1409) |  |
| βc-2509 Target: | 5'-ATGGGTGGCCACCACCCTGGTGCTGAC-3' | (SEQ ID NO: 2518) |  |
|  | 5'-GGUGGCCACCACCCUGGUGCUGACU-3' | (SEQ ID NO: 3628) |  |
|  | 3'-ACCCACCGGUGGUGGGACCACGACUGA-5' | (SEQ ID NO: 1410) |  |
| βc-2510 Target: | 5'-TGGGTGGCCACCACCCTGGTGCTGACT-3' | (SEQ ID NO: 2519) |  |
|  | 5'-GUGGCCACCACCCUGGUGCUGACUA-3' | (SEQ ID NO: 3629) |  |
|  | 3'-CCCACCGGUGGUGGGACCACGACUGAU-5' | (SEQ ID NO: 1411) |  |
| βc-2511 Target: | 5'-GGGTGGCCACCACCCTGGTGCTGACTA-3' | (SEQ ID NO: 2520) |  |
|  | 5'-UGGCCACCACCCUGGUGCUGACUAU-3' | (SEQ ID NO: 3630) |  |
|  | 3'-CCACCGGUGGUGGGACCACGACUGAUA-5' | (SEQ ID NO: 1412) |  |
| βc-2512 Target: | 5'-GGTGGCCACCACCCTGGTGCTGACTAT-3' | (SEQ ID NO: 2521) |  |
|  | 5'-GGCCACCACCCUGGUGCUGACUAUC-3' | (SEQ ID NO: 3631) |  |
|  | 3'-CACCGGUGGUGGGACCACGACUGAUAG-5' | (SEQ ID NO: 1413) |  |
| βc-2513 Target: | 5'-GTGGCCACCACCCTGGTGCTGACTATC-3' | (SEQ ID NO: 2522) |  |
|  | 5'-GCCACCACCCUGGUGCUGACUAUCC-3' | (SEQ ID NO: 3632) |  |
|  | 3'-ACCGGUGGUGGGACCACGACUGAUAGG-5' | (SEQ ID NO: 1414) |  |
| βc-2514 Target: | 5'-TGGCCACCACCCTGGTGCTGACTATCC-3' | (SEQ ID NO: 2523) |  |
|  | 5'-CCACCACCCUGGUGCUGACUAUCCA-3' | (SEQ ID NO: 3633) |  |
|  | 3'-CCGGUGGUGGGACCACGACUGAUAGGU-5' | (SEQ ID NO: 1415) |  |
| βc-2515 Target: | 5'-GGCCACCACCCTGGTGCTGACTATCCA-3' | (SEQ ID NO: 2524) |  |
|  | 5'-CACCACCCUGGUGCUGACUAUCCAG-3' | (SEQ ID NO: 3634) |  |
|  | 3'-CGGUGGUGGGACCACGACUGAUAGGUC-5' | (SEQ ID NO: 1416) |  |
| βc-2516 Target: | 5'-GCCACCACCCTGGTGCTGACTATCCAG-3' | (SEQ ID NO: 2525) |  |

TABLE 6-continued

Selected Anti-β-catenin DsiRNA Agents, Unmodified Duplexes

|  |  |  |  |
|---|---|---|---|
|  | 5'-ACCACCCUGGUGCUGACUAUCCAGU-3' | (SEQ ID NO: 3635) |  |
|  | 3'-GGUGGUGGGACCACGACUGAUAGGUCA-5' | (SEQ ID NO: 1417) |  |
| βc-2517 Target: | 5'-CCACCACCCTGGTGCTGACTATCCAGT-3' | (SEQ ID NO: 2526) |  |
|  | 5'-CCACCCUGGUGCUGACUAUCCAGUU-3' | (SEQ ID NO: 3636) |  |
|  | 3'-GUGGUGGGACCACGACUGAUAGGUCAA-5' | (SEQ ID NO: 1418) |  |
| βc-2518 Target: | 5'-CACCACCCTGGTGCTGACTATCCAGTT-3' | (SEQ ID NO: 2527) |  |
|  | 5'-CACCCUGGUGCUGACUAUCCAGUUG-3' | (SEQ ID NO: 3637) |  |
|  | 3'-UGGUGGGACCACGACUGAUAGGUCAAC-5' | (SEQ ID NO: 1419) |  |
| βc-2519 Target: | 5'-ACCACCCTGGTGCTGACTATCCAGTTG-3' | (SEQ ID NO: 2528) |  |
|  | 5'-ACCCUGGUGCUGACUAUCCAGUUGA-3' | (SEQ ID NO: 3638) |  |
|  | 3'-GGUGGGACCACGACUGAUAGGUCAACU-5' | (SEQ ID NO: 1420) |  |
| βc-2520 Target: | 5'-CCACCCTGGTGCTGACTATCCAGTTGA-3' | (SEQ ID NO: 2529) |  |
|  | 5'-CCCUGGUGCUGACUAUCCAGUUGAU-3' | (SEQ ID NO: 3639) |  |
|  | 3'-GUGGGACCACGACUGAUAGGUCAACUA-5' | (SEQ ID NO: 1421) |  |
| βc-2521 Target: | 5'-CACCCTGGTGCTGACTATCCAGTTGAT-3' | (SEQ ID NO: 2530) |  |
|  | 5'-CCUGGUGCUGACUAUCCAGUUGAUG-3' | (SEQ ID NO: 3640) |  |
|  | 3'-UGGGACCACGACUGAUAGGUCAACUAC-5' | (SEQ ID NO: 1422) |  |
| βc-2522 Target: | 5'-ACCCTGGTGCTGACTATCCAGTTGATG-3' | (SEQ ID NO: 2531) |  |
|  | 5'-CUGGUGCUGACUAUCCAGUUGAUGG-3' | (SEQ ID NO: 3641) |  |
|  | 3'-GGGACCACGACUGAUAGGUCAACUACC-5' | (SEQ ID NO: 1423) |  |
| βc-2523 Target: | 5'-CCCTGGTGCTGACTATCCAGTTGATGG-3' | (SEQ ID NO: 2532) |  |
|  | 5'-UGGUGCUGACUAUCCAGUUGAUGGG-3' | (SEQ ID NO: 3642) |  |
|  | 3'-GGACCACGACUGAUAGGUCAACUACCC-5' | (SEQ ID NO: 1424) |  |
| βc-2524 Target: | 5'-CCTGGTGCTGACTATCCAGTTGATGGG-3' | (SEQ ID NO: 2533) |  |
|  | 5'-GGUGCUGACUAUCCAGUUGAUGGGC-3' | (SEQ ID NO: 3643) |  |
|  | 3'-GACCACGACUGAUAGGUCAACUACCCG-5' | (SEQ ID NO: 1425) |  |
| βc-2525 Target: | 5'-CTGGTGCTGACTATCCAGTTGATGGGC-3' | (SEQ ID NO: 2534) |  |
|  | 5'-GUGCUGACUAUCCAGUUGAUGGGCU-3' | (SEQ ID NO: 3644) |  |
|  | 3'-ACCACGACUGAUAGGUCAACUACCCGA-5' | (SEQ ID NO: 1426) |  |
| βc-2526 Target: | 5'-TGGTGCTGACTATCCAGTTGATGGGCT-3' | (SEQ ID NO: 2535) |  |
|  | 5'-UGCUGACUAUCCAGUUGAUGGGCUG-3' | (SEQ ID NO: 3645) |  |
|  | 3'-CCACGACUGAUAGGUCAACUACCCGAC-5' | (SEQ ID NO: 1427) |  |
| βc-2527 Target: | 5'-GGTGCTGACTATCCAGTTGATGGGCTG-3' | (SEQ ID NO: 2536) |  |
|  | 5'-GCUGACUAUCCAGUUGAUGGGCUGC-3' | (SEQ ID NO: 3646) |  |
|  | 3'-CACGACUGAUAGGUCAACUACCCGACG-5' | (SEQ ID NO: 1428) |  |
| βc-2528 Target: | 5'-GTGCTGACTATCCAGTTGATGGGCTGC-3' | (SEQ ID NO: 2537) |  |
|  | 5'-CUGACUAUCCAGUUGAUGGGCUGCC-3' | (SEQ ID NO: 3647) |  |
|  | 3'-ACGACUGAUAGGUCAACUACCCGACGG-5' | (SEQ ID NO: 1429) |  |
| βc-2529 Target: | 5'-TGCTGACTATCCAGTTGATGGGCTGCC-3' | (SEQ ID NO: 2538) |  |

TABLE 6-continued

Selected Anti-β-catenin DsiRNA Agents, Unmodified Duplexes

|  |  |  |  |
|---|---|---|---|
|  | 5'-UGACUAUCCAGUUGAUGGGCUGCCA-3' | (SEQ ID NO: 3648) |  |
|  | 3'-CGACUGAUAGGUCAACUACCCGACGGU-5' | (SEQ ID NO: 1430) |  |
| βc-2530 Target: | 5'-GCTGACTATCCAGTTGATGGGCTGCCA-3' | (SEQ ID NO: 2539) |  |
|  | 5'-GACUAUCCAGUUGAUGGGCUGCCAG-3' | (SEQ ID NO: 3649) |  |
|  | 3'-GACUGAUAGGUCAACUACCCGACGGUC-5' | (SEQ ID NO: 1431) |  |
| βc-2531 Target: | 5'-CTGACTATCCAGTTGATGGGCTGCCAG-3' | (SEQ ID NO: 2540) |  |
|  | 5'-ACUAUCCAGUUGAUGGGCUGCCAGA-3' | (SEQ ID NO: 3650) |  |
|  | 3'-ACUGAUAGGUCAACUACCCGACGGUCU-5' | (SEQ ID NO: 1432) |  |
| βc-2532 Target: | 5'-TGACTATCCAGTTGATGGGCTGCCAGA-3' | (SEQ ID NO: 2541) |  |
|  | 5'-CUAUCCAGUUGAUGGGCUGCCAGAU-3' | (SEQ ID NO: 3651) |  |
|  | 3'-CUGAUAGGUCAACUACCCGACGGUCUA-5' | (SEQ ID NO: 1433) |  |
| βc-2533 Target: | 5'-GACTATCCAGTTGATGGGCTGCCAGAT-3' | (SEQ ID NO: 2542) |  |
|  | 5'-UAUCCAGUUGAUGGGCUGCCAGAUC-3' | (SEQ ID NO: 3652) |  |
|  | 3'-UGAUAGGUCAACUACCCGACGGUCUAG-5' | (SEQ ID NO: 1434) |  |
| βc-2534 Target: | 5'-ACTATCCAGTTGATGGGCTGCCAGATC-3' | (SEQ ID NO: 2543) |  |
|  | 5'-AUCCAGUUGAUGGGCUGCCAGAUCU-3' | (SEQ ID NO: 3653) |  |
|  | 3'-GAUAGGUCAACUACCCGACGGUCUAGA-5' | (SEQ ID NO: 1435) |  |
| βc-2535 Target: | 5'-CTATCCAGTTGATGGGCTGCCAGATCT-3' | (SEQ ID NO: 2544) |  |
|  | 5'-GCCCAGGACCUCAUGGAUGGGCUGC-3' | (SEQ ID NO: 3654) |  |
|  | 3'-UACGGGUCCUGGAGUACCUACCCGACG-5' | (SEQ ID NO: 1436) |  |
| βc-2567 Target: | 5'-ATGCCCAGGACCTCATGGATGGGCTGC-3' | (SEQ ID NO: 2545) |  |
|  | 5'-CCCAGGACCUCAUGGAUGGGCUGCC-3' | (SEQ ID NO: 3655) |  |
|  | 3'-ACGGGUCCUGGAGUACCUACCCGACGG-5' | (SEQ ID NO: 1437) |  |
| βc-2568 Target: | 5'-TGCCCAGGACCTCATGGATGGGCTGCC-3' | (SEQ ID NO: 2546) |  |
|  | 5'-CCAGGACCUCAUGGAUGGGCUGCCU-3' | (SEQ ID NO: 3656) |  |
|  | 3'-CGGGUCCUGGAGUACCUACCCGACGGA-5' | (SEQ ID NO: 1438) |  |
| βc-2569 Target: | 5'-GCCCAGGACCTCATGGATGGGCTGCCT-3' | (SEQ ID NO: 2547) |  |
|  | 5'-AGCAAUCAGCUGGCCUGGUUUGAUA-3' | (SEQ ID NO: 3657) |  |
|  | 3'-UGUCGUUAGUCGACCGGACCAAACUAU-5' | (SEQ ID NO: 1439) |  |
| βc-2603 Target: | 5'-ACAGCAATCAGCTGGCCTGGTTTGATA-3' | (SEQ ID NO: 2548) |  |
|  | 5'-GCAAUCAGCUGGCCUGGUUUGAUAC-3' | (SEQ ID NO: 3658) |  |
|  | 3'-GUCGUUAGUCGACCGGACCAAACUAUG-5' | (SEQ ID NO: 1440) |  |
| βc-2604 Target: | 5'-CAGCAATCAGCTGGCCTGGTTTGATAC-3' | (SEQ ID NO: 2549) |  |
|  | 5'-CAAUCAGCUGGCCUGGUUUGAUACU-3' | (SEQ ID NO: 3659) |  |
|  | 3'-UCGUUAGUCGACCGGACCAAACUAUGA-5' | (SEQ ID NO: 1441) |  |
| βc-2605 Target: | 5'-AGCAATCAGCTGGCCTGGTTTGATACT-3' | (SEQ ID NO: 2550) |  |
|  | 5'-AAUCAGCUGGCCUGGUUUGAUACUG-3' | (SEQ ID NO: 3660) |  |
|  | 3'-CGUUAGUCGACCGGACCAAACUAUGAC-5' | (SEQ ID NO: 1442) |  |
| βc-2606 Target: | 5'-GCAATCAGCTGGCCTGGTTTGATACTG-3' | (SEQ ID NO: 2551) |  |

TABLE 6-continued

Selected Anti-β-catenin DsiRNA Agents, Unmodified Duplexes

|  |  |  |  |
|---|---|---|---|
|  | 5'-AUCAGCUGGCCUGGUUUGAUACUGA-3' | (SEQ ID NO: 3661) |
|  | 3'-GUUAGUCGACCGGACCAAACUAUGACU-5' | (SEQ ID NO: 1443) |
| βc-2607 Target: | 5'-CAATCAGCTGGCCTGGTTTGATACTGA-3' | (SEQ ID NO: 2552) |
|  | 5'-UCAGCUGGCCUGGUUUGAUACUGAC-3' | (SEQ ID NO: 3662) |
|  | 3'-UUAGUCGACCGGACCAAACUAUGACUG-5' | (SEQ ID NO: 1444) |
| βc-2608 Target: | 5'-AATCAGCTGGCCTGGTTTGATACTGAC-3' | (SEQ ID NO: 2553) |
|  | 5'-CAGCUGGCCUGGUUUGAUACUGACC-3' | (SEQ ID NO: 3663) |
|  | 3'-UAGUCGACCGGACCAAACUAUGACUGG-5' | (SEQ ID NO: 1445) |
| βc-2609 Target: | 5'-ATCAGCTGGCCTGGTTTGATACTGACC-3' | (SEQ ID NO: 2554) |
|  | 5'-AGCUGGCCUGGUUUGAUACUGACCU-3' | (SEQ ID NO: 3664) |
|  | 3'-AGUCGACCGGACCAAACUAUGACUGGA-5' | (SEQ ID NO: 1446) |
| βc-2610 Target: | 5'-TCAGCTGGCCTGGTTTGATACTGACCT-3' | (SEQ ID NO: 2555) |
|  | 5'-GCUGGCCUGGUUUGAUACUGACCUG-3' | (SEQ ID NO: 3665) |
|  | 3'-GUCGACCGGACCAAACUAUGACUGGAC-5' | (SEQ ID NO: 1447) |
| βc-2611 Target: | 5'-CAGCTGGCCTGGTTTGATACTGACCTG-3' | (SEQ ID NO: 2556) |
|  | 5'-CUGGCCUGGUUUGAUACUGACCUGU-3' | (SEQ ID NO: 3666) |
|  | 3'-UCGACCGGACCAAACUAUGACUGGACA-5' | (SEQ ID NO: 1448) |
| βc-2612 Target: | 5'-AGCTGGCCTGGTTTGATACTGACCTGT-3' | (SEQ ID NO: 2557) |
|  | 5'-UGGCCUGGUUUGAUACUGACCUGUA-3' | (SEQ ID NO: 3667) |
|  | 3'-CGACCGGACCAAACUAUGACUGGACAU-5' | (SEQ ID NO: 1449) |
| βc-2613 Target: | 5'-GCTGGCCTGGTTTGATACTGACCTGTA-3' | (SEQ ID NO: 2558) |
|  | 5'-GGCCUGGUUUGAUACUGACCUGUAA-3' | (SEQ ID NO: 3668) |
|  | 3'-GACCGGACCAAACUAUGACUGGACAUU-5' | (SEQ ID NO: 1450) |
| βc-2614 Target: | 5'-CTGGCCTGGTTTGATACTGACCTGTAA-3' | (SEQ ID NO: 2559) |
|  | 5'-GCCUGGUUUGAUACUGACCUGUAAA-3' | (SEQ ID NO: 3669) |
|  | 3'-ACCGGACCAAACUAUGACUGGACAUUU-5' | (SEQ ID NO: 1451) |
| βc-2615 Target: | 5'-TGGCCTGGTTTGATACTGACCTGTAAA-3' | (SEQ ID NO: 2560) |
|  | 5'-CCUGGUUUGAUACUGACCUGUAAAU-3' | (SEQ ID NO: 3670) |
|  | 3'-CCGGACCAAACUAUGACUGGACAUUUA-5' | (SEQ ID NO: 1452) |
| βc-2616 Target: | 5'-GGCCTGGTTTGATACTGACCTGTAAAT-3' | (SEQ ID NO: 2561) |
|  | 5'-CUGGUUUGAUACUGACCUGUAAAUC-3' | (SEQ ID NO: 3671) |
|  | 3'-CGGACCAAACUAUGACUGGACAUUUAG-5' | (SEQ ID NO: 1453) |
| βc-2617 Target: | 5'-GCCTGGTTTGATACTGACCTGTAAATC-3' | (SEQ ID NO: 2562) |
|  | 5'-UGGUUUGAUACUGACCUGUAAAUCA-3' | (SEQ ID NO: 3672) |
|  | 3'-GGACCAAACUAUGACUGGACAUUUAGU-5' | (SEQ ID NO: 1454) |
| βc-2618 Target: | 5'-CCTGGTTTGATACTGACCTGTAAATCA-3' | (SEQ ID NO: 2563) |
|  | 5'-GGUUUGAUACUGACCUGUAAAUCAU-3' | (SEQ ID NO: 3673) |
|  | 3'-GACCAAACUAUGACUGGACAUUUAGUA-5' | (SEQ ID NO: 1455) |
| βc-2619 Target: | 5'-CTGGTTTGATACTGACCTGTAAATC-3' | (SEQ ID NO: 2564) |

TABLE 6-continued

Selected Anti-β-catenin DsiRNA Agents, Unmodified Duplexes

|  |  |  |  |
|---|---|---|---|
|  | 5'-GUUUGAUACUGACCUGUAAAUCAUC-3' | (SEQ ID NO: 3674) |  |
|  | 3'-ACCAAACUAUGACUGGACAUUUAGUAG-5' | (SEQ ID NO: 1456) |  |
| βc-2620 Target: | 5'-TGGTTTGATACTGACCTGTAAATCATC-3' | (SEQ ID NO: 2565) |  |
|  | 5'-UUUGAUACUGACCUGUAAAUCAUCC-3' | (SEQ ID NO: 3675) |  |
|  | 3'-CCAAACUAUGACUGGACAUUUAGUAGG-5' | (SEQ ID NO: 1457) |  |
| βc-2621 Target: | 5'-GGTTTGATACTGACCTGTAAATCATCC-3' | (SEQ ID NO: 2566) |  |
|  | 5'-UUGAUACUGACCUGUAAAUCAUCCU-3' | (SEQ ID NO: 3676) |  |
|  | 3'-CAAACUAUGACUGGACAUUUAGUAGGA-5' | (SEQ ID NO: 1458) |  |
| βc-2622 Target: | 5'-GTTTGATACTGACCTGTAAATCATCCT-3' | (SEQ ID NO: 2567) |  |
|  | 5'-UGAUACUGACCUGUAAAUCAUCCUU-3' | (SEQ ID NO: 3677) |  |
|  | 3'-AAACUAUGACUGGACAUUUAGUAGGAA-5' | (SEQ ID NO: 1459) |  |
| βc-2623 Target: | 5'-TTTGATACTGACCTGTAAATCATCCTT-3' | (SEQ ID NO: 2568) |  |
|  | 5'-UUUUGCCACAGCUUUUGCAACUUAA-3' | (SEQ ID NO: 3678) |  |
|  | 3'-AAAAAACGGUGUCGAAAACGUUGAAUU-5' | (SEQ ID NO: 1460) |  |
| βc-2869 Target: | 5'-TTTTTTGCCACAGCTTTTGCAACTTAA-3' | (SEQ ID NO: 2569) |  |
|  | 5'-UGAGUAACAUUUGCUGUUUUAAACA-3' | (SEQ ID NO: 3679) |  |
|  | 3'-UUACUCAUUGUAAACGACAAAAUUUGU-5' | (SEQ ID NO: 1461) |  |
| βc-2902 Target: | 5'-AATGAGTAACATTTGCTGTTTTAAACA-3' | (SEQ ID NO: 2570) |  |
|  | 5'-AACAUUAAUAGCAGCCUUUCUCUCU-3' | (SEQ ID NO: 3680) |  |
|  | 3'-AUUUGUAAUUAUCGUCGGAAAGAGAGA-5' | (SEQ ID NO: 1462) |  |
| βc-2923 Target: | 5'-TAAACATTAATAGCAGCCTTTCTCTCT-3' | (SEQ ID NO: 2571) |  |
|  | 5'-CAUUAAUAGCAGCCUUUCUCUCUUU-3' | (SEQ ID NO: 3681) |  |
|  | 3'-UUGUAAUUAUCGUCGGAAAGAGAGAAA-5' | (SEQ ID NO: 1463) |  |
| βc-2925 Target: | 5'-AACATTAATAGCAGCCTTTCTCTCTTT-3' | (SEQ ID NO: 2572) |  |
|  | 5'-UUAAUAGCAGCCUUUCUCUCUUUAU-3' | (SEQ ID NO: 3682) |  |
|  | 3'-GUAAUUAUCGUCGGAAAGAGAGAAAUA-5' | (SEQ ID NO: 1464) |  |
| βc-2927 Target: | 5'-CATTAATAGCAGCCTTTCTCTCTTTAT-3' | (SEQ ID NO: 2573) |  |
|  | 5'-AAUAGCAGCCUUUCUCUCUUUAUAC-3' | (SEQ ID NO: 3683) |  |
|  | 3'-AAUUAUCGUCGGAAAGAGAGAAAUAUG-5' | (SEQ ID NO: 1465) |  |
| βc-2929 Target: | 5'-TTAATAGCAGCCTTTCTCTCTTTATAC-3' | (SEQ ID NO: 2574) |  |
|  | 5'-GCAUUGUGAUUGGCCUGUAGAGUUG-3' | (SEQ ID NO: 3684) |  |
|  | 3'-AACGUAACACUAACCGGACAUCUCAAC-5' | (SEQ ID NO: 1466) |  |
| βc-2973 Target: | 5'-TTGCATTGTGATTGGCCTGTAGAGTTG-3' | (SEQ ID NO: 2575) |  |
|  | 5'-AUUGUGAUUGGCCUGUAGAGUUGCU-3' | (SEQ ID NO: 3685) |  |
|  | 3'-CGUAACACUAACCGGACAUCUCAACGA-5' | (SEQ ID NO: 1467) |  |
| βc-2975 Target: | 5'-GCATTGTGATTGGCCTGTAGAGTTGCT-3' | (SEQ ID NO: 2576) |  |
|  | 5'-UGUGAUUGGCCUGUAGAGUUGCUGA-3' | (SEQ ID NO: 3686) |  |
|  | 3'-UAACACUAACCGGACAUCUCAACGACU-5' | (SEQ ID NO: 1468) |  |
| βc-2977 Target: | 5'-ATTGTGATTGGCCTGTAGAGTTGCTGA-3' | (SEQ ID NO: 2577) |  |

TABLE 6-continued

Selected Anti-β-catenin DsiRNA Agents, Unmodified Duplexes

|  |  |  |  |
|---|---|---|---|
|  | 5'-UGAUUGGCCUGUAGAGUUGCUGAGA-3' | (SEQ ID NO: 3687) |  |
|  | 3'-ACACUAACCGGACAUCUCAACGACUCU-5' | (SEQ ID NO: 1469) |  |
| βc-2979 Target: | 5'-TGTGATTGGCCTGTAGAGTTGCTGAGA-3' | (SEQ ID NO: 2578) |  |
|  | 5'-AUUGGCCUGUAGAGUUGCUGAGAGG-3' | (SEQ ID NO: 3688) |  |
|  | 3'-ACUAACCGGACAUCUCAACGACUCUCC-5' | (SEQ ID NO: 1470) |  |
| βc-2981 Target: | 5'-TGATTGGCCTGTAGAGTTGCTGAGAGG-3' | (SEQ ID NO: 2579) |  |
|  | 5'-UGGCCUGUAGAGUUGCUGAGAGGGC-3' | (SEQ ID NO: 3689) |  |
|  | 3'-UAACCGGACAUCUCAACGACUCUCCCG-5' | (SEQ ID NO: 1471) |  |
| βc-2983 Target: | 5'-ATTGGCCTGTAGAGTTGCTGAGAGGGC-3' | (SEQ ID NO: 2580) |  |
|  | 5'-GCCUGUAGAGUUGCUGAGAGGGCUC-3' | (SEQ ID NO: 3690) |  |
|  | 3'-ACCGGACAUCUCAACGACUCUCCCGAG-5' | (SEQ ID NO: 1472) |  |
| βc-2985 Target: | 5'-TGGCCTGTAGAGTTGCTGAGAGGGCTC-3' | (SEQ ID NO: 2581) |  |
|  | 5'-CUGUAGAGUUGCUGAGAGGGCUCGA-3' | (SEQ ID NO: 3691) |  |
|  | 3'-CGGACAUCUCAACGACUCUCCCGAGCU-5' | (SEQ ID NO: 1473) |  |
| βc-2987 Target: | 5'-GCCTGTAGAGTTGCTGAGAGGGCTCGA-3' | (SEQ ID NO: 2582) |  |
|  | 5'-GUAGAGUUGCUGAGAGGGCUCGAGG-3' | (SEQ ID NO: 3692) |  |
|  | 3'-GACAUCUCAACGACUCUCCCGAGCUCC-5' | (SEQ ID NO: 1474) |  |
| βc-2989 Target: | 5'-CTGTAGAGTTGCTGAGAGGGCTCGAGG-3' | (SEQ ID NO: 2583) |  |
|  | 5'-GUGGGCUGGUAUCUCAGAAAGUGCC-3' | (SEQ ID NO: 3693) |  |
|  | 3'-CCCACCCGACCAUAGAGUCUUUCACGG-5' | (SEQ ID NO: 1475) |  |
| βc-3015 Target: | 5'-GGGTGGGCTGGTATCTCAGAAAGTGCC-3' | (SEQ ID NO: 2584) |  |
|  | 5'-GGGCUGGUAUCUCAGAAAGUGCCUG-3' | (SEQ ID NO: 3694) |  |
|  | 3'-CACCCGACCAUAGAGUCUUUCACGGAC-5' | (SEQ ID NO: 1476) |  |
| βc-3017 Target: | 5'-GTGGGCTGGTATCTCAGAAAGTGCCTG-3' | (SEQ ID NO: 2585) |  |
|  | 5'-GCUGGUAUCUCAGAAAGUGCCUGAC-3' | (SEQ ID NO: 3695) |  |
|  | 3'-CCCGACCAUAGAGUCUUUCACGGACUG-5' | (SEQ ID NO: 1477) |  |
| βc-3019 Target: | 5'-GGGCTGGTATCTCAGAAAGTGCCTGAC-3' | (SEQ ID NO: 2586) |  |
|  | 5'-UGGUAUCUCAGAAAGUGCCUGACAC-3' | (SEQ ID NO: 3696) |  |
|  | 3'-CGACCAUAGAGUCUUUCACGGACUGUG-5' | (SEQ ID NO: 1478) |  |
| βc-3021 Target: | 5'-GCTGGTATCTCAGAAAGTGCCTGACAC-3' | (SEQ ID NO: 2587) |  |
|  | 5'-ACUAACCAAGCUGAGUUUCCUAUGG-3' | (SEQ ID NO: 3697) |  |
|  | 3'-UGUGAUUGGUUCGACUCAAAGGAUACC-5' | (SEQ ID NO: 1479) |  |
| βc-3046 Target: | 5'-ACACTAACCAAGCTGAGTTTCCTATGG-3' | (SEQ ID NO: 2588) |  |
|  | 5'-UAACCAAGCUGAGUUUCCUAUGGGA-3' | (SEQ ID NO: 3698) |  |
|  | 3'-UGAUUGGUUCGACUCAAAGGAUACCCU-5' | (SEQ ID NO: 1480) |  |
| βc-3048 Target: | 5'-ACTAACCAAGCTGAGTTTCCTATGGGA-3' | (SEQ ID NO: 2589) |  |
|  | 5'-ACCAAGCUGAGUUUCCUAUGGGAAC-3' | (SEQ ID NO: 3699) |  |
|  | 3'-AUUGGUUCGACUCAAAGGAUACCCUUG-5' | (SEQ ID NO: 1481) |  |
| βc-3050 Target: | 5'-TAACCAAGCTGAGTTTCCTATGGGAAC-3' | (SEQ ID NO: 2590) |  |

TABLE 6-continued

Selected Anti-β-catenin DsiRNA Agents, Unmodified Duplexes

|  |  |  |  |
|---|---|---|---|
|  | 5'-CAAGCUGAGUUUCCUAUGGGAACAA-3' | (SEQ ID NO: 3700) |  |
|  | 3'-UGGUUCGACUCAAAGGAUACCCUUGUU-5' | (SEQ ID NO: 1482) |  |
| βc-3052 Target: | 5'-ACCAAGCTGAGTTTCCTATGGGAACAA-3' | (SEQ ID NO: 2591) |  |
|  | 5'-AGCUGAGUUUCCUAUGGGAACAAUU-3' | (SEQ ID NO: 3701) |  |
|  | 3'-GUUCGACUCAAAGGAUACCCUUGUUAA-5' | (SEQ ID NO: 1483) |  |
| βc-3054 Target: | 5'-CAAGCTGAGTTTCCTATGGGAACAATT-3' | (SEQ ID NO: 2592) |  |
|  | 5'-CUGAGUUUCCUAUGGGAACAAUUGA-3' | (SEQ ID NO: 3702) |  |
|  | 3'-UCGACUCAAAGGAUACCCUUGUUAACU-5' | (SEQ ID NO: 1484) |  |
| βc-3056 Target: | 5'-AGCTGAGTTTCCTATGGGAACAATTGA-3' | (SEQ ID NO: 2593) |  |
|  | 5'-CUUUUUGUUCUGGUCCUUUUUGGUC-3' | (SEQ ID NO: 3703) |  |
|  | 3'-UUGAAAAACAAGACCAGGAAAAACCAG-5' | (SEQ ID NO: 1485) |  |
| βc-3087 Target: | 5'-AACTTTTTGTTCTGGTCCTTTTTGGTC-3' | (SEQ ID NO: 2594) |  |
|  | 5'-UUUUGUUCUGGUCCUUUUUGGUCGA-3' | (SEQ ID NO: 3704) |  |
|  | 3'-GAAAAACAAGACCAGGAAAAACCAGCU-5' | (SEQ ID NO: 1486) |  |
| βc-3089 Target: | 5'-CTTTTTGTTCTGGTCCTTTTTGGTCGA-3' | (SEQ ID NO: 2595) |  |
|  | 5'-UUGUUCUGGUCCUUUUUGGUCGAGG-3' | (SEQ ID NO: 3705) |  |
|  | 3'-AAAACAAGACCAGGAAAAACCAGCUCC-5' | (SEQ ID NO: 1487) |  |
| βc-3091 Target: | 5'-TTTTGTTCTGGTCCTTTTTGGTCGAGG-3' | (SEQ ID NO: 2596) |  |
|  | 5'-GUUCUGGUCCUUUUUGGUCGAGGAG-3' | (SEQ ID NO: 3706) |  |
|  | 3'-AACAAGACCAGGAAAAACCAGCUCCUC-5' | (SEQ ID NO: 1488) |  |
| βc-3093 Target: | 5'-TTGTTCTGGTCCTTTTTGGTCGAGGAG-3' | (SEQ ID NO: 2597) |  |
|  | 5'-UCUGGUCCUUUUUGGUCGAGGAGUA-3' | (SEQ ID NO: 3707) |  |
|  | 3'-CAAGACCAGGAAAAACCAGCUCCUCAU-5' | (SEQ ID NO: 1489) |  |
| βc-3095 Target: | 5'-GTTCTGGTCCTTTTTGGTCGAGGAGTA-3' | (SEQ ID NO: 2598) |  |
|  | 5'-UGGUCCUUUUUGGUCGAGGAGUAAC-3' | (SEQ ID NO: 3708) |  |
|  | 3'-AGACCAGGAAAAACCAGCUCCUCAUUG-5' | (SEQ ID NO: 1490) |  |
| βc-3097 Target: | 5'-TCTGGTCCTTTTTGGTCGAGGAGTAAC-3' | (SEQ ID NO: 2599) |  |
|  | 5'-GUCCUUUUUGGUCGAGGAGUAACAA-3' | (SEQ ID NO: 3709) |  |
|  | 3'-ACCAGGAAAAACCAGCUCCUCAUUGUU-5' | (SEQ ID NO: 1491) |  |
| βc-3099 Target: | 5'-TGGTCCTTTTTGGTCGAGGAGTAACAA-3' | (SEQ ID NO: 2600) |  |
|  | 5'-CCUUUUUGGUCGAGGAGUAACAAUA-3' | (SEQ ID NO: 3710) |  |
|  | 3'-CAGGAAAAACCAGCUCCUCAUUGUUAU-5' | (SEQ ID NO: 1492) |  |
| βc-3101 Target: | 5'-GTCCTTTTTGGTCGAGGAGTAACAATA-3' | (SEQ ID NO: 2601) |  |
|  | 5'-UUUUUGGUCGAGGAGUAACAAUACA-3' | (SEQ ID NO: 3711) |  |
|  | 3'-GGAAAAACCAGCUCCUCAUUGUUAUGU-5' | (SEQ ID NO: 1493) |  |
| βc-3103 Target: | 5'-CCTTTTTGGTCGAGGAGTAACAATACA-3' | (SEQ ID NO: 2602) |  |
|  | 5'-UUUGGUCGAGGAGUAACAAUACAAA-3' | (SEQ ID NO: 3712) |  |
|  | 3'-AAAAACCAGCUCCUCAUUGUUAUGUUU-5' | (SEQ ID NO: 1494) |  |
| βc-3105 Target: | 5'-TTTTTGGTCGAGGAGTAACAATACAAA-3' | (SEQ ID NO: 2603) |  |

TABLE 6-continued

Selected Anti-β-catenin DsiRNA Agents, Unmodified Duplexes

|  |  |  |  |
|---|---|---|---|
|  | 5'-UGGUCGAGGAGUAACAAUACAAAUG-3' | (SEQ ID NO: 3713) |
|  | 3'-AAACCAGCUCCUCAUUGUUAUGUUUAC-5' | (SEQ ID NO: 1495) |
| βc-3107 Target: | 5'-TTTGGTCGAGGAGTAACAATACAAATG-3' | (SEQ ID NO: 2604) |
|  | 5'-GUCGAGGAGUAACAAUACAAAUGGA-3' | (SEQ ID NO: 3714) |
|  | 3'-ACCAGCUCCUCAUUGUUAUGUUUACCU-5' | (SEQ ID NO: 1496) |
| βc-3109 Target: | 5'-TGGTCGAGGAGTAACAATACAAATGGA-3' | (SEQ ID NO: 2605) |
|  | 5'-CGAGGAGUAACAAUACAAAUGGAUU-3' | (SEQ ID NO: 3715) |
|  | 3'-CAGCUCCUCAUUGUUAUGUUUACCUAA-5' | (SEQ ID NO: 1497) |
| βc-3111 Target: | 5'-GTCGAGGAGTAACAATACAAATGGATT-3' | (SEQ ID NO: 2606) |
|  | 5'-AGGAGUAACAAUACAAAUGGAUUUU-3' | (SEQ ID NO: 3716) |
|  | 3'-GCUCCUCAUUGUUAUGUUUACCUAAAA-5' | (SEQ ID NO: 1498) |
| βc-3113 Target: | 5'-CGAGGAGTAACAATACAAATGGATTTT-3' | (SEQ ID NO: 2607) |
|  | 5'-GAGUAACAAUACAAAUGGAUUUUGG-3' | (SEQ ID NO: 3717) |
|  | 3'-UCCUCAUUGUUAUGUUUACCUAAAACC-5' | (SEQ ID NO: 1499) |
| βc-3115 Target: | 5'-AGGAGTAACAATACAAATGGATTTTGG-3' | (SEQ ID NO: 2608) |
|  | 5'-UAUCAAACCCUAGCCUUGCUUGUUA-3' | (SEQ ID NO: 3718) |
|  | 3'-AAAUAGUUUGGGAUCGGAACGAACAAU-5' | (SEQ ID NO: 1500) |
| βc-3191 Target: | 5'-TTTATCAAACCCTAGCCTTGCTTGTTA-3' | (SEQ ID NO: 2609) |
|  | 5'-UCAAACCCUAGCCUUGCUUGUUAAA-3' | (SEQ ID NO: 3719) |
|  | 3'-AUAGUUUGGGAUCGGAACGAACAAUUU-5' | (SEQ ID NO: 1501) |
| βc-3193 Target: | 5'-TATCAAACCCTAGCCTTGCTTGTTAAA-3' | (SEQ ID NO: 2610) |
|  | 5'-AAACCCUAGCCUUGCUUGUUAAAUU-3' | (SEQ ID NO: 3720) |
|  | 3'-AGUUUGGGAUCGGAACGAACAAUUUAA-5' | (SEQ ID NO: 1502) |
| βc-3195 Target: | 5'-TCAAACCCTAGCCTTGCTTGTTAAATT-3' | (SEQ ID NO: 2611) |
|  | 5'-GAGUAAUGGUGUAGAACACUAAUUC-3' | (SEQ ID NO: 3721) |
|  | 3'-AACUCAUUACCACAUCUUGUGAUUAAG-5' | (SEQ ID NO: 1503) |
| βc-3387 Target: | 5'-TTGAGTAATGGTGTAGAACACTAATTC-3' | (SEQ ID NO: 2612) |
|  | 5'-GUAAUGGUGUAGAACACUAAUUCAU-3' | (SEQ ID NO: 3722) |
|  | 3'-CUCAUUACCACAUCUUGUGAUUAAGUA-5' | (SEQ ID NO: 1504) |
| βc-3389 Target: | 5'-GAGTAATGGTGTAGAACACTAATTC-3' | (SEQ ID NO: 2613) |
|  | 5'-AAUGGUGUAGAACACUAAUUCAUAA-3' | (SEQ ID NO: 3723) |
|  | 3'-CAUUACCACAUCUUGUGAUUAAGUAUU-5' | (SEQ ID NO: 1505) |
| βc-3391 Target: | 5'-GTAATGGTGTAGAACACTAATTCATAA-3' | (SEQ ID NO: 2614) |
|  | 5'-UGGUGUAGAACACUAAUUCAUAAUC-3' | (SEQ ID NO: 3724) |
|  | 3'-UUACCACAUCUUGUGAUUAAGUAUUAG-5' | (SEQ ID NO: 1506) |
| βc-3393 Target: | 5'-AATGGTGTAGAACACTAATTCATAATC-3' | (SEQ ID NO: 2615) |
|  | 5'-GUGUAGAACACUAAUUCAUAAUCAC-3' | (SEQ ID NO: 3725) |
|  | 3'-ACCACAUCUUGUGAUUAAGUAUUAGUG-5' | (SEQ ID NO: 1507) |
| βc-3395 Target: | 5'-TGGTGTAGAACACTAATTCATAATCAC-3' | (SEQ ID NO: 2616) |

TABLE 6-continued

Selected Anti-β-catenin DsiRNA Agents, Unmodified Duplexes

|  |  |  |  |
|---|---|---|---|
|  | 5'-GUAGAACACUAAUUCAUAAUCACUC-3' | (SEQ ID NO: 3726) |
|  | 3'-CACAUCUUGUGAUUAAGUAUUAGUGAG-5' | (SEQ ID NO: 1508) |
| βc-3397 Target: | 5'-GTGTAGAACACTAATTCATAATCACTC-3' | (SEQ ID NO: 2617) |
|  | 5'-AGAACACUAAUUCAUAAUCACUCUA-3' | (SEQ ID NO: 3727) |
|  | 3'-CAUCUUGUGAUUAAGUAUUAGUGAGAU-5' | (SEQ ID NO: 1509) |
| βc-3399 Target: | 5'-GTAGAACACTAATTCATAATCACTCTA-3' | (SEQ ID NO: 2618) |
|  | 5'-AACACUAAUUCAUAAUCACUCUAAU-3' | (SEQ ID NO: 3728) |
|  | 3'-UCUUGUGAUUAAGUAUUAGUGAGAUUA-5' | (SEQ ID NO: 1510) |
| βc-3401 Target: | 5'-AGAACACTAATTCATAATCACTCTAAT-3' | (SEQ ID NO: 2619) |
|  | 5'-UUAGUUUCCUUUUUAAUAUGCUUAA-3' | (SEQ ID NO: 3729) |
|  | 3'-UUAAUCAAAGGAAAAAUUAUACGAAUU-5' | (SEQ ID NO: 1511) |
| βc-3500 Target: | 5'-AATTAGTTTCCTTTTAATATGCTTAA-3' | (SEQ ID NO: 2620) |
|  | 5'-AGUUUCCUUUUAAUAUGCUUAAAA-3' | (SEQ ID NO: 3730) |
|  | 3'-AAUCAAAGGAAAAAUUAUACGAAUUUU-5' | (SEQ ID NO: 1512) |
| βc-3502 Target: | 5'-TTAGTTTCCTTTTTAATATGCTTAAAA-3' | (SEQ ID NO: 2621) |
|  | 5'-UUUCCUUUUUAAUAUGCUUAAAAUA-3' | (SEQ ID NO: 3731) |
|  | 3'-UCAAAGGAAAAAUUAUACGAAUUUUAU-5' | (SEQ ID NO: 1513) |
| βc-3504 Target: | 5'-AGTTTCCTTTTTAATATGCTTAAAATA-3' | (SEQ ID NO: 2622) |
|  | 5'-UCCUUUUUAAUAUGCUUAAAAUAAG-3' | (SEQ ID NO: 3732) |
|  | 3'-AAAGGAAAAAUUAUACGAAUUUUAUUC-5' | (SEQ ID NO: 1514) |
| βc-3506 Target: | 5'-TTTCCTTTTTAATATGCTTAAAATAAG-3' | (SEQ ID NO: 2623) |
|  | 5'-CUUUUUAAUAUGCUUAAAAUAAGCA-3' | (SEQ ID NO: 3733) |
|  | 3'-AGGAAAAAUUAUACGAAUUUUAUUCGU-5' | (SEQ ID NO: 1515) |
| βc-3508 Target: | 5'-TCCTTTTTAATATGCTTAAAATAAGCA-3' | (SEQ ID NO: 2624) |
|  | 5'-UUUUUAAUAUGCUUAAAAUAAGCAG-3' | (SEQ ID NO: 3734) |
|  | 3'-GGAAAAAUUAUACGAAUUUUAUUCGUC-5' | (SEQ ID NO: 1516) |
| βc-3509 Target: | 5'-CCTTTTTAATATGCTTAAAATAAGCAG-3' | (SEQ ID NO: 2625) |
|  | 5'-UUUUAAUAUGCUUAAAAUAAGCAGG-3' | (SEQ ID NO: 3735) |
|  | 3'-GAAAAAUUAUACGAAUUUUAUUCGUCC-5' | (SEQ ID NO: 1517) |
| βc-3510 Target: | 5'-CTTTTTAATATGCTTAAAATAAGCAGG-3' | (SEQ ID NO: 2626) |
|  | 5'-UUAAUAUGCUUAAAAUAAGCAGGUG-3' | (SEQ ID NO: 3736) |
|  | 3'-AAAAUUAUACGAAUUUUAUUCGUCCAC-5' | (SEQ ID NO: 1518) |
| βc-3512 Target: | 5'-TTTTTAATATGCTTAAAATAAGCAGGTG-3' | (SEQ ID NO: 2627) |
|  | 5'-AAUAUGCUUAAAAUAAGCAGGUGGA-3' | (SEQ ID NO: 3737) |
|  | 3'-AAUUAUACGAAUUUUAUUCGUCCACCU-5' | (SEQ ID NO: 1519) |
| βc-3514 Target: | 5'-TTAATATGCTTAAAATAAGCAGGTGGA-3' | (SEQ ID NO: 2628) |
|  | 5'-UAUGCUUAAAAUAAGCAGGUGGAUC-3' | (SEQ ID NO: 3738) |
|  | 3'-UUAUACGAAUUUUAUUCGUCCACCUAG-5' | (SEQ ID NO: 1520) |
| βc-3516 Target: | 5'-AATATGCTTAAAATAAGCAGGTGGATC-3' | (SEQ ID NO: 2629) |

TABLE 6-continued

Selected Anti-β-catenin DsiRNA Agents, Unmodified Duplexes

|  |  |  |  |
|---|---|---|---|
|  | 5'-UGCUUAAAAUAAGCAGGUGGAUCUA-3' | (SEQ ID NO: 3739) |
|  | 3'-AUACGAAUUUUAUUCGUCCACCUAGAU-5' | (SEQ ID NO: 1521) |
| βc-3518 Target: | 5'-TATGCTTAAAATAAGCAGGTGGATCTA-3' | (SEQ ID NO: 2630) |
|  | 5'-CUUAAAAUAAGCAGGUGGAUCUAUU-3' | (SEQ ID NO: 3740) |
|  | 3'-ACGAAUUUUAUUCGUCCACCUAGAUAA-5' | (SEQ ID NO: 1522) |
| βc-3520 Target: | 5'-TGCTTAAAATAAGCAGGTGGATCTATT-3' | (SEQ ID NO: 2631) |
|  | 5'-UAAAAUAAGCAGGUGGAUCUAUUUC-3' | (SEQ ID NO: 3741) |
|  | 3'-GAAUUUUAUUCGUCCACCUAGAUAAAG-5' | (SEQ ID NO: 1523) |
| βc-3522 Target: | 5'-CTTAAAATAAGCAGGTGGATCTATTTC-3' | (SEQ ID NO: 2632) |
|  | 5'-AAAUAAGCAGGUGGAUCUAUUUCAU-3' | (SEQ ID NO: 3742) |
|  | 3'-AUUUUAUUCGUCCACCUAGAUAAAGUA-5' | (SEQ ID NO: 1524) |
| βc-3524 Target: | 5'-TAAAATAAGCAGGTGGATCTATTTC-3' | (SEQ ID NO: 2633) |
|  | 5'-AUAAGCAGGUGGAUCUAUUUCAUGU-3' | (SEQ ID NO: 3743) |
|  | 3'-UUUAUUCGUCCACCUAGAUAAAGUACA-5' | (SEQ ID NO: 1525) |
| βc-3526 Target: | 5'-AAATAAGCAGGTGGATCTATTTCATGT-3' | (SEQ ID NO: 2634) |
|  | 5'-AAGCAGGUGGAUCUAUUUCAUGUUU-3' | (SEQ ID NO: 3744) |
|  | 3'-UAUUCGUCCACCUAGAUAAAGUACAAA-5' | (SEQ ID NO: 1526) |
| βc-3528 Target: | 5'-ATAAGCAGGTGGATCTATTTCATGTTT-3' | (SEQ ID NO: 2635) |
|  | 5'-GCAGGUGGAUCUAUUUCAUGUUUUU-3' | (SEQ ID NO: 3745) |
|  | 3'-UUCGUCCACCUAGAUAAAGUACAAAAA-5' | (SEQ ID NO: 1527) |
| βc-3530 Target: | 5'-AAGCAGGTGGATCTATTTCATGTTTTT-3' | (SEQ ID NO: 2636) |
|  | 5'-AGGUGGAUCUAUUUCAUGUUUUUGA-3' | (SEQ ID NO: 3746) |
|  | 3'-CGUCCACCUAGAUAAAGUACAAAAACU-5' | (SEQ ID NO: 1528) |
| βc-3532 Target: | 5'-GCAGGTGGATCTATTTCATGTTTTTGA-3' | (SEQ ID NO: 2637) |
|  | 5'-GUGGAUCUAUUUCAUGUUUUUGAUC-3' | (SEQ ID NO: 3747) |
|  | 3'-UCCACCUAGAUAAAGUACAAAAACUAG-5' | (SEQ ID NO: 1529) |
| βc-3534 Target: | 5'-AGGTGGATCTATTTCATGTTTTTGATC-3' | (SEQ ID NO: 2638) |
|  | 5'-GGAUCUAUUUCAUGUUUUUGAUCAA-3' | (SEQ ID NO: 3748) |
|  | 3'-CACCUAGAUAAAGUACAAAAACUAGUU-5' | (SEQ ID NO: 1530) |
| βc-3536 Target: | 5'-GTGGATCTATTTCATGTTTTTGATCAA-3' | (SEQ ID NO: 2639) |
|  | 5'-AUCUAUUUCAUGUUUUUGAUCAAAA-3' | (SEQ ID NO: 3749) |
|  | 3'-CCUAGAUAAAGUACAAAAACUAGUUUU-5' | (SEQ ID NO: 1531) |
| βc-3538 Target: | 5'-GGATCTATTTCATGTTTTTGATCAAAA-3' | (SEQ ID NO: 2640) |
|  | 5'-GUAGGGUAAAUCAGUAAGAGGUGUU-3' | (SEQ ID NO: 3750) |
|  | 3'-CCCAUCCCAUUUAGUCAUUCUCCACAA-5' | (SEQ ID NO: 1532) |
| βc-3583 Target: | 5'-GGGTAGGGTAAATCAGTAAGAGGTGTT-3' | (SEQ ID NO: 2641) |
|  | 5'-AGGGUAAAUCAGUAAGAGGUGUUAU-3' | (SEQ ID NO: 3751) |
|  | 3'-CAUCCCAUUUAGUCAUUCUCCACAAUA-5' | (SEQ ID NO: 1533) |
| βc-3585 Target: | 5'-GTAGGGTAAATCAGTAAGAGGTGTTAT-3' | (SEQ ID NO: 2642) |

TABLE 6-continued

Selected Anti-β-catenin DsiRNA Agents, Unmodified Duplexes

|  | | |
|---|---|---|
| | 5'-GGUAAAUCAGUAAGAGGUGUUAUUU-3' | (SEQ ID NO: 3752) |
| | 3'-UCCCAUUUAGUCAUUCUCCACAAUAAA-5' | (SEQ ID NO: 1534) |
| βc-3587 Target: | 5'-AGGGTAAATCAGTAAGAGGTGTTATTT-3' | (SEQ ID NO: 2643) |
| | 5'-UAAAUCAGUAAGAGGUGUUAUUUGG-3' | (SEQ ID NO: 3753) |
| | 3'-CCAUUUAGUCAUUCUCCACAAUAAACC-5' | (SEQ ID NO: 1535) |
| βc-3589 Target: | 5'-GGTAAATCAGTAAGAGGTGTTATTTGG-3' | (SEQ ID NO: 2644) |
| | 5'-AAUCAGUAAGAGGUGUUAUUUGGAA-3' | (SEQ ID NO: 3754) |
| | 3'-AUUUAGUCAUUCUCCACAAUAAACCUU-5' | (SEQ ID NO: 1536) |
| βc-3591 Target: | 5'-TAAATCAGTAAGAGGTGTTATTTGGAA-3' | (SEQ ID NO: 2645) |
| | 5'-UCAGUAAGAGGUGUUAUUUGGAACC-3' | (SEQ ID NO: 3755) |
| | 3'-UUAGUCAUUCUCCACAAUAAACCUUGG-5' | (SEQ ID NO: 1537) |
| βc-3593 Target: | 5'-AATCAGTAAGAGGTGTTATTTGGAACC-3' | (SEQ ID NO: 2646) |
| | 5'-UACCAGUUGCCUUUUAUCCCAAAGU-3' | (SEQ ID NO: 3756) |
| | 3'-AAAUGGUCAACGGAAAAUAGGGUUUCA-5' | (SEQ ID NO: 1538) |
| βc-3633 Target: | 5'-TTTACCAGTTGCCTTTTATCCCAAAGT-3' | (SEQ ID NO: 2647) |
| | 5'-CCAGUUGCCUUUUAUCCCAAAGUUG-3' | (SEQ ID NO: 3757) |
| | 3'-AUGGUCAACGGAAAAUAGGGUUUCAAC-5' | (SEQ ID NO: 1539) |
| βc-3635 Target: | 5'-TACCAGTTGCCTTTTATCCCAAAGTTG-3' | (SEQ ID NO: 2648) |
| | 5'-AGUUGCCUUUUAUCCCAAAGUUGUU-3' | (SEQ ID NO: 3758) |
| | 3'-GGUCAACGGAAAAUAGGGUUUCAACAA-5' | (SEQ ID NO: 1540) |
| βc-3637 Target: | 5'-CCAGTTGCCTTTTATCCCAAAGTTGTT-3' | (SEQ ID NO: 2649) |
| | 5'-UUGCCUUUUAUCCCAAAGUUGUUGU-3' | (SEQ ID NO: 3759) |
| | 3'-UCAACGGAAAAUAGGGUUUCAACAACA-5' | (SEQ ID NO: 1541) |
| βc-3639 Target: | 5'-AGTTGCCTTTTATCCCAAAGTTGTTGT-3' | (SEQ ID NO: 2650) |
| | 5'-GCCUUUUAUCCCAAAGUUGUUGUAA-3' | (SEQ ID NO: 3760) |
| | 3'-AACGGAAAAUAGGGUUUCAACAACAUU-5' | (SEQ ID NO: 1542) |
| βc-3641 Target: | 5'-TTGCCTTTTATCCCAAAGTTGTTGTAA-3' | (SEQ ID NO: 2651) |
| | 5'-CUUUUAUCCCAAAGUUGUUGUAACC-3' | (SEQ ID NO: 3761) |
| | 3'-CGGAAAAUAGGGUUUCAACAACAUUGG-5' | (SEQ ID NO: 1543) |
| βc-3643 Target: | 5'-GCCTTTTATCCCAAAGTTGTTGTAACC-3' | (SEQ ID NO: 2652) |
| | 5'-UUUAUCCCAAAGUUGUUGUAACCUG-3' | (SEQ ID NO: 3762) |
| | 3'-GAAAAUAGGGUUUCAACAACAUUGGAC-5' | (SEQ ID NO: 1544) |
| βc-3645 Target: | 5'-CTTTTATCCCAAAGTTGTTGTAACCTG-3' | (SEQ ID NO: 2653) |
| | 5'-UAUCCCAAAGUUGUUGUAACCUGCU-3' | (SEQ ID NO: 3763) |
| | 3'-AAAUAGGGUUUCAACAACAUUGGACGA-5' | (SEQ ID NO: 1545) |
| βc-3647 Target: | 5'-TTTATCCCAAAGTTGTTGTAACCTGCT-3' | (SEQ ID NO: 2654) |
| | 5'-UCCCAAAGUUGUUGUAACCUGCUGU-3' | (SEQ ID NO: 3764) |
| | 3'-AUAGGGUUUCAACAACAUUGGACGACA-5' | (SEQ ID NO: 1546) |
| βc-3649 Target: | 5'-TATCCCAAAGTTGTTGTAACCTGCTGT-3' | (SEQ ID NO: 2655) |

TABLE 6-continued

Selected Anti-β-catenin DsiRNA Agents, Unmodified Duplexes

|  |  |  |  |
|---|---|---|---|
|  | 5'-CCAAAGUUGUUGUAACCUGCUGUGA-3' | (SEQ ID NO: 3765) |
|  | 3'-AGGGUUUCAACAACAUUGGACGACACU-5' | (SEQ ID NO: 1547) |
| βc-3651 Target: | 5'-TCCCAAAGTTGTTGTAACCTGCTGTGA-3' | (SEQ ID NO: 2656) |
|  | 5'-AAAGUUGUUGUAACCUGCUGUGAUA-3' | (SEQ ID NO: 3766) |
|  | 3'-GGUUUCAACAACAUUGGACGACACUAU-5' | (SEQ ID NO: 1548) |
| βc-3653 Target: | 5'-CCAAAGTTGTTGTAACCTGCTGTGATA-3' | (SEQ ID NO: 2657) |
|  | 5'-AGUUGUUGUAACCUGCUGUGAUACG-3' | (SEQ ID NO: 3767) |
|  | 3'-UUUCAACAACAUUGGACGACACUAUGC-5' | (SEQ ID NO: 1549) |
| βc-3655 Target: | 5'-AAAGTTGTTGTAACCTGCTGTGATACG-3' | (SEQ ID NO: 2658) |
|  | 5'-UUGUUGUAACCUGCUGUGAUACGAU-3' | (SEQ ID NO: 3768) |
|  | 3'-UCAACAACAUUGGACGACACUAUGCUA-5' | (SEQ ID NO: 1550) |
| βc-3657 Target: | 5'-AGTTGTTGTAACCTGCTGTGATACGAT-3' | (SEQ ID NO: 2659) |
|  | 5'-GUUGUAACCUGCUGUGAUACGAUGC-3' | (SEQ ID NO: 3769) |
|  | 3'-AACAACAUUGGACGACACUAUGCUACG-5' | (SEQ ID NO: 1551) |
| βc-3659 Target: | 5'-TTGTTGTAACCTGCTGTGATACGATGC-3' | (SEQ ID NO: 2660) |
|  | 5'-AAAUGGUUCAGAAUUAAACUUUUAA-3' | (SEQ ID NO: 3770) |
|  | 3'-UUUUUACCAAGUCUUAAUUUGAAAAUU-5' | (SEQ ID NO: 1552) |
| βc-3708 Target: | 5'-AAAAATGGTTCAGAATTAAACTTTTAA-3' | (SEQ ID NO: 2661) |
|  | 5'-AUGGUUCAGAAUUAAACUUUUAAUU-3' | (SEQ ID NO: 3771) |
|  | 3'-UUUACCAAGUCUUAAUUUGAAAAUUAA-5' | (SEQ ID NO: 1553) |
| βc-3710 Target: | 5'-AAATGGTTCAGAATTAAACTTTTAATT-3' | (SEQ ID NO: 2662) |
|  | 5'-GGUUCAGAAUUAAACUUUUAAUUCA-3' | (SEQ ID NO: 3772) |
|  | 3'-UACCAAGUCUUAAUUUGAAAAUUAAGU-5' | (SEQ ID NO: 1554) |
| βc-3712 Target: | 5'-ATGGTTCAGAATTAAACTTTTAATTCA-3' | (SEQ ID NO: 2663) |
|  | 5'-UUCAGAAUUAAACUUUUAAUUCAUU-3' | (SEQ ID NO: 3773) |
|  | 3'-CCAAGUCUUAAUUUGAAAAUUAAGUAA-5' | (SEQ ID NO: 1555) |
| βc-3714 Target: | 5'-GGTTCAGAATTAAACTTTTAATTCATT-3' | (SEQ ID NO: 2664) |
|  | 5'-CAGAAUUAAACUUUUAAUUCAUUCG-3' | (SEQ ID NO: 3774) |
|  | 3'-AAGUCUUAAUUUGAAAAUUAAGUAAGC-5' | (SEQ ID NO: 1556) |
| βc-3716 Target: | 5'-TTCAGAATTAAACTTTTAATTCATTCG-3' | (SEQ ID NO: 2665) |
|  | 5'-GCAGCAGUCUUACUUGGAUUCUGGA-3' | (SEQ ID NO: 3775) |
|  | 3'-GUCGUCGUCAGAAUGAACCUAAGACCU-5' | (SEQ ID NO: 1557) |
| βc-m314 Target: | 5'-CAGCAGCAGTCTTACTTGGATTCTGGA-3' | (SEQ ID NO: 2666) |
|  | 5'-ACUUGGAUUCUGGAAUCCAUUCUGG-3' | (SEQ ID NO: 3776) |
|  | 3'-AAUGAACCUAAGACCUUAGGUAAGACC-5' | (SEQ ID NO: 1558) |
| βc-m325 Target: | 5'-TTACTTGGATTCTGGAATCCATTCTGG-3' | (SEQ ID NO: 2667) |
|  | 5'-GACACCUCCCAAGUCCUUUAUGAAU-3' | (SEQ ID NO: 3777) |
|  | 3'-AACUGUGGAGGGUUCAGGAAAUACUUA-5' | (SEQ ID NO: 1559) |
| βc-m408 Target: | 5'-TTGACACCTCCCAAGTCCTTTATGAAT-3' | (SEQ ID NO: 2668) |

TABLE 6-continued

Selected Anti-β-catenin DsiRNA Agents, Unmodified Duplexes

|  |  |  |
|---|---|---|
|  | 5'-CGCAAGAGCAAGUAGCUGAUAUUGA-3' | (SEQ ID NO: 3778) |
|  | 3'-GUGCGUUCUCGUUCAUCGACUAUAACU-5' | (SEQ ID NO: 1560) |
| βc-m460 Target: | 5'-CACGCAAGAGCAAGTAGCTGATATTGA-3' | (SEQ ID NO: 2669) |
|  | 5'-CCAUGUUCCCUGAGACGCUAGAUGA-3' | (SEQ ID NO: 3779) |
|  | 3'-ACGGUACAAGGGACUCUGCGAUCUACU-5' | (SEQ ID NO: 1561) |
| βc-m526 Target: | 5'-TGCCATGTTCCCTGAGACGCTAGATGA-3' | (SEQ ID NO: 2670) |
|  | 5'-UGAAACAUGCAGUUGUCAAUUUGAU-3' | (SEQ ID NO: 3780) |
|  | 3'-CAACUUUGUACGUCAACAGUUAAACUA-5' | (SEQ ID NO: 1562) |
| βc-m631 Target: | 5'-GTTGAAACATGCAGTTGTCAATTTGAT-3' | (SEQ ID NO: 2671) |
|  | 5'-CAUGCAGUUGUCAAUUUGAUUAACU-3' | (SEQ ID NO: 3781) |
|  | 3'-UUGUACGUCAACAGUUAAACUAAUUGA-5' | (SEQ ID NO: 1563) |
| βc-m636 Target: | 5'-AACATGCAGTTGTCAATTTGATTAACT-3' | (SEQ ID NO: 2672) |
|  | 5'-GUUGUCAAUUUGAUUAACUAUCAGG-3' | (SEQ ID NO: 3782) |
|  | 3'-GUCAACAGUUAAACUAAUUGAUAGUCC-5' | (SEQ ID NO: 1564) |
| βc-m642 Target: | 5'-CAGTTGTCAATTTGATTAACTATCAGG-3' | (SEQ ID NO: 2673) |
|  | 5'-GAGGACCAGGUGGUAGUUAAUAAAG-3' | (SEQ ID NO: 3783) |
|  | 3'-UACUCCUGGUCCACCAUCAAUUAUUUC-5' | (SEQ ID NO: 1565) |
| βc-m723 Target: | 5'-ATGAGGACCAGGTGGTAGTTAATAAAG-3' | (SEQ ID NO: 2674) |
|  | 5'-GGUCACCAGUGGAUUCUGUACUGUU-3' | (SEQ ID NO: 3784) |
|  | 3'-ACCCAGUGGUCACCUAAGACAUGACAA-5' | (SEQ ID NO: 1566) |
| βc-m970 Target: | 5'-TGGGTCACCAGTGGATTCTGTACTGTT-3' | (SEQ ID NO: 2675) |
|  | 5'-CAGUGGAUUCUGUACUGUUCUACGC-3' | (SEQ ID NO: 3785) |
|  | 3'-UGGUCACCUAAGACAUGACAAGAUGCG-5' | (SEQ ID NO: 1567) |
| βc-m976 Target: | 5'-ACCAGTGGATTCTGTACTGTTCTACGC-3' | (SEQ ID NO: 2676) |
|  | 5'-GAUUCUGUACUGUUCUACGCCAUCA-3' | (SEQ ID NO: 3786) |
|  | 3'-ACCUAAGACAUGACAAGAUGCGGUAGU-5' | (SEQ ID NO: 1568) |
| βc-m981 Target: | 5'-TGGATTCTGTACTGTTCTACGCCATCA-3' | (SEQ ID NO: 2677) |
|  | 5'-GUGGACUGCAGAAAAUGGUUGCUUU-3' | (SEQ ID NO: 3787) |
|  | 3'-ACCACCUGACGUCUUUUACCAACGAAA-5' | (SEQ ID NO: 1569) |
| βc-m1066 Target: | 5'-TGGTGGACTGCAGAAAATGGTTGCTTT-3' | (SEQ ID NO: 2678) |
|  | 5'-CGUGAAAUUCUUGGCUAUUACAACA-3' | (SEQ ID NO: 3788) |
|  | 3'-UUGCACUUUAAGAACCGAUAAUGUUGU-5' | (SEQ ID NO: 1570) |
| βc-m1106 Target: | 5'-AACGTGAAATTCTTGGCTATTACAACA-3' | (SEQ ID NO: 2679) |
|  | 5'-CAAGUCAGCGACUUGUUCAAAACUG-3' | (SEQ ID NO: 3789) |
|  | 3'-GGGUUCAGUCGCUGAACAAGUUUUGAC-5' | (SEQ ID NO: 1571) |
| βc-m1354 Target: | 5'-CCCAAGTCAGCGACTTGTTCAAAACTG-3' | (SEQ ID NO: 2680) |
|  | 5'-GACUUGUUCAAAACUGUCUUUGGAC-3' | (SEQ ID NO: 3790) |
|  | 3'-CGCUGAACAAGUUUUGACAGAAACCUG-5' | (SEQ ID NO: 1572) |
| βc-m1363 Target: | 5'-GCGACTTGTTCAAAACTGTCTTTGGAC-3' | (SEQ ID NO: 2681) |

TABLE 6-continued

Selected Anti-β-catenin DsiRNA Agents, Unmodified Duplexes

```
              5'-AAACUGUCUUUGGACUCUCAGAAAC-3'    (SEQ ID NO: 3791)
              3'-GUUUUGACAGAAACCUGAGAGUCUUUG-5'  (SEQ ID NO: 1573)

βc-m1373 Target: 5'-CAAAACTGTCTTTGGACTCTCAGAAAC-3'  (SEQ ID NO: 2682)

5'-CUCUAACCUCACUUGCAAUAAUUAC-3'    (SEQ ID NO: 3792)
              3'-GAGAGAUUGGAGUGAACGUUAUUAAUG-5'  (SEQ ID NO: 1574)

βc-m1508 Target: 5'-CTCTCTAACCTCACTTGCAATAATTAC-3'  (SEQ ID NO: 2683)

5'-CUCACUUGCAAUAAUUACAAAAACA-3'    (SEQ ID NO: 3793)
              3'-UGGAGUGAACGUUAUUAAUGUUUUUGU-5'  (SEQ ID NO: 1575)

βc-m1515 Target: 5'-ACCTCACTTGCAATAATTACAAAAACA-3'  (SEQ ID NO: 2684)

5'-GAAUGCCGUUCGCCUUCAUUAUGGA-3'    (SEQ ID NO: 3794)
              3'-GUCUUACGGCAAGCGGAAGUAAUACCU-5'  (SEQ ID NO: 1576)

βc-m1682 Target: 5'-CAGAATGCCGTTCGCCTTCATTATGGA-3'  (SEQ ID NO: 2685)

5'-GCCUUCAUUAUGGACUGCCUGUUGU-3'    (SEQ ID NO: 3795)
              3'-AGCGGAAGUAAUACCUGACGGACAACA-5'  (SEQ ID NO: 1577)

βc-m1693 Target: 5'-TCGCCTTCATTATGGACTGCCTGTTGT-3'  (SEQ ID NO: 2686)

5'-CAUUAUGGACUGCCUGUUGUGGUUA-3'    (SEQ ID NO: 3796)
              3'-AAGUAAUACCUGACGGACAACACCAAU-5'  (SEQ ID NO: 1578)

βc-m1698 Target: 5'-TTCATTATGGACTGCCTGTTGTGGTTA-3'  (SEQ ID NO: 2687)

5'-GACUGCCUGUUGUGGUUAAACUCCU-3'    (SEQ ID NO: 3797)
              3'-ACCUGACGGACAACACCAAUUUGAGGA-5'  (SEQ ID NO: 1579)

βc-m1705 Target: 5'-TGGACTGCCTGTTGTGGTTAAACTCCT-3'  (SEQ ID NO: 2688)

5'-AACUGUUGGAUUGAUUCGAAACCUU-3'    (SEQ ID NO: 3798)
              3'-CGUUGACAACCUAACUAAGCUUUGGAA-5'  (SEQ ID NO: 1580)

βc-m1763 Target: 5'-GCAACTGTTGGATTGATTCGAAACCTT-3'  (SEQ ID NO: 2689)

5'-GAGGACUCAAUACCAUUCCAUUGUU-3'    (SEQ ID NO: 3799)
              3'-GGCUCCUGAGUUAUGGUAAGGUAACAA-5'  (SEQ ID NO: 1581)

βc-m2008 Target: 5'-CCGAGGACTCAATACCATTCCATTGTT-3'  (SEQ ID NO: 2690)

5'-GAGGACAAGCCACAGGAUUACAAGA-3'    (SEQ ID NO: 3800)
              3'-GACUCCUGUUCGGUGUCCUAAUGUUCU-5'  (SEQ ID NO: 1582)

βc-m2226 Target: 5'-CTGAGGACAAGCCACAGGATTACAAGA-3'  (SEQ ID NO: 2691)

5'-AUGGACCCUAUGAUGGAGCAUGAGA-3'    (SEQ ID NO: 3801)
              3'-CCUACCUGGGAUACUACCUCGUACUCU-5'  (SEQ ID NO: 1583)

βc-m2427 Target: 5'-GGATGGACCCTATGATGGAGCATGAGA-3'  (SEQ ID NO: 2692)

5'-GAUACUGACCUGUAAAUCGUCCUUU-3'    (SEQ ID NO: 3802)
              3'-AACUAUGACUGGACAUUUAGCAGGAAA-5'  (SEQ ID NO: 1584)

βc-m2568 Target: 5'-TTGATACTGACCTGTAAATCGTCCTTT-3'  (SEQ ID NO: 2693)

5'-CCAGUGUGGGUGAAUACUUUACUCU-3'    (SEQ ID NO: 3803)
              3'-UCGGUCACACCCACUUAUGAAAUGAGA-5'  (SEQ ID NO: 1585)

βc-m2614 Target: 5'-AGCCAGTGTGGGTGAATACTTTACTCT-3'  (SEQ ID NO: 2694)
```

TABLE 6-continued

Selected Anti-β-catenin DsiRNA Agents, Unmodified Duplexes

|  |  |  |
|---|---|---|
|  | 5'-CCACAGCUUUUGCAGCGUUAUACUC-3' | (SEQ ID NO: 3804) |
|  | 3'-ACGGUGUCGAAAACGUCGCAAUAUGAG-5' | (SEQ ID NO: 1586) |
| βc-m2770 Target: | 5'-TGCCACAGCTTTTGCAGCGTTATACTC-3' | (SEQ ID NO: 2695) |
|  | 5'-UUUUGCAGCGUUAUACUCAGAUGAG-3' | (SEQ ID NO: 3805) |
|  | 3'-CGAAAACGUCGCAAUAUGAGUCUACUC-5' | (SEQ ID NO: 1587) |
| βc-m2777 Target: | 5'-GCTTTTGCAGCGTTATACTCAGATGAG-3' | (SEQ ID NO: 2696) |
|  | 5'-GCGUUAUACUCAGAUGAGUAACAUU-3' | (SEQ ID NO: 3806) |
|  | 3'-GUCGCAAUAUGAGUCUACUCAUUGUAA-5' | (SEQ ID NO: 1588) |
| βc-m2784 Target: | 5'-CAGCGTTATACTCAGATGAGTAACATT-3' | (SEQ ID NO: 2697) |
|  | 5'-AUUUGCUGUUUUCAACAUUAAUAGC-3' | (SEQ ID NO: 3807) |
|  | 3'-UGUAAACGACAAAAGUUGUAAUUAUCG-5' | (SEQ ID NO: 1589) |
| βc-m2806 Target: | 5'-ACATTTGCTGTTTTCAACATTAATAGC-3' | (SEQ ID NO: 2698) |
|  | 5'-CUGUAGUGUCUGAACGUGCAUUGUG-3' | (SEQ ID NO: 3808) |
|  | 3'-UCGACAUCACAGACUUGCACGUAACAC-5' | (SEQ ID NO: 1590) |
| βc-m2850 Target: | 5'-AGCTGTAGTGTCTGAACGTGCATTGTG-3' | (SEQ ID NO: 2699) |
|  | 5'-GAACAGUCGAAGUACGCUUUUUGUU-3' | (SEQ ID NO: 3809) |
|  | 3'-CCCUUGUCAGCUUCAUGCGAAAAACAA-5' | (SEQ ID NO: 1591) |
| βc-m2965 Target: | 5'-GGGAACAGTCGAAGTACGCTTTTTGTT-3' | (SEQ ID NO: 2700) |
|  | 5'-GUCGAAGUACGCUUUUUGUUCUGGU-3' | (SEQ ID NO: 3810) |
|  | 3'-GUCAGCUUCAUGCGAAAAACAAGACCA-5' | (SEQ ID NO: 1592) |
| βc-m2970 Target: | 5'-CAGTCGAAGTACGCTTTTTGTTCTGGT-3' | (SEQ ID NO: 2701) |
|  | 5'-GUACGCUUUUUGUUCUGGUCCUUUU-3' | (SEQ ID NO: 3811) |
|  | 3'-UUCAUGCGAAAAACAAGACCAGGAAAA-5' | (SEQ ID NO: 1593) |
| βc-m2976 Target: | 5'-AAGTACGCTTTTTGTTCTGGTCCTTTT-3' | (SEQ ID NO: 2702) |
|  | 5'-CCUAGCCUUGCUUGUUCUUUGUUUU-3' | (SEQ ID NO: 3812) |
|  | 3'-UGGGAUCGGAACGAACAAGAAACAAAA-5' | (SEQ ID NO: 1594) |
| βc-m3092 Target: | 5'-ACCCTAGCCTTGCTTGTTCTTTGTTTT-3' | (SEQ ID NO: 2703) |
|  | 5'-CCUUGCUUGUUCUUUGUUUUAAUAU-3' | (SEQ ID NO: 3813) |
|  | 3'-UCGGAACGAACAAGAAACAAAAUUAUA-5' | (SEQ ID NO: 1595) |
| βc-m3097 Target: | 5'-AGCCTTGCTTGTTCTTTGTTTTAATAT-3' | (SEQ ID NO: 2704) |
|  | 5'-AACCUGCUACAGCAAUUUCUGAUUU-3' | (SEQ ID NO: 3814) |
|  | 3'-ACUUGGACGAUGUCGUUAAAGACUAAA-5' | (SEQ ID NO: 1596) |
| βc-m3198 Target: | 5'-TGAACCTGCTACAGCAATTTCTGATTT-3' | (SEQ ID NO: 2705) |
|  | 5'-CAGCAAUUUCUGAUUUCUAAGAACC-3' | (SEQ ID NO: 3815) |
|  | 3'-AUGUCGUUAAAGACUAAAGAUUCUUGG-5' | (SEQ ID NO: 1597) |
| βc-m3207 Target: | 5'-TACAGCAATTTCTGATTTCTAAGAACC-3' | (SEQ ID NO: 2706) |
|  | 5'-GUAAGAGGUGUUAUUUGAGCCUUGU-3' | (SEQ ID NO: 3816) |
|  | 3'-GUCAUUCUCCACAAUAAACUCGGAACA-5' | (SEQ ID NO: 1598) |
| βc-m3433 Target: | 5'-CAGTAAGAGGTGTTATTTGAGCCTTGT-3' | (SEQ ID NO: 2707) |

TABLE 6-continued

Selected Anti-β-catenin DsiRNA Agents, Unmodified Duplexes

```
                  5'-GGUGUUAUUUGAGCCUUGUUUUGGA-3'       (SEQ ID NO: 3817)

3'-CUCCACAAUAAACUCGGAACAAAACCU-5'     (SEQ ID NO: 1599)

βc-m3439 Target:  5'-GAGGTGTTATTTGAGCCTTGTTTTGGA-3'     (SEQ ID NO: 2708)

5'-UAUUUGAGCCUUGUUUUGGACAGUA-3'       (SEQ ID NO: 3818)

3'-CAAUAAACUCGGAACAAAACCUGUCAU-5'     (SEQ ID NO: 1600)

βc-m3444 Target:  5'-GTTATTTGAGCCTTGTTTTGGACAGTA-3'     (SEQ ID NO: 2709)

5'-GAGCCUUGUUUUGGACAGUAUACCA-3'       (SEQ ID NO: 3819)

3'-AACUCGGAACAAAACCUGUCAUAUGGU-5'     (SEQ ID NO: 1601)

βc-m3449 Target:  5'-TTGAGCCTTGTTTTGGACAGTATACCA-3'     (SEQ ID NO: 2710)

5'-CAACAGAUGCGGUUAUAGAAAUGGU-3'       (SEQ ID NO: 3820)

3'-AAGUUGUCUACGCCAAUAUCUUUACCA-5'     (SEQ ID NO: 1602)

βc-m3522 Target:  5'-TTCAACAGATGCGGTTATAGAAATGGT-3'     (SEQ ID NO: 2711)

5'-GUUAUAGAAAUGGUUCAGAAUUAAA-3'       (SEQ ID NO: 3821)

3'-GCCAAUAUCUUUACCAAGUCUUAAUUU-5'     (SEQ ID NO: 1603)

βc-m3533 Target:  5'-CGGTTATAGAAATGGTTCAGAATTAAA-3'     (SEQ ID NO: 2712)

5'-AGAAAUGGUUCAGAAUUAAACUUUU-3'       (SEQ ID NO: 3822)

3'-UAUCUUUACCAAGUCUUAAUUUGAAAA-5'     (SEQ ID NO: 1604)

βc-m3538 Target:  5'-ATAGAAATGGTTCAGAATTAAACTTTT-3'     (SEQ ID NO: 2713)
```

TABLE 7

Selected Anti-β-catenin DsiRNA Agents, Blunt/Frayed Duplexes

```
5'-CCCUGAGGGUAUUUGAAGUAUACCA^CC-3'  (SEQ ID NO: 5553)
3'-GGGACUCCCAUAAACUUCAUAUGGU_AU-5'  (SEQ ID NO: 1117)

βc-240 Target: 5'-CCCTGAGGGTATTTGAAGTATACCATA-3'  (SEQ ID NO: 2226)

5'-GAGGGUAUUUGAAGUAUACCAUACA^CA-3'  (SEQ ID NO: 5554)
3'-CUCCCAUAAACUUCAUAUGGUAUGU_UG-5'  (SEQ ID NO: 1118)

βc-244 Target: 5'-GAGGGTATTTGAAGTATACCATACAAC-3'  (SEQ ID NO: 2227)

5'-UGAAGUAUACCAUACAACUGUUUG^CC-3'   (SEQ ID NO: 5555)
3'-ACUUCAUAUGGUAUGUUGACAAAAC_UU-5'  (SEQ ID NO: 1119)

βc-253 Target: 5'-TGAAGTATACCATACAACTGTTTTGAA-3'  (SEQ ID NO: 2228)

5'-AUACCAUACAACUGUUUUGAAAAUC^AC-3'  (SEQ ID NO: 5556)
3'-UAUGGUAUGUUGACAAAACUUUUAG_GU-5'  (SEQ ID NO: 1120)

βc-259 Target: 5'-ATACCATACAACTGTTTTGAAAATCCA-3'  (SEQ ID NO: 2229)
```

TABLE 7-continued

Selected Anti-β-catenin DsiRNA Agents, Blunt/Frayed Duplexes

```
                                  C A-3'
5'-AUACAACUGUUUUGAAAAUCCAGCG        (SEQ ID NO: 5557)
3'-UAUGUUGACAAAACUUUUAGGUCGC
                                  A C-5'
```

βc-264 Target: 5'-ATACAACTGTTTTGAAAATCCAGCGTG-3' (SEQ ID NO: 2230)

```
                                  C C-3'
5'-CAGGGAUUUUCUCAGUCCUUCACUC        (SEQ ID NO: 5558)
3'-GUCCCUAAAAGAGUCAGGAAGUGAG
                                  U U-5'
```

βc-496 Target: 5'-CAGGGATTTTCTCAGTCCTTCACTCAA-3' (SEQ ID NO: 2231)

```
                                  A C-3'
5'-CACUCAAGAACAAGUAGCUGAUAUU        (SEQ ID NO: 5559)
3'-GUGAGUUCUUGUUCAUCGACUAUAA
                                  C U-5'
```

βc-516 Target: 5'-CACTCAAGAACAAGTAGCTGATATTGA-3' (SEQ ID NO: 2232)

```
                                  A C-3'
5'-AGAACAAGUAGCUGAUAUUGAUGGA        (SEQ ID NO: 5560)
3'-UCUUGUUCAUCGACUAUAACUACCU
                                  G U-5'
```

βc-522 Target: 5'-AGAACAAGTAGCTGATATTGATGGACA-3' (SEQ ID NO: 2233)

```
                                  A C-3'
5'-AACAAGUAGCUGAUAUUGAUGGACA        (SEQ ID NO: 5561)
3'-UUGUUCAUCGACUAUAACUACCUGU
                                  C A-5'
```

βc-524 Target: 5'-AACAAGTAGCTGATATTGATGGACAGT-3' (SEQ ID NO: 2234)

```
                                  A A-3'
5'-UGAUGGACAGUAUGCAAUGACUCGA        (SEQ ID NO: 5562)
3'-ACUACCUGUCAUACGUUACUGAGCU
                                  C G-5'
```

βc-540 Target: 5'-TGATGGACAGTATGCAATGACTCGAGC-3' (SEQ ID NO: 2235)

```
                                  A C-3'
5'-UGCUAUGUUCCCUGAGACAUUAGAU        (SEQ ID NO: 5563)
3'-ACGAUACAAGGGACUCUGUAAUCUA
                                  C U-5'
```

βc-582 Target: 5'-TGCTATGTTCCCTGAGACATTAGATGA-3' (SEQ ID NO: 2236)

```
                                  A C-3'
5'-UGCUGAAACAUGCAGUUGUAAACUU        (SEQ ID NO: 5564)
3'-ACGACUUUGUACGUCAACAUUUGAA
                                  C U-5'
```

βc-686 Target: 5'-TGCTGAAACATGCAGTTGTAAACTTGA-3' (SEQ ID NO: 2237)

```
                                  A C-3'
5'-AACAUGCAGUUGUAAACUUGAUUAA        (SEQ ID NO: 5565)
3'-UUGUACGUCAACAUUUGAACUAAUU
                                  G A-5'
```

βc-692 Target: 5'-AACATGCAGTTGTAAACTTGATTAACT-3' (SEQ ID NO: 2238)

```
                                  C C-3'
5'-GCAGUUGUAAACUUGAUUAACUAUC        (SEQ ID NO: 5566)
3'-CGUCAACAUUUGAACUAAUUGAUAG
                                  U U-5'
```

βc-697 Target: 5'-GCAGTTGTAAACTTGATTAACTATCAA-3' (SEQ ID NO: 2239)

TABLE 7-continued

Selected Anti-β-catenin DsiRNA Agents,
Blunt/Frayed Duplexes

```
5'-ACUUGAUUAACUAUCAAGAUGAUGC^CA-3'     (SEQ ID NO: 5567)
3'-UGAACUAAUUGAUAGUUCUACUACG_UC-5'     (SEQ ID NO: 1131)
```

βc-707 Target: 5'-ACTTGATTAACTATCAAGATGATGCAG-3' (SEQ ID NO: 2240)

```
5'-CCCUGAACUGACAAAACUGCUAAAU^AC-3'     (SEQ ID NO: 5568)
3'-GGGACUUGACUGUUUUGACGAUUUA_CU-5'     (SEQ ID NO: 1132)
```

βc-753 Target: 5'-CCCTGAACTGACAAAACTGCTAAATGA-3' (SEQ ID NO: 2241)

```
5'-UCAGAUGGUGUCUGCUAUUGUACGU^CA-3'     (SEQ ID NO: 5569)
3'-AGUCUACCACAGACGAUAACAUGCA_UG-5'     (SEQ ID NO: 1133)
```

βc-870 Target: 5'-TCAGATGGTGTCTGCTATTGTACGTAC-3' (SEQ ID NO: 2242)

```
5'-GUACGUACCAUGCAGAAUACAAAUG^CC-3'     (SEQ ID NO: 5570)
3'-CAUGCAUGGUACGUCUUAUGUUUAC_UA-5'     (SEQ ID NO: 1134)
```

βc-889 Target: 5'-GTACGTACCATGCAGAATACAAATGAT-3' (SEQ ID NO: 2243)

```
5'-AUUACAACUCUCCACAACCUUUUAU^CC-3'     (SEQ ID NO: 5571)
3'-UAAUGUUGAGAGGUGUUGGAAAAUA_AU-5'     (SEQ ID NO: 1135)
```

βc-1060 Target: 5'-ATTACAACTCTCCACAACCTTTTATTA-3' (SEQ ID NO: 2244)

```
5'-AACUCUCCACAACCUUUUAUUACAU^AC-3'     (SEQ ID NO: 5572)
3'-UUGAGAGGUGUUGGAAAAUAAUGUA_GU-5'     (SEQ ID NO: 1136)
```

βc-1065 Target: 5'-AACTCTCCACAACCTTTTATTACATCA-3' (SEQ ID NO: 2245)

```
5'-UCCACAACCUUUUAUUACAUCAAGA^CA-3'     (SEQ ID NO: 5573)
3'-AGGUGUUGGAAAAUAAUGUAGUUCU_UC-5'     (SEQ ID NO: 1137)
```

βc-1070 Target: 5'-TCCACAACCTTTTATTACATCAAGAAG-3' (SEQ ID NO: 2246)

```
5'-ACCUUUUAUUACAUCAAGAAGGAGC^CC-3'     (SEQ ID NO: 5574)
3'-UGGAAAAUAAUGUAGUUCUUCCUCG_AU-5'     (SEQ ID NO: 1138)
```

βc-1076 Target: 5'-ACCTTTTATTACATCAAGAAGGAGCTA-3' (SEQ ID NO: 2247)

```
5'-ACAAAACAAAUGUUAAAUUCUUGGC^CC-3'     (SEQ ID NO: 5575)
3'-UGUUUUGUUUACAAUUUAAGAACCG_AU-5'     (SEQ ID NO: 1139)
```

βc-1154 Target: 5'-ACAAAACAAATGTTAAATTCTTGGCTA-3' (SEQ ID NO: 2248)

TABLE 7-continued

Selected Anti-β-catenin DsiRNA Agents,
Blunt/Frayed Duplexes

5'-AUUACGACAGACUGCCUUCAAAUUU$^{CC\text{-}3'}$ (SEQ ID NO: 5576)
3'-UAAUGCUGUCUGACGGAAGUUUAAA$_{AU\text{-}5'}$ (SEQ ID NO: 1140)

βc-1180 Target: 5'-ATTACGACAGACTGCCTTCAAATTTTA-3' (SEQ ID NO: 2249)

5'-GACAGACUGCCUUCAAAUUUUAGCU$^{CC\text{-}3'}$ (SEQ ID NO: 5577)
3'-CUGUCUGACGGAAGUUUAAAAUCGA$_{AU\text{-}5'}$ (SEQ ID NO: 1141)

βc-1185 Target: 5'-GACAGACTGCCTTCAAATTTTAGCTTA-3' (SEQ ID NO: 2250)

5'-AGCUUUAGUAAAUAUAAUGAGGACC$^{CC\text{-}3'}$ (SEQ ID NO: 5578)
3'-UCGAAAUCAUUUAUAUUACUCCUGG$_{AU\text{-}5'}$ (SEQ ID NO: 1142)

βc-1260 Target: 5'-AGCTTTAGTAAATATAATGAGGACCTA-3' (SEQ ID NO: 2251)

5'-GAAAACUACUGUGGACCACAAGCA$^{AC\text{-}3'}$ (SEQ ID NO: 5579)
3'-CUUUUUGAUGACACCUGGUGUUCGU$_{CU\text{-}5'}$ (SEQ ID NO: 1143)

βc-1294 Target: 5'-GAAAAACTACTGTGGACCACAAGCAGA-3' (SEQ ID NO: 2252)

5'-CAAGUCAACGUCUUGUUCAGAACUG$^{CA\text{-}3'}$ (SEQ ID NO: 5580)
3'-GUUCAGUUGCAGAACAAGUCUUGAC$_{AG\text{-}5'}$ (SEQ ID NO: 1144)

βc-1412 Target: 5'-CAAGTCAACGTCTTGTTCAGAACTGTC-3' (SEQ ID NO: 2253)

5'-AACGUCUUGUUCAGAACUGUCUUUG$^{AC\text{-}3'}$ (SEQ ID NO: 5581)
3'-UUGCAGAACAAGUCUUGACAGAAAC$_{CU\text{-}5'}$ (SEQ ID NO: 1145)

βc-1418 Target: 5'-AACGTCTTGTTCAGAACTGTCTTTGGA-3' (SEQ ID NO: 2254)

5'-CUUGUUCAGAACUGUCUUUGGACUC$^{CA\text{-}3'}$ (SEQ ID NO: 5582)
3'-GAACAAGUCUUGACAGAAACCUGAG$_{AG\text{-}5'}$ (SEQ ID NO: 1146)

βc-1423 Target: 5'-CTTGTTCAGAACTGTCTTTGGACTCTC-3' (SEQ ID NO: 2255)

5'-UGGGUUCAGAUGAUAUAAAUGUGGU$^{AC\text{-}3'}$ (SEQ ID NO: 5583)
3'-ACCCAAGUCUACUAUAUUUACACCA$_{GU\text{-}5'}$ (SEQ ID NO: 1147)

βc-1520 Target: 5'-TGGGTTCAGATGATATAAATGTGGTCA-3' (SEQ ID NO: 2256)

5'-AUUCUUUCUAACCUCACUUGCAAUA$^{AC\text{-}3'}$ (SEQ ID NO: 5584)
3'-UAAGAAAGAUUGGAGUGAACGUUAU$_{UA\text{-}5'}$ (SEQ ID NO: 1148)

βc-1561 Target: 5'-ATTCTTTCTAACCTCACTTGCAATAAT-3' (SEQ ID NO: 2257)

TABLE 7-continued

Selected Anti-β-catenin DsiRNA Agents,
Blunt/Frayed Duplexes

5'-ACCUCACUUGCAAUAAUUAUAAGAA$_A{}^{C-3'}$ (SEQ ID NO: 5585)
3'-UGGAGUGAACGUUAUUAAUAUUCUU$_{G_{U-5'}}$ (SEQ ID NO: 1149)

βc-1571 Target: 5'-ACCTCACTTGCAATAATTATAAGAACA-3' (SEQ ID NO: 2258)

5'-UGCAAUAAUUAUAAGAACAAGAUGA$_C{}^{A-3'}$ (SEQ ID NO: 5586)
3'-ACGUUAUUAAUAUUCUUGUUCUACU$_{A_{C-5'}}$ (SEQ ID NO: 1150)

βc-1579 Target: 5'-TGCAATAATTATAAGAACAAGATGATG-3' (SEQ ID NO: 2259)

5'-UGGUAUAGAGGCUCUUGUGCGUACU$_A{}^{C-3'}$ (SEQ ID NO: 5587)
3'-ACCAUAUCUCCGAGAACACGCAUGA$_{C_{A-5'}}$ (SEQ ID NO: 1151)

βc-1620 Target: 5'-TGGTATAGAGGCTCTTGTGCGTACTGT-3' (SEQ ID NO: 2260)

5'-AAGGCUACUGUUGGAUUGAUUCGAA$_C{}^{C-3'}$ (SEQ ID NO: 5588)
3'-UUCCGAUGACAACCUAACUAAGCUU$_{U_{A-5'}}$ (SEQ ID NO: 1152)

βc-1816 Target: 5'-AAGGCTACTGTTGGATTGATTCGAAAT-3' (SEQ ID NO: 2261)

5'-CGCAUGGAAGAAAUAGUUGAAGGUU$_A{}^{C-3'}$ (SEQ ID NO: 5589)
3'-GCGUACCUUCUUUAUCAACUUCCAA$_{C_{A-5'}}$ (SEQ ID NO: 1153)

βc-1987 Target: 5'-CGCATGGAAGAAATAGTTGAAGGTTGT-3' (SEQ ID NO: 2262)

5'-CAUGGAAGAAAUAGUUGAAGGUUGU$_C{}^{A-3'}$ (SEQ ID NO: 5590)
3'-GUACCUUCUUUAUCAACUUCCAACA$_{U_{G-5'}}$ (SEQ ID NO: 1154)

βc-1989 Target: 5'-CATGGAAGAAATAGTTGAAGGTTGTAC-3' (SEQ ID NO: 2263)

5'-CCAUUGAAAACAUCCAAAGAGUAGC$_C{}^{A-3'}$ (SEQ ID NO: 5591)
3'-GGUAACUUUUGUAGGUUUCUCAUCG$_{A_{C-5'}}$ (SEQ ID NO: 1155)

βc-2111 Target: 5'-CCATTGAAAACATCCAAAGAGTAGCTG-3' (SEQ ID NO: 2264)

5'-CUGAGGACAAGCCACAAGAUUACAA$_A{}^{C-3'}$ (SEQ ID NO: 5592)
3'-GACUCCUGUUCGGUGUUCUAAUGUU$_{C_{U-5'}}$ (SEQ ID NO: 1156)

βc-2282 Target: 5'-CTGAGGACAAGCCACAAGATTACAAGA-3' (SEQ ID NO: 2265)

5'-UUGAUACUGACCUGUAAAUCAUCCU$_C{}^{C-3'}$ (SEQ ID NO: 5593)
3'-AACUAUGACUGGACAUUUAGUAGGA$_{A-5'}$ (SEQ ID NO: 1157)

βc-2624 Target: 5'-TTGATACTGACCTGTAAATCATCCTTT-3' (SEQ ID NO: 2266)

TABLE 7-continued

Selected Anti-β-catenin DsiRNA Agents,
Blunt/Frayed Duplexes

```
                                  A C-3'
5'-CUUUAGGUAAGAAGUUUUAAAAAGC           (SEQ ID NO: 5594)
3'-GAAAUCCAUUCUUCAAAAUUUUUCG           (SEQ ID NO: 1158)
                                  G U-5'
```

βc-2647 Target: 5'-CTTTAGGTAAGAAGTTTTAAAAAGCCA-3' (SEQ ID NO: 2267)

```
                                  C A-3'
5'-AACAGGUAUAUACUUUGAAAGGAGA           (SEQ ID NO: 5595)
3'-UUGUCCAUAUAUGAAACUUUCCUCU           (SEQ ID NO: 1159)
                                  A C-5'
```

βc-2770 Target: 5'-AACAGGTATATACTTTGAAAGGAGATG-3' (SEQ ID NO: 2268)

```
                              C C-3'
5'-UGGAAGUUAUUAACUUUAAUGUUUU           (SEQ ID NO: 5596)
3'-ACCUUCAAUAAUUGAAAUUACAAAA           (SEQ ID NO: 1160)
                              A A-5'
```

βc-2848 Target: 5'-TGGAAGTTATTAACTTTAATGTTTTTT-3' (SEQ ID NO: 2269)

```
                                  C A-3'
5'-UGCCACAGCUUUUGCAACUUAAUAC           (SEQ ID NO: 5597)
3'-ACGGUGUCGAAAACGUUGAAUUAUG           (SEQ ID NO: 1161)
                                  A G-5'
```

βc-2874 Target: 5'-TGCCACAGCTTTTGCAACTTAATACTC-3' (SEQ ID NO: 2270)

```
                                 C A-3'
5'-AACAUUUGCUGUUUUAAACAUUAAU            (SEQ ID NO: 5598)
3'-UUGUAAACGACAAAAUUUGUAAUUA            (SEQ ID NO: 1162)
                                 U C-5'
```

βc-2909 Target: 5'-AACATTTGCTGTTTTAAACATTAATAG-3' (SEQ ID NO: 2271)

```
                                 C A-3'
5'-AACAAUUGAAGUAAACUUUUUGUUC            (SEQ ID NO: 5599)
3'-UUGUUAACUUCAUUUGAAAAACAAG            (SEQ ID NO: 1163)
                                 A C-5'
```

βc-3074 Target: 5'-AACAATTGAAGTAAACTTTTTGTTCTG-3' (SEQ ID NO: 2272)

```
                                C C-3'
5'-AAACCCUAGCCUUGCUUGUUAAAUU            (SEQ ID NO: 5600)
3'-UUUGGGAUCGGAACGAACAAUUUAA            (SEQ ID NO: 1164)
                                A A-5'
```

βc-3197 Target: 5'-AAACCCTAGCCTTGCTTGTTAAATTTT-3' (SEQ ID NO: 2273)

```
                                    C C-3'
5'-UAGCCUUGCUUGUUAAAUUUUUUUU            (SEQ ID NO: 5601)
3'-AUCGGAACGAACAAUUUAAAAAAAA            (SEQ ID NO: 1165)
                                    A A-5'
```

βc-3203 Target: 5'-TAGCCTTGCTTGTTAAATTTTTTTTT-3' (SEQ ID NO: 2274)

```
                                 C C-3'
5'-UUGAAGUAGCUCUUUUUUUUUUUUU            (SEQ ID NO: 5602)
3'-AACUUCAUCGAGAAAAAAAAAAAAA            (SEQ ID NO: 1166)
                                 A A-5'
```

βc-3273 Target: 5'-TTGAAGTAGCTCTTTTTTTTTTTTTT-3' (SEQ ID NO: 2275)

TABLE 7-continued

Selected Anti-β-catenin DsiRNA Agents,
Blunt/Frayed Duplexes

```
                         A C-3'
5'-UCGUAGUGUUAAGUUAUAGUGAAUA A       (SEQ ID NO: 5603)
3'-AGCAUCACAAUUCAAUAUCACUUAU         (SEQ ID NO: 1167)
                              G A-5'
```

βc-3333 Target: 5'-TCGTAGTGTTAAGTTATAGTGAATACT-3' (SEQ ID NO: 2276)

```
                         C C-3'
5'-UAGUGAAUACUGCUACAGCAAUUUC         (SEQ ID NO: 5604)
3'-AUCACUUAUGACGAUGUCGUUAAAG         (SEQ ID NO: 1168)
                              A U-5'
```

βc-3349 Target: 5'-TAGTGAATACTGCTACAGCAATTTCTA-3' (SEQ ID NO: 2277)

```
                         C C-3'
5'-AAUACUGCUACAGCAAUUUCUAAUU         (SEQ ID NO: 5605)
3'-UUAUGACGAUGUCGUUAAAGAUUAA         (SEQ ID NO: 1169)
                              A A-5'
```

βc-3354 Target: 5'-AATACTGCTACAGCAATTTCTAATTTT-3' (SEQ ID NO: 2278)

```
                         A A-3'
5'-UUCUAAUUUUUAAGAAUUGAGUAAU A       (SEQ ID NO: 5606)
3'-AAGAUUAAAAAUUCUUAACUCAUUA         (SEQ ID NO: 1170)
                              C C-5'
```

βc-3371 Target: 5'-TTCTAATTTTTAAGAATTGAGTAATGG-3' (SEQ ID NO: 2279)

```
                         C A-3'
5'-AUUUUUAAGAAUUGAGUAAUGGUGU         (SEQ ID NO: 5607)
3'-UAAAAAUUCUUAACUCAUUACCACA         (SEQ ID NO: 1171)
                              U C-5'
```

βc-3376 Target: 5'-ATTTTTAAGAATTGAGTAATGGTGTAG-3' (SEQ ID NO: 2280)

```
                         C C-3'
5'-UUCAUAAUCACUCUAAUUAAUUGUA         (SEQ ID NO: 5608)
3'-AAGUAUUAGUGAGAUUAAUUAACAU         (SEQ ID NO: 1172)
                              U A-5'
```

βc-3411 Target: 5'-TTCATAATCACTCTAATTAATTGTAAT-3' (SEQ ID NO: 2281)

```
                         C C-3'
5'-AUUAAUUGUAAUCUGAAUAAAGUGU         (SEQ ID NO: 5609)
3'-UAAUUAACAUUAGACUUAUUUCACA         (SEQ ID NO: 1173)
                              U U-5'
```

βc-3426 Target: 5'-ATTAATTGTAATCTGAATAAAGTGTAA-3' (SEQ ID NO: 2282)

```
                         C C-3'
5'-UUGUAAUCUGAAUAAAGUGUAACAA         (SEQ ID NO: 5610)
3'-AACAUUAGACUUAUUUCACAUUGUU         (SEQ ID NO: 1174)
                              A A-5'
```

βc-3431 Target: 5'-TTGTAATCTGAATAAAGTGTAACAATT-3' (SEQ ID NO: 2283)

```
                         C A-3'
5'-UCUGAAUAAAGUGUAACAAUUGUGU         (SEQ ID NO: 5611)
3'-AGACUUAUUUCACAUUGUUAACACA         (SEQ ID NO: 1175)
                              U C-5'
```

βc-3437 Target: 5'-TCTGAATAAAGTGTAACAATTGTGTAG-3' (SEQ ID NO: 2284)

TABLE 7-continued

Selected Anti-β-catenin DsiRNA Agents,
Blunt/Frayed Duplexes

```
5'-GUGUAGCCUUUUUGUAUAAAAUAGA^AC-3'   (SEQ ID NO: 5612)
3'-CACAUCGGAAAAACAUAUUUUAUCU_GU-5'   (SEQ ID NO: 1176)
```

βc-3458 Target: 5'-GTGTAGCCTTTTTGTATAAAATAGACA-3' (SEQ ID NO: 2285)

```
5'-UUUGUAUAAAAUAGACAAAUAGAAA^CC-3'   (SEQ ID NO: 5613)
3'-AAACAUAUUUUAUCUGUUUAUCUUU_UA-5'   (SEQ ID NO: 1177)
```

βc-3468 Target: 5'-TTTGTATAAAATAGACAAATAGAAAAT-3' (SEQ ID NO: 2286)

```
5'-AGAAAAUGGUCCAAUUAGUUUCCUU^CC-3'   (SEQ ID NO: 5614)
3'-UCUUUUACCAGGUUAAUCAAAGGAA_AA-5'   (SEQ ID NO: 1178)
```

βc-3488 Target: 5'-AGAAAATGGTCCAATTAGTTTCCTTTT-3' (SEQ ID NO: 2287)

```
5'-GUCCAAUUAGUUUCCUUUUUAAUAU^AA-3'   (SEQ ID NO: 5615)
3'-CAGGUUAAUCAAAGGAAAAAUUAUA_CG-5'   (SEQ ID NO: 1179)
```

βc-3496 Target: 5'-GTCCAATTAGTTTCCTTTTTAATATGC-3' (SEQ ID NO: 2288)

```
5'-UUUUUGAUCAAAAACUAUUUGGGAU^CC-3'   (SEQ ID NO: 5616)
3'-AAAAACUAGUUUUUGAUAAACCCUA_UA-5'   (SEQ ID NO: 1180)
```

βc-3552 Target: 5'-TTTTTGATCAAAAACTATTTGGGATAT-3' (SEQ ID NO: 2289)

```
5'-AAGAGGUGUUAUUUGGAACCUUGUU^CC-3'   (SEQ ID NO: 5617)
3'-UUCUCCACAAUAAACCUUGGAACAA_AA-5'   (SEQ ID NO: 1181)
```

βc-3600 Target: 5'-AAGAGGTGTTATTTGGAACCTTGTTTT-3' (SEQ ID NO: 2290)

```
5'-GUGUUAUUUGGAACCUUGUUUUGGA^AC-3'   (SEQ ID NO: 5618)
3'-CACAAUAAACCUUGGAACAAAACCU_GU-5'   (SEQ ID NO: 1182)
```

βc-3605 Target: 5'-GTGTTATTTGGAACCTTGTTTTGGACA-3' (SEQ ID NO: 2291)

```
5'-GAACCUUGUUUUGGACAGUUUACCA^AC-3'   (SEQ ID NO: 5619)
3'-CUUGGAACAAAACCUGUCAAAUGGU_CA-5'   (SEQ ID NO: 1183)
```

βc-3615 Target: 5'-GAACCTTGTTTTGGACAGTTTACCAGT-3' (SEQ ID NO: 2292)

```
5'-GUGAUACGAUGCUUCAAGAGAAAAU^AA-3'   (SEQ ID NO: 5620)
3'-CACUAUGCUACGAAGUUCUCUUUUA_CG-5'   (SEQ ID NO: 1184)
```

βc-3674 Target: 5'-GTGATACGATGCTTCAAGAGAAAATGC-3' (SEQ ID NO: 2293)

TABLE 7-continued

Selected Anti-β-catenin DsiRNA Agents,
Blunt/Frayed Duplexes

5'-UUCAAGAGAAAAUGCGGUUAUAAAA$^{C}$$^{C-3'}$ (SEQ ID NO: 5621)
3'-AAGUUCUCUUUUACGCCAAUAUUUU$_{U}$$_{U-5'}$ (SEQ ID NO: 1185)

βc-3686 Target: 5'-TTCAAGAGAAAATGCGGTTATAAAAA-3' (SEQ ID NO: 2294)

5'-GAGAAAAUGCGGUUAUAAAAAAUGG$^{C}$$^{C-3'}$ (SEQ ID NO: 5622)
3'-CUCUUUUACGCCAAUAUUUUUUACC$_{A}$$_{A-5'}$ (SEQ ID NO: 1186)

βc-3691 Target: 5'-GAGAAAATGCGGTTATAAAAATGGTT-3' (SEQ ID NO: 2295)

5'-CGGUUAUAAAAAAUGGUUCAGAAUU$^{C}$$^{C-3'}$ (SEQ ID NO: 5623)
3'-GCCAAUAUUUUUUACCAAGUCUUAA$_{U}$$_{U-5'}$ (SEQ ID NO: 1187)

βc-3700 Target: 5'-CGGTTATAAAAATGGTTCAGAATTAA-3' (SEQ ID NO: 2296)

5'-AAAAAAUGGUUCAGAAUUAAACUUU$^{C}$$^{C-3'}$ (SEQ ID NO: 5624)
3'-UUUUUUACCAAGUCUUAAUUUGAAA$_{A}$$_{U-5'}$ (SEQ ID NO: 1188)

βc-3707 Target: 5'-AAAAAATGGTTCAGAATTAAACTTTTA-3' (SEQ ID NO: 2297)

5'-CAGCGUGGACAAUGGCUACUCAAGC$^{C}$$^{A-3'}$ (SEQ ID NO: 5625)
3'-GUCGCACCUGUUACCGAUGAGUUCG$_{A}$$_{C-5'}$ (SEQ ID NO: 1189)

βc-284 Target: 5'-CAGCGTGGACAATGGCTACTCAAGCTG-3' (SEQ ID NO: 2298)

5'-AGCGUGGACAAUGGCUACUCAAGCU$^{A}$$^{C-3'}$ (SEQ ID NO: 5626)
3'-UCGCACCUGUUACCGAUGAGUUCGA$_{C}$$_{U-5'}$ (SEQ ID NO: 1190)

βc-285 Target: 5'-AGCGTGGACAATGGCTACTCAAGCTGA-3' (SEQ ID NO: 2299)

5'-GCGUGGACAAUGGCUACUCAAGCUG$^{C}$$^{C-3'}$ (SEQ ID NO: 5627)
3'-CGCACCUGUUACCGAUGAGUUCGAC$_{U}$$_{A-5'}$ (SEQ ID NO: 1191)

βc-286 Target: 5'-GCGTGGACAATGGCTACTCAAGCTGAT-3' (SEQ ID NO: 2300)

5'-CGUGGACAAUGGCUACUCAAGCUGA$^{C}$$^{C-3'}$ (SEQ ID NO: 5628)
3'-GCACCUGUUACCGAUGAGUUCGACU$_{A}$$_{A-5'}$ (SEQ ID NO: 1192)

βc-287 Target: 5'-CGTGGACAATGGCTACTCAAGCTGATT-3' (SEQ ID NO: 2301)

5'-GUGGACAAUGGCUACUCAAGCUGAU$^{C}$$^{C-3'}$ (SEQ ID NO: 5629)
3'-CACCUGUUACCGAUGAGUUCGACUA$_{A}$$_{A-5'}$ (SEQ ID NO: 1193)

βc-288 Target: 5'-GTGGACAATGGCTACTCAAGCTGATTT-3' (SEQ ID NO: 2302)

5'-UGGACAAUGGCUACUCAAGCUGAUU$^{C}$$^{A-3'}$ (SEQ ID NO: 5630)
3'-ACCUGUUACCGAUGAGUUCGACUAA$_{A}$$_{C-5'}$ (SEQ ID NO: 1194)

βc-289 Target: 5'-TGGACAATGGCTACTCAAGCTGATTTG-3' (SEQ ID NO: 2303)

TABLE 7-continued

Selected Anti-β-catenin DsiRNA Agents,
Blunt/Frayed Duplexes

5'-GGACAAUGGCUACUCAAGCUGAUUU$_A^{C-3'}$    (SEQ ID NO: 5631)
3'-CCUGUUACCGAUGAGUUCGACUAAA$_{C_{U-5'}}$   (SEQ ID NO: 1195)

βc-290 Target: 5'-GGACAATGGCTACTCAAGCTGATTTGA-3' (SEQ ID NO: 2304)

5'-GACAAUGGCUACUCAAGCUGAUUUG$^{C-3'}_C$    (SEQ ID NO: 5632)
3'-CUGUUACCGAUGAGUUCGACUAAAC$_{U_{A-5'}}$   (SEQ ID NO: 1196)

βc-291 Target: 5'-GACAATGGCTACTCAAGCTGATTTGAT-3' (SEQ ID NO: 2305)

5'-UUUGAUGGAGUUGGACAUGGCCAUG$_A^{C-3'}$    (SEQ ID NO: 5633)
3'-AAACUACCUCAACCUGUACCGGUAC$_{C_{U-5'}}$   (SEQ ID NO: 1197)

βc-312 Target: 5'-TTTGATGGAGTTGGACATGGCCATGGA-3' (SEQ ID NO: 2306)

5'-UUGAUGGAGUUGGACAUGGCCAUGG$^{C-3'}_C$    (SEQ ID NO: 5634)
3'-AACUACCUCAACCUGUACCGGUACC$_{U_{U-5'}}$   (SEQ ID NO: 1198)

βc-313 Target: 5'-TTGATGGAGTTGGACATGGCCATGGAA-3' (SEQ ID NO: 2307)

5'-UGAUGGAGUUGGACAUGGCCAUGGA$_C^{A-3'}$    (SEQ ID NO: 5635)
3'-ACUACCUCAACCUGUACCGGUACCU$_{U_{G-5'}}$   (SEQ ID NO: 1199)

βc-314 Target: 5'-TGATGGAGTTGGACATGGCCATGGAAC-3' (SEQ ID NO: 2308)

5'-GAUGGAGUUGGACAUGGCCAUGGAA$_A^{A-3'}$    (SEQ ID NO: 5636)
3'-CUACCUCAACCUGUACCGGUACCUU$_{G-5'}$   (SEQ ID NO: 1200)

βc-315 Target: 5'-GATGGAGTTGGACATGGCCATGGAACC-3' (SEQ ID NO: 2309)

5'-AUGGAGUUGGACAUGGCCAUGGAAC$_A^{C-3'}$    (SEQ ID NO: 5637)
3'-UACCUCAACCUGUACCGGUACCUUG$_{U-5'}$   (SEQ ID NO: 1201)

βc-316 Target: 5'-ATGGAGTTGGACATGGCCATGGAACCA-3' (SEQ ID NO: 2310)

5'-UGGAGUUGGACAUGGCCAUGGAACC$_C^{A-3'}$    (SEQ ID NO: 5638)
3'-ACCUCAACCUGUACCGGUACCUUGG$_{U_{C-5'}}$   (SEQ ID NO: 1202)

βc-317 Target: 5'-TGGAGTTGGACATGGCCATGGAACCAG-3' (SEQ ID NO: 2311)

5'-GGAGUUGGACAUGGCCAUGGAACCA$_A^{C-3'}$    (SEQ ID NO: 5639)
3'-CCUCAACCUGUACCGGUACCUUGGU$_{C_{U-5'}}$   (SEQ ID NO: 1203)

βc-318 Target: 5'-GGAGTTGGACATGGCCATGGAACCAGA-3' (SEQ ID NO: 2312)

5'-ACUCUGGAAUCCAUUCUGGUGCCAC$_C^{C-3'}$    (SEQ ID NO: 5640)
3'-UGAGACCUUAGGUAAGACCACGGUG$_{A_{U-5'}}$   (SEQ ID NO: 1204)

βc-389 Target: 5'-ACTCTGGAATCCATTCTGGTGCCACTA-3' (SEQ ID NO: 2313)

TABLE 7-continued

Selected Anti-β-catenin DsiRNA Agents,
Blunt/Frayed Duplexes

5'-CUCUGGAAUCCAUUCUGGUGCCACU$^{CA-3'}$  (SEQ ID NO: 5641)
3'-GAGACCUUAGGUAAGACCACGGUGA$_{UG-5'}$  (SEQ ID NO: 1205)

βc-390 Target: 5'-CTCTGGAATCCATTCTGGTGCCACTAC-3' (SEQ ID NO: 2314)

5'-UCUGGAAUCCAUUCUGGUGCCACUA$^{AA-3'}$  (SEQ ID NO: 5642)
3'-AGACCUUAGGUAAGACCACGGUGAU$_{G-5'}$  (SEQ ID NO: 1206)

βc-391 Target: 5'-TCTGGAATCCATTCTGGTGCCACTACC-3' (SEQ ID NO: 2315)

5'-CUGGAAUCCAUUCUGGUGCCACUAC$^{AC-3'}$  (SEQ ID NO: 5643)
3'-GACCUUAGGUAAGACCACGGUGAUG$_{U-5'}$  (SEQ ID NO: 1207)

βc-392 Target: 5'-CTGGAATCCATTCTGGTGCCACTACCA-3' (SEQ ID NO: 2316)

5'-UGGAAUCCAUUCUGGUGCCACUACC$^{CA-3'}$  (SEQ ID NO: 5644)
3'-ACCUUAGGUAAGACCACGGUGAUGG$_{UG-5'}$  (SEQ ID NO: 1208)

βc-393 Target: 5'-TGGAATCCATTCTGGTGCCACTACCAC-3' (SEQ ID NO: 2317)

5'-AUUAGAUGAGGGCAUGCAGAUCCCA$^{CA-3'}$  (SEQ ID NO: 5645)
3'-UAAUCUACUCCCGUACGUCUAGGGU$_{AG-5'}$  (SEQ ID NO: 1209)

βc-600 Target: 5'-ATTAGATGAGGGCATGCAGATCCCATC-3' (SEQ ID NO: 2318)

5'-UUAGAUGAGGGCAUGCAGAUCCCAU$^{AC-3'}$  (SEQ ID NO: 5646)
3'-AAUCUACUCCCGUACGUCUAGGGUA$_{GA-5'}$  (SEQ ID NO: 1210)

βc-601 Target: 5'-TTAGATGAGGGCATGCAGATCCCATCT-3' (SEQ ID NO: 2319)

5'-UAGAUGAGGGCAUGCAGAUCCCAUC$^{CC-3'}$  (SEQ ID NO: 5647)
3'-AUCUACUCCCGUACGUCUAGGGUAG$_{AU-5'}$  (SEQ ID NO: 1211)

βc-602 Target: 5'-TAGATGAGGGCATGCAGATCCCATCTA-3' (SEQ ID NO: 2320)

5'-AGAUGAGGGCAUGCAGAUCCCAUCU$^{CA-3'}$  (SEQ ID NO: 5648)
3'-UCUACUCCCGUACGUCUAGGGUAGA$_{UG-5'}$  (SEQ ID NO: 1212)

βc-603 Target: 5'-AGATGAGGGCATGCAGATCCCATCTAC-3' (SEQ ID NO: 2321)

5'-GAUGAGGGCAUGCAGAUCCCAUCUA$^{AC-3'}$  (SEQ ID NO: 5649)
3'-CUACUCCCGUACGUCUAGGGUAGAU$_{GU-5'}$  (SEQ ID NO: 1213)

βc-604 Target: 5'-GATGAGGGCATGCAGATCCCATCTACA-3' (SEQ ID NO: 2322)

5'-AUGAGGGCAUGCAGAUCCCAUCUAC$^{CA-3'}$  (SEQ ID NO: 5650)
3'-UACUCCCGUACGUCUAGGGUAGAUG$_{UG-5'}$  (SEQ ID NO: 1214)

βc-605 Target: 5'-ATGAGGGCATGCAGATCCCATCTACAC-3' (SEQ ID NO: 2323)

TABLE 7-continued

Selected Anti-β-catenin DsiRNA Agents,
Blunk/Frayed Duplexes

5'-AUGCUGCUCAUCCCACUAAUGUCCA$^{A}$$^{A-3'}$   (SEQ ID NO: 5651)
3'-UACGACGAGUAGGGUGAUUACAGGU$_{C}$$_{G-5'}$   (SEQ ID NO: 1215)

βc-638 Target: 5'-ATGCTGCTCATCCCACTAATGTCCAGC-3' (SEQ ID NO: 2324)

5'-UGCUGCUCAUCCCACUAAUGUCCAG$^{A}$$^{A-3'}$   (SEQ ID NO: 5652)
3'-ACGACGAGUAGGGUGAUUACAGGUC$_{G}$$_{C-5'}$   (SEQ ID NO: 1216)

βc-639 Target: 5'-TGCTGCTCATCCCACTAATGTCCAGCG-3' (SEQ ID NO: 2325)

5'-GCUGCUCAUCCCACUAAUGUCCAGC$^{A}$$^{C-3'}$   (SEQ ID NO: 5653)
3'-CGACGAGUAGGGUGAUUACAGGUCG$_{C}$$_{A-5'}$   (SEQ ID NO: 1217)

βc-640 Target: 5'-GCTGCTCATCCCACTAATGTCCAGCGT-3' (SEQ ID NO: 2326)

5'-CUGCUCAUCCCACUAAUGUCCAGCG$^{C}$$^{C-3'}$   (SEQ ID NO: 5654)
3'-GACGAGUAGGGUGAUUACAGGUCGC$_{A}$$_{A-5'}$   (SEQ ID NO: 1218)

βc-641 Target: 5'-CTGCTCATCCCACTAATGTCCAGCGTT-3' (SEQ ID NO: 2327)

5'-UGCUCAUCCCACUAAUGUCCAGCGU$^{C}$$^{C-3'}$   (SEQ ID NO: 5655)
3'-ACGAGUAGGGUGAUUACAGGUCGCA$_{A}$$_{A-5'}$   (SEQ ID NO: 1219)

βc-642 Target: 5'-TGCTCATCCCACTAATGTCCAGCGTTT-3' (SEQ ID NO: 2328)

5'-GCUCAUCCCACUAAUGUCCAGCGUU$^{C}$$^{A-3'}$   (SEQ ID NO: 5656)
3'-CGAGUAGGGUGAUUACAGGUCGCAA$_{A}$$_{C-5'}$   (SEQ ID NO: 1220)

βc-643 Target: 5'-GCTCATCCCACTAATGTCCAGCGTTTG-3' (SEQ ID NO: 2329)

5'-CUCAUCCCACUAAUGUCCAGCGUUU$^{A}$$^{A-3'}$   (SEQ ID NO: 5657)
3'-GAGUAGGGUGAUUACAGGUCGCAAA$_{C}$$_{C-5'}$   (SEQ ID NO: 1221)

βc-644 Target: 5'-CTCATCCCACTAATGTCCAGCGTTTGG-3' (SEQ ID NO: 2330)

5'-UCAUCCCACUAAUGUCCAGCGUUUG$^{A}$$^{A-3'}$   (SEQ ID NO: 5658)
3'-AGUAGGGUGAUUACAGGUCGCAAAC$_{C}$$_{G-5'}$   (SEQ ID NO: 1222)

βc-645 Target: 5'-TCATCCCACTAATGTCCAGCGTTTGGC-3' (SEQ ID NO: 2331)

5'-GUUUGGCUGAACCAUCACAGAUGCU$^{A}$$^{C-3'}$   (SEQ ID NO: 5659)
3'-CAAACCGACUUGGUAGUGUCUACGA$_{C}$$_{U-5'}$   (SEQ ID NO: 1223)

βc-665 Target: 5'-GTTTGGCTGAACCATCACAGATGCTGA-3' (SEQ ID NO: 2332)

5'-UUUGGCUGAACCAUCACAGAUGCUG$^{C}$$^{C-3'}$   (SEQ ID NO: 5660)
3'-AAACCGACUUGGUAGUGUCUACGAC$_{U}$$_{U-5'}$   (SEQ ID NO: 1224)

βc-666 Target: 5'-TTTGGCTGAACCATCACAGATGCTGAA-3' (SEQ ID NO: 2333)

TABLE 7-continued

Selected Anti-β-catenin DsiRNA Agents,
Blunt/Frayed Duplexes

5'-UUGGCUGAACCAUCACAGAUGCUGA$^{CC-3'}$ (SEQ ID NO: 5661)
3'-AACCGACUUGGUAGUGUCUACGACU$_{U_{U-5'}}$ (SEQ ID NO: 1225)

βc-667 Target: 5'-TTGGCTGAACCATCACAGATGCTGAAA-3' (SEQ ID NO: 2334)

5'-CAGAACUUGCCACACGUGCAAUCCC$^{CA-3'}$ (SEQ ID NO: 5662)
3'-GUCUUGAACGGUGUGCACGUUAGGG$_{A_{C-5'}}$ (SEQ ID NO: 1226)

βc-731 Target: 5'-CAGAACTTGCCACACGTGCAATCCCTG-3' (SEQ ID NO: 2335)

5'-AGAACUUGCCACACGUGCAAUCCCU$^{AC-3'}$ (SEQ ID NO: 5663)
3'-UCUUGAACGGUGUGCACGUUAGGGA$_{C_{U-5'}}$ (SEQ ID NO: 1227)

βc-732 Target: 5'-AGAACTTGCCACACGTGCAATCCCTGA-3' (SEQ ID NO: 2336)

5'-CAGUUAUGGUCCAUCAGCUUUCUAA$^{AC-3'}$ (SEQ ID NO: 5664)
3'-GUCAAUACCAGGUAGUCGAAAGAUU$_{U_{U-5'}}$ (SEQ ID NO: 1228)

βc-809 Target: 5'-CAGTTATGGTCCATCAGCTTTCTAAAA-3' (SEQ ID NO: 2337)

5'-AGUUAUGGUCCAUCAGCUUUCUAAA$^{CC-3'}$ (SEQ ID NO: 5665)
3'-UCAAUACCAGGUAGUCGAAAGAUUU$_{U_{U-5'}}$ (SEQ ID NO: 1229)

βc-810 Target: 5'-AGTTATGGTCCATCAGCTTTCTAAAAA-3' (SEQ ID NO: 2338)

5'-CUAAAAAGGAAGCUUCCAGACACGC$^{CC-3'}$ (SEQ ID NO: 5666)
3'-GAUUUUUCCUUCGAAGGUCUGUGCG$_{A_{U-5'}}$ (SEQ ID NO: 1230)

βc-830 Target: 5'-CTAAAAAGGAAGCTTCCAGACACGCTA-3' (SEQ ID NO: 2339)

5'-UAAAAAGGAAGCUUCCAGACACGCU$^{CC-3'}$ (SEQ ID NO: 5667)
3'-AUUUUUCCUUCGAAGGUCUGUGCGA$_{U_{A-5'}}$ (SEQ ID NO: 1231)

βc-831 Target: 5'-TAAAAAGGAAGCTTCCAGACACGCTAT-3' (SEQ ID NO: 2340)

5'-GUACCAUGCAGAAUACAAAUGAUGU$^{CA-3'}$ (SEQ ID NO: 5668)
3'-CAUGGUACGUCUUAUGUUUACUACA$_{U_{C-5'}}$ (SEQ ID NO: 1232)

βc-893 Target: 5'-GTACCATGCAGAATACAAATGATGTAG-3' (SEQ ID NO: 2341)

5'-UACCAUGCAGAAUACAAAUGAUGUA$^{AC-3'}$ (SEQ ID NO: 5669)
3'-AUGGUACGUCUUAUGUUUACUACAU$_{C_{U-5'}}$ (SEQ ID NO: 1233)

βc-894 Target: 5'-TACCATGCAGAATACAAATGATGTAGA-3' (SEQ ID NO: 2342)

5'-ACCAUGCAGAAUACAAAUGAUGUAG$^{CC-3'}$ (SEQ ID NO: 5670)
3'-UGGUACGUCUUAUGUUUACUACAUC$_{U_{U-5'}}$ (SEQ ID NO: 1234)

βc-895 Target: 5'-ACCATGCAGAATACAAATGATGTAGAA-3' (SEQ ID NO: 2343)

TABLE 7-continued

Selected Anti-β-catenin DsiRNA Agents,
Blunt/Frayed Duplexes

5'-CCAUGCAGAAUACAAAUGAUGUAGA<sup>C</sup><sup>C-3'</sup>  (SEQ ID NO: 5671)
3'-GGUACGUCUUAUGUUUACUACAUCU<sub>U</sub><sub>U-5'</sub>  (SEQ ID NO: 1235)

βc-896 Target: 5'-CCATGCAGAATACAAATGATGTAGAAA-3' (SEQ ID NO: 2344)

5'-CAUGCAGAAUACAAAUGAUGUAGAA<sup>C</sup><sup>A-3'</sup>  (SEQ ID NO: 5672)
3'-GUACGUCUUAUGUUUACUACAUCUU<sub>U</sub><sub>G-5'</sub>  (SEQ ID NO: 1236)

βc-897 Target: 5'-CATGCAGAATACAAATGATGTAGAAAC-3' (SEQ ID NO: 2345)

5'-AUGCAGAAUACAAAUGAUGUAGAAA<sup>A</sup><sup>C-3'</sup>  (SEQ ID NO: 5673)
3'-UACGUCUUAUGUUUACUACAUCUUU<sub>G</sub><sub>U-5'</sub>  (SEQ ID NO: 1237)

βc-898 Target: 5'-ATGCAGAATACAAATGATGTAGAAACA-3' (SEQ ID NO: 2346)

5'-UGCAGAAUACAAAUGAUGUAGAAAC<sup>C</sup><sup>A-3'</sup>  (SEQ ID NO: 5674)
3'-ACGUCUUAUGUUUACUACAUCUUUG<sub>U</sub><sub>C-5'</sub>  (SEQ ID NO: 1238)

βc-899 Target: 5'-TGCAGAATACAAATGATGTAGAAACAG-3' (SEQ ID NO: 2347)

5'-GCAGAAUACAAAUGAUGUAGAAACA<sup>A</sup><sup>A-3'</sup>  (SEQ ID NO: 5675)
3'-CGUCUUAUGUUUACUACAUCUUUGU<sub>C</sub><sub>G-5'</sub>  (SEQ ID NO: 1239)

βc-900 Target: 5'-GCAGAATACAAATGATGTAGAAACAGC-3' (SEQ ID NO: 2348)

5'-UACUGGCCAUCUUUAAGUCUGGAGG<sup>A</sup><sup>C-3'</sup>  (SEQ ID NO: 5676)
3'-AUGACCGGUAGAAAUUCAGACCUCC<sub>G</sub><sub>U-5'</sub>  (SEQ ID NO: 1240)

βc-977 Target: 5'-TACTGGCCATCTTTAAGTCTGGAGGCA-3' (SEQ ID NO: 2349)

5'-ACUGGCCAUCUUUAAGUCUGGAGGC<sup>C</sup><sup>C-3'</sup>  (SEQ ID NO: 5677)
3'-UGACCGGUAGAAAUUCAGACCUCCG<sub>U</sub><sub>A-5'</sub>  (SEQ ID NO: 1241)

βc-978 Target: 5'-ACTGGCCATCTTTAAGTCTGGAGGC-3' (SEQ ID NO: 2350)

5'-AAGAAGGAGCUAAAAUGGCAGUGCG<sup>C</sup><sup>C-3'</sup>  (SEQ ID NO: 5678)
3'-UUCUUCCUCGAUUUUACCGUCACGC<sub>A</sub><sub>A-5'</sub>  (SEQ ID NO: 1242)

βc-1091 Target: 5'-AAGAAGGAGCTAAAATGGCAGTGCGTT-3' (SEQ ID NO: 2351)

5'-AGAAGGAGCUAAAAUGGCAGUGCGU<sup>C</sup><sup>C-3'</sup>  (SEQ ID NO: 5679)
3'-UCUUCCUCGAUUUUACCGUCACGCA<sub>A</sub><sub>A-5'</sub>  (SEQ ID NO: 1243)

βc-1092 Target: 5'-AGAAGGAGCTAAAATGGCAGTGCGTTT-3' (SEQ ID NO: 2352)

5'-GAAGGAGCUAAAAUGGCAGUGCGUU<sup>C</sup><sup>C-3'</sup>  (SEQ ID NO: 5680)
3'-CUUCCUCGAUUUUACCGUCACGCAA<sub>A</sub><sub>U-5'</sub>  (SEQ ID NO: 1244)

βc-1093 Target: 5'-GAAGGAGCTAAAATGGCAGTGCGTTTA-3' (SEQ ID NO: 2353)

TABLE 7-continued

Selected Anti-β-catenin DsiRNA Agents, Blunt/Frayed Duplexes

5'-AAGGAGCUAAAAUGGCAGUGCGUUU$_C{}^{A-3'}$       (SEQ ID NO: 5681)
3'-UUCCUCGAUUUUACCGUCACGCAAA$_{U_C-5'}$         (SEQ ID NO: 1245)

βc-1094 Target: 5'-AAGGAGCTAAAATGGCAGTGCGTTTAG-3' (SEQ ID NO: 2354)

5'-AGGAGCUAAAAUGGCAGUGCGUUUA$_A{}^{A-3'}$       (SEQ ID NO: 5682)
3'-UCCUCGAUUUUACCGUCACGCAAAU$_{C_G-5'}$         (SEQ ID NO: 1246)

βc-1095 Target: 5'-AGGAGCTAAAATGGCAGTGCGTTTAGC-3' (SEQ ID NO: 2355)

5'-UACUGUGGACCACAAGCAGAGUGCU$_A{}^{C-3'}$       (SEQ ID NO: 5683)
3'-AUGACACCUGGUGUUCGUCUCACGA$_{C_U-5'}$         (SEQ ID NO: 1247)

βc-1301 Target: 5'-TACTGTGGACCACAAGCAGAGTGCTGA-3' (SEQ ID NO: 2356)

5'-ACUGUGGACCACAAGCAGAGUGCUG$_C{}^{C-3'}$       (SEQ ID NO: 5684)
3'-UGACACCUGGUGUUCGUCUCACGAC$_{U_U-5'}$         (SEQ ID NO: 1248)

βc-1302 Target: 5'-ACTGTGGACCACAAGCAGAGTGCTGAA-3' (SEQ ID NO: 2357)

5'-CUGUGGACCACAAGCAGAGUGCUGA$_C{}^{A-3'}$       (SEQ ID NO: 5685)
3'-GACACCUGGUGUUCGUCUCACGACU$_{U_C-5'}$         (SEQ ID NO: 1249)

βc-1303 Target: 5'-CTGTGGACCACAAGCAGAGTGCTGAAG-3' (SEQ ID NO: 2358)

5'-UGUGGACCACAAGCAGAGUGCUGAA$_A{}^{A-3'}$       (SEQ ID NO: 5686)
3'-ACACCUGGUGUUCGUCUCACGACUU$_{C_C-5'}$         (SEQ ID NO: 1250)

βc-1304 Target: 5'-TGTGGACCACAAGCAGAGTGCTGAAGG-3' (SEQ ID NO: 2359)

5'-GUGGACCACAAGCAGAGUGCUGAAG$_A{}^{C-3'}$       (SEQ ID NO: 5687)
3'-CACCUGGUGUUCGUCUCACGACUUC$_{C_A-5'}$         (SEQ ID NO: 1251)

βc-1305 Target: 5'-GTGGACCACAAGCAGAGTGCTGAAGGT-3' (SEQ ID NO: 2360)

5'-UGGACCACAAGCAGAGUGCUGAAGG$_C{}^{A-3'}$       (SEQ ID NO: 5688)
3'-ACCUGGUGUUCGUCUCACGACUUCC$_{A_C-5'}$         (SEQ ID NO: 1252)

βc-1306 Target: 5'-TGGACCACAAGCAGAGTGCTGAAGGTG-3' (SEQ ID NO: 2361)

5'-GGACCACAAGCAGAGUGCUGAAGGU$_A{}^{A-3'}$       (SEQ ID NO: 5689)
3'-CCUGGUGUUCGUCUCACGACUUCCA$_{C_G-5'}$         (SEQ ID NO: 1253)

βc-1307 Target: 5'-GGACCACAAGCAGAGTGCTGAAGGTGC-3' (SEQ ID NO: 2362)

TABLE 7-continued

Selected Anti-β-catenin DsiRNA Agents,
Blunt/Frayed Duplexes

5'-GACCACAAGCAGAGUGCUGAAGGUG$^{AC-3'}$ (SEQ ID NO: 5690)
3'-CUGGUGUUCGUCUCACGACUUCCAC$_{GA-5'}$ (SEQ ID NO: 1254)

βc-1308 Target: 5'-GACCACAAGCAGAGTGCTGAAGGTGCT-3' (SEQ ID NO: 2363)

5'-ACCACAAGCAGAGUGCUGAAGGUGC$^{CC-3'}$ (SEQ ID NO: 5691)
3'-UGGUGUUCGUCUCACGACUUCCACG$_{AU-5'}$ (SEQ ID NO: 1255)

βc-1309 Target: 5'-ACCACAAGCAGAGTGCTGAAGGTGCTA-3' (SEQ ID NO: 2364)

5'-CCACAAGCAGAGUGCUGAAGGUGCU$^{CC-3'}$ (SEQ ID NO: 5692)
3'-GGUGUUCGUCUCACGACUUCCACGA$_{UA-5'}$ (SEQ ID NO: 1256)

βc-1310 Target: 5'-CCACAAGCAGAGTGCTGAAGGTGCTAT-3' (SEQ ID NO: 2365)

5'-CACAAGCAGAGUGCUGAAGGUGCUA$^{CA-3'}$ (SEQ ID NO: 5693)
3'-GUGUUCGUCUCACGACUUCCACGAU$_{AG-5'}$ (SEQ ID NO: 1257)

βc-1311 Target: 5'-CACAAGCAGAGTGCTGAAGGTGCTATC-3' (SEQ ID NO: 2366)

5'-ACAAGCAGAGUGCUGAAGGUGCUAU$^{AC-3'}$ (SEQ ID NO: 5694)
3'-UGUUCGUCUCACGACUUCCACGAUA$_{GA-5'}$ (SEQ ID NO: 1258)

βc-1312 Target: 5'-ACAAGCAGAGTGCTGAAGGTGCTATCT-3' (SEQ ID NO: 2367)

5'-CAAGCAGAGUGCUGAAGGUGCUAUC$^{CA-3'}$ (SEQ ID NO: 5695)
3'-GUUCGUCUCACGACUUCCACGAUAG$_{AC-5'}$ (SEQ ID NO: 1259)

βc-1313 Target: 5'-CAAGCAGAGTGCTGAAGGTGCTATCTG-3' (SEQ ID NO: 2368)

5'-AAGCAGAGUGCUGAAGGUGCUAUCU$^{AC-3'}$ (SEQ ID NO: 5696)
3'-UUCGUCUCACGACUUCCACGAUAGA$_{CA-5'}$ (SEQ ID NO: 1260)

βc-1314 Target: 5'-AAGCAGAGTGCTGAAGGTGCTATCTGT-3' (SEQ ID NO: 2369)

5'-AGAACUGUCUUUGGACUCUCAGGAA$^{CA-3'}$ (SEQ ID NO: 5697)
3'-UCUUGACAGAAACCUGAGAGUCCUU$_{AG-5'}$ (SEQ ID NO: 1261)

βc-1430 Target: 5'-AGAACTGTCTTTGGACTCTCAGGAATC-3' (SEQ ID NO: 2370)

5'-GAACUGUCUUUGGACUCUCAGGAAU$^{AC-3'}$ (SEQ ID NO: 5698)
3'-CUUGACAGAAACCUGAGAGUCCUUA$_{GA-5'}$ (SEQ ID NO: 1262)

βc-1431 Target: 5'-GAACTGTCTTTGGACTCTCAGGAATCT-3' (SEQ ID NO: 2371)

TABLE 7-continued

Selected Anti-β-catenin DsiRNA Agents,
Blunt/Frayed Duplexes

5'-CAGAUGAUAUAAAUGUGGUCACCUG<sup>CA-3'</sup>       (SEQ ID NO: 5699)
3'-GUCUACUAUAUUUACACCAGUGGAC<sub>AC-5'</sub>       (SEQ ID NO: 1263)

βc-1526 Target: 5'-CAGATGATATAAATGTGGTCACCTGTG-3' (SEQ ID NO: 2372)

5'-AGAUGAUAUAAAUGUGGUCACCUGU<sup>AA-3'</sup>       (SEQ ID NO: 5700)
3'-UCUACUAUAUUUACACCAGUGGACA<sub>CG-5'</sub>       (SEQ ID NO: 1264)

βc-1527 Target: 5'-AGATGATATAAATGTGGTCACCTGTGC-3' (SEQ ID NO: 2373)

5'-GAUGAUAUAAAUGUGGUCACCUGUG<sup>AC-3'</sup>       (SEQ ID NO: 5701)
3'-CUACUAUAUUUACACCAGUGGACAC<sub>GU-5'</sub>       (SEQ ID NO: 1265)

βc-1528 Target: 5'-GATGATATAAATGTGGTCACCTGTGCA-3' (SEQ ID NO: 2374)

5'-AUGAUAUAAAUGUGGUCACCUGUGC<sup>CA-3'</sup>       (SEQ ID NO: 5702)
3'-UACUAUAUUUACACCAGUGGACACG<sub>UC-5'</sub>       (SEQ ID NO: 1266)

βc-1529 Target: 5'-ATGATATAAATGTGGTCACCTGTGCAG-3' (SEQ ID NO: 2375)

5'-UGAUAUAAAUGUGGUCACCUGUGCA<sup>AA-3'</sup>       (SEQ ID NO: 5703)
3'-ACUAUAUUUACACCAGUGGACACGU<sub>CG-5'</sub>       (SEQ ID NO: 1267)

βc-1530 Target: 5'-TGATATAAATGTGGTCACCTGTGCAGC-3' (SEQ ID NO: 2376)

5'-GAUAUAAAUGUGGUCACCUGUGCAG<sup>AC-3'</sup>       (SEQ ID NO: 5704)
3'-CUAUAUUUACACCAGUGGACACGUC<sub>GA-5'</sub>       (SEQ ID NO: 1268)

βc-1531 Target: 5'-GATATAAATGTGGTCACCTGTGCAGCT-3' (SEQ ID NO: 2377)

5'-AUAUAAAUGUGGUCACCUGUGCAGC<sup>CA-3'</sup>       (SEQ ID NO: 5705)
3'-UAUAUUUACACCAGUGGACACGUCG<sub>AC-5'</sub>       (SEQ ID NO: 1269)

βc-1532 Target: 5'-ATATAAATGTGGTCACCTGTGCAGCTG-3' (SEQ ID NO: 2378)

5'-UAUAAAUGUGGUCACCUGUGCAGCU<sup>AA-3'</sup>       (SEQ ID NO: 5706)
3'-AUAUUUACACCAGUGGACACGUCGA<sub>CC-5'</sub>       (SEQ ID NO: 1270)

βc-1533 Target: 5'-TATAAATGTGGTCACCTGTGCAGCTGG-3' (SEQ ID NO: 2379)

5'-AUAAAUGUGGUCACCUGUGCAGCUG<sup>AC-3'</sup>       (SEQ ID NO: 5707)
3'-UAUUUACACCAGUGGACACGUCGAC<sub>UC-5'</sub>       (SEQ ID NO: 1271)

βc-1534 Target: 5'-ATAAATGTGGTCACCTGTGCAGCTGGA-3' (SEQ ID NO: 2380)

TABLE 7-continued

Selected Anti-β-catenin DsiRNA Agents,
Blunt/Frayed Duplexes

5'-UAAAUGUGGUCACCUGUGCAGCUGG$^{CC-3'}$      (SEQ ID NO: 5708)
3'-AUUUACACCAGUGGACACGUCGACC$_{UU-5'}$      (SEQ ID NO: 1272)

βc-1535 Target: 5'-TAAATGTGGTCACCTGTGCAGCTGGAA-3' (SEQ ID NO: 2381)

5'-AAAUGUGGUCACCUGUGCAGCUGGA$^{AC-3'}$      (SEQ ID NO: 5709)
3'-UUUACACCAGUGGACACGUCGACCU$_{UA-5'}$      (SEQ ID NO: 1273)

βc-1536 Target: 5'-AAATGTGGTCACCTGTGCAGCTGGAAT-3' (SEQ ID NO: 2382)

5'-AAUGUGGUCACCUGUGCAGCUGGAA$^{CC-3'}$      (SEQ ID NO: 5710)
3'-UUACACCAGUGGACACGUCGACCUU$_{AA-5'}$      (SEQ ID NO: 1274)

βc-1537 Target: 5'-AATGTGGTCACCTGTGCAGCTGGAATT-3' (SEQ ID NO: 2383)

5'-AUGUGGUCACCUGUGCAGCUGGAAU$^{CA-3'}$      (SEQ ID NO: 5711)
3'-UACACCAGUGGACACGUCGACCUUA$_{AG-5'}$      (SEQ ID NO: 1275)

βc-1538 Target: 5'-ATGTGGTCACCTGTGCAGCTGGAATTC-3' (SEQ ID NO: 2384)

5'-UGUGGUCACCUGUGCAGCUGGAAUU$^{AC-3'}$      (SEQ ID NO: 5712)
3'-ACACCAGUGGACACGUCGACCUUAA$_{GA-5'}$      (SEQ ID NO: 1276)

βc-1539 Target: 5'-TGTGGTCACCTGTGCAGCTGGAATTCT-3' (SEQ ID NO: 2385)

5'-GUGGUCACCUGUGCAGCUGGAAUUC$^{CC-3'}$      (SEQ ID NO: 5713)
3'-CACCAGUGGACACGUCGACCUUAAG$_{AA-5'}$      (SEQ ID NO: 1277)

βc-1540 Target: 5'-GTGGTCACCTGTGCAGCTGGAATTCTT-3' (SEQ ID NO: 2386)

5'-UGGUCACCUGUGCAGCUGGAAUUCU$^{CC-3'}$      (SEQ ID NO: 5714)
3'-ACCAGUGGACACGUCGACCUUAAGA$_{AA-5'}$      (SEQ ID NO: 1278)

βc-1541 Target: 5'-TGGTCACCTGTGCAGCTGGAATTCTTT-3' (SEQ ID NO: 2387)

5'-GGUCACCUGUGCAGCUGGAAUUCUU$^{CA-3'}$      (SEQ ID NO: 5715)
3'-CCAGUGGACACGUCGACCUUAAGAA$_{AG-5'}$      (SEQ ID NO: 1279)

βc-1542 Target: 5'-GGTCACCTGTGCAGCTGGAATTCTTTC-3' (SEQ ID NO: 2388)

5'-GUCACCUGUGCAGCUGGAAUUCUUU$^{AC-3'}$      (SEQ ID NO: 5716)
3'-CAGUGGACACGUCGACCUUAAGAAA$_{GA-5'}$      (SEQ ID NO: 1280)

βc-1543 Target: 5'-GTCACCTGTGCAGCTGGAATTCTTTCT-3' (SEQ ID NO: 2389)

TABLE 7-continued

Selected Anti-β-catenin DsiRNA Agents,
Blunt/Frayed Duplexes

```
5'-UCACCUGUGCAGCUGGAAUUCUUUC_C^C-3'   (SEQ ID NO: 5717)
3'-AGUGGACACGUCGACCUUAAGAAAG_A       (SEQ ID NO: 1281)
                               U-5'
```

βc-1544 Target: 5'-TCACCTGTGCAGCTGGAATTCTTTCTA-3' (SEQ ID NO: 2390)

```
5'-CACCUGUGCAGCUGGAAUUCUUUCU_C^C-3'   (SEQ ID NO: 5718)
3'-GUGGACACGUCGACCUUAAGAAAGA          (SEQ ID NO: 1282)
                               U-5'
```

βc-1545 Target: 5'-CACCTGTGCAGCTGGAATTCTTTCTAA-3' (SEQ ID NO: 2391)

```
5'-UUUCUAACCUCACUUGCAAUAAUUA_C^C-3'   (SEQ ID NO: 5719)
3'-AAAGAUUGGAGUGAACGUUAUUAAU_A        (SEQ ID NO: 1283)
                               U-5'
```

βc-1565 Target: 5'-TTTCTAACCTCACTTGCAATAATTATA-3' (SEQ ID NO: 2392)

```
5'-UUCUAACCUCACUUGCAAUAAUUAU_C^C-3'   (SEQ ID NO: 5720)
3'-AAGAUUGGAGUGAACGUUAUUAAUA          (SEQ ID NO: 1284)
                               U-5'
```

βc-1566 Target: 5'-TTCTAACCTCACTTGCAATAATTATAA-3' (SEQ ID NO: 2393)

```
5'-UCUAACCUCACUUGCAAUAAUUAUA_C^A-3'   (SEQ ID NO: 5721)
3'-AGAUUGGAGUGAACGUUAUUAAUAU          (SEQ ID NO: 1285)
                               C-5'
```

βc-1567 Target: 5'-TCTAACCTCACTTGCAATAATTATAAG-3' (SEQ ID NO: 2394)

```
5'-CUAACCUCACUUGCAAUAAUUAUAA_A^C-3'   (SEQ ID NO: 5722)
3'-GAUUGGAGUGAACGUUAUUAAUAUU_C        (SEQ ID NO: 1286)
                               U-5'
```

βc-1568 Target: 5'-CTAACCTCACTTGCAATAATTATAAGA-3' (SEQ ID NO: 2395)

```
5'-UAACCUCACUUGCAAUAAUUAUAAG_C^C-3'   (SEQ ID NO: 5723)
3'-AUUGGAGUGAACGUUAUUAAUAUUC_U        (SEQ ID NO: 1287)
                               U-5'
```

βc-1569 Target: 5'-TAACCTCACTTGCAATAATTATAAGAA-3' (SEQ ID NO: 2396)

```
5'-GGGCUGGUGACAGGGAAGACAUCAC_C^A-3'   (SEQ ID NO: 5724)
3'-CCCGACCACUGUCCCUUCUGUAGUG_A        (SEQ ID NO: 1288)
                               C-5'
```

βc-1652 Target: 5'-GGGCTGGTGACAGGGAAGACATCACTG-3' (SEQ ID NO: 2397)

```
5'-GGCUGGUGACAGGGAAGACAUCACU_A^C-3'   (SEQ ID NO: 5725)
3'-CCGACCACUGUCCCUUCUGUAGUGA          (SEQ ID NO: 1289)
                               U-5'
```

βc-1653 Target: 5'-GGCTGGTGACAGGGAAGACATCACTGA-3' (SEQ ID NO: 2398)

TABLE 7-continued

Selected Anti-β-catenin DsiRNA Agents,
Blunt/Frayed Duplexes

5'-GCUGGUGACAGGGAAGACAUCACUG$^{CA-3'}$      (SEQ ID NO: 5726)
3'-CGACCACUGUCCCUUCUGUAGUGAC$_{UC-5'}$      (SEQ ID NO: 1290)

βc-1654 Target: 5'-GCTGGTGACAGGGAAGACATCACTGAG-3' (SEQ ID NO: 2399)

5'-CUGGUGACAGGGAAGACAUCACUGA$^{AA-3'}$      (SEQ ID NO: 5727)
3'-GACCACUGUCCCUUCUGUAGUGACU$_{CG-5'}$      (SEQ ID NO: 1291)

βc-1655 Target: 5'-CTGGTGACAGGGAAGACATCACTGAGC-3' (SEQ ID NO: 2400)

5'-UGGUGACAGGGAAGACAUCACUGAG$^{AA-3'}$      (SEQ ID NO: 5728)
3'-ACCACUGUCCCUUCUGUAGUGACUC$_{GG-5'}$      (SEQ ID NO: 1292)

βc-1656 Target: 5'-TGGTGACAGGGAAGACATCACTGAGCC-3' (SEQ ID NO: 2401)

5'-GGUGACAGGGAAGACAUCACUGAGC$^{AC-3'}$      (SEQ ID NO: 5729)
3'-CCACUGUCCCUUCUGUAGUGACUCG$_{GA-5'}$      (SEQ ID NO: 1293)

βc-1657 Target: 5'-GGTGACAGGGAAGACATCACTGAGCCT-3' (SEQ ID NO: 2402)

5'-GUGACAGGGAAGACAUCACUGAGCC$^{CA-3'}$      (SEQ ID NO: 5730)
3'-CACUGUCCCUUCUGUAGUGACUCGG$_{AC-5'}$      (SEQ ID NO: 1294)

βc-1658 Target: 5'-GTGACAGGGAAGACATCACTGAGCCTG-3' (SEQ ID NO: 2403)

5'-UGACAGGGAAGACAUCACUGAGCCU$^{AA-3'}$      (SEQ ID NO: 5731)
3'-ACUGUCCCUUCUGUAGUGACUCGGA$_{CG-5'}$      (SEQ ID NO: 1295)

βc-1659 Target: 5'-TGACAGGGAAGACATCACTGAGCCTGC-3' (SEQ ID NO: 2404)

5'-GACAGGGAAGACAUCACUGAGCCUG$^{AA-3'}$      (SEQ ID NO: 5732)
3'-CUGUCCCUUCUGUAGUGACUCGGAC$_{GG-5'}$      (SEQ ID NO: 1296)

βc-1660 Target: 5'-GACAGGGAAGACATCACTGAGCCTGCC-3' (SEQ ID NO: 2405)

5'-ACAGGGAAGACAUCACUGAGCCUGC$^{AC-3'}$      (SEQ ID NO: 5733)
3'-UGUCCCUUCUGUAGUGACUCGGACG$_{GU-5'}$      (SEQ ID NO: 1297)

βc-1661 Target: 5'-ACAGGGAAGACATCACTGAGCCTGCCA-3' (SEQ ID NO: 2406)

5'-CAGGGAAGACAUCACUGAGCCUGCC$^{CC-3'}$      (SEQ ID NO: 5734)
3'-GUCCCUUCUGUAGUGACUCGGACGG$_{UA-5'}$      (SEQ ID NO: 1298)

βc-1662 Target: 5'-CAGGGAAGACATCACTGAGCCTGCC-3' (SEQ ID NO: 2407)

TABLE 7-continued

Selected Anti-β-catenin DsiRNA Agents,
Blunt/Frayed Duplexes

5'-AGGGAAGACAUCACUGAGCCUGCCA$^{CA-3'}$    (SEQ ID NO: 5735)
3'-UCCCUUCUGUAGUGACUCGGACGGU$_{AG-5'}$    (SEQ ID NO: 1299)

βc-1663 Target: 5'-AGGGAAGACATCACTGAGCCTGCCATC-3' (SEQ ID NO: 2408)

5'-GGGAAGACAUCACUGAGCCUGCCAU$^{AC-3'}$    (SEQ ID NO: 5736)
3'-CCCUUCUGUAGUGACUCGGACGGUA$_{GA-5'}$    (SEQ ID NO: 1300)

βc-1664 Target: 5'-GGGAAGACATCACTGAGCCTGCCATCT-3' (SEQ ID NO: 2409)

5'-GGAAGACAUCACUGAGCCUGCCAUC$^{CA-3'}$    (SEQ ID NO: 5737)
3'-CCUUCUGUAGUGACUCGGACGGUAG$_{AC-5'}$    (SEQ ID NO: 1301)

βc-1665 Target: 5'-GGAAGACATCACTGAGCCTGCCATCTG-3' (SEQ ID NO: 2410)

5'-GAAGACAUCACUGAGCCUGCCAUCU$^{AC-3'}$    (SEQ ID NO: 5738)
3'-CUUCUGUAGUGACUCGGACGGUAGA$_{CA-5'}$    (SEQ ID NO: 1302)

βc-1666 Target: 5'-GAAGACATCACTGAGCCTGCCATCTGT-3' (SEQ ID NO: 2411)

5'-AAGACAUCACUGAGCCUGCCAUCUG$^{CA-3'}$    (SEQ ID NO: 5739)
3'-UUCUGUAGUGACUCGGACGGUAGAC$_{AC-5'}$    (SEQ ID NO: 1303)

βc-1667 Target: 5'-AAGACATCACTGAGCCTGCCATCTGTG-3' (SEQ ID NO: 2412)

5'-AGACAUCACUGAGCCUGCCAUCUGU$^{AA-3'}$    (SEQ ID NO: 5740)
3'-UCUGUAGUGACUCGGACGGUAGACA$_{CG-5'}$    (SEQ ID NO: 1304)

βc-1668 Target: 5'-AGACATCACTGAGCCTGCCATCTGTGC-3' (SEQ ID NO: 2413)

5'-GACAUCACUGAGCCUGCCAUCUGUG$^{AC-3'}$    (SEQ ID NO: 5741)
3'-CUGUAGUGACUCGGACGGUAGACAC$_{GA-5'}$    (SEQ ID NO: 1305)

βc-1669 Target: 5'-GACATCACTGAGCCTGCCATCTGTGCT-3' (SEQ ID NO: 2414)

5'-ACAUCACUGAGCCUGCCAUCUGUGC$^{CA-3'}$    (SEQ ID NO: 5742)
3'-UGUAGUGACUCGGACGGUAGACACG$_{AG-5'}$    (SEQ ID NO: 1306)

βc-1670 Target: 5'-ACATCACTGAGCCTGCCATCTGTGCTC-3' (SEQ ID NO: 2415)

5'-CAUCACUGAGCCUGCCAUCUGUGCU$^{AC-3'}$    (SEQ ID NO: 5743)
3'-GUAGUGACUCGGACGGUAGACACGA$_{GA-5'}$    (SEQ ID NO: 1307)

βc-1671 Target: 5'-CATCACTGAGCCTGCCATCTGTGCTCT-3' (SEQ ID NO: 2416)

TABLE 7-continued

Selected Anti-β-catenin DsiRNA Agents,
Blunt/Frayed Duplexes

5'-AUCACUGAGCCUGCCAUCUGUGCUC$^{CC-3'}$  (SEQ ID NO: 5744)
3'-UAGUGACUCGGACGGUAGACACGAG$_{AA-5'}$  (SEQ ID NO: 1308)

βc-1672 Target: 5'-ATCACTGAGCCTGCCATCTGTGCTCTT-3' (SEQ ID NO: 2417)

5'-UCACUGAGCCUGCCAUCUGUGCUCU$^{CA-3'}$  (SEQ ID NO: 5745)
3'-AGUGACUCGGACGGUAGACACGAGA$_{AG-5'}$  (SEQ ID NO: 1309)

βc-1673 Target: 5'-TCACTGAGCCTGCCATCTGTGCTCTTC-3' (SEQ ID NO: 2418)

5'-CACUGAGCCUGCCAUCUGUGCUCUU$^{AA-3'}$  (SEQ ID NO: 5746)
3'-GUGACUCGGACGGUAGACACGAGAA$_{GC-5'}$  (SEQ ID NO: 1310)

βc-1674 Target: 5'-CACTGAGCCTGCCATCTGTGCTCTTCG-3' (SEQ ID NO: 2419)

5'-ACUGAGCCUGCCAUCUGUGCUCUUC$^{AC-3'}$  (SEQ ID NO: 5747)
3'-UGACUCGGACGGUAGACACGAGAAG$_{CA-5'}$  (SEQ ID NO: 1311)

βc-1675 Target: 5'-ACTGAGCCTGCCATCTGTGCTCTTCGT-3' (SEQ ID NO: 2420)

5'-CUGAGCCUGCCAUCUGUGCUCUUCG$^{CA-3'}$  (SEQ ID NO: 5748)
3'-GACUCGGACGGUAGACACGAGAAGC$_{AG-5'}$  (SEQ ID NO: 1312)

βc-1676 Target: 5'-CTGAGCCTGCCATCTGTGCTCTTCGTC-3' (SEQ ID NO: 2421)

5'-UGAGCCUGCCAUCUGUGCUCUUCGU$^{AC-3'}$  (SEQ ID NO: 5749)
3'-ACUCGGACGGUAGACACGAGAAGCA$_{GU-5'}$  (SEQ ID NO: 1313)

βc-1677 Target: 5'-TGAGCCTGCCATCTGTGCTCTTCGTCA-3' (SEQ ID NO: 2422)

5'-GAGCCUGCCAUCUGUGCUCUUCGUC$^{CC-3'}$  (SEQ ID NO: 5750)
3'-CUCGGACGGUAGACACGAGAAGCAG$_{UA-5'}$  (SEQ ID NO: 1314)

βc-1678 Target: 5'-GAGCCTGCCATCTGTGCTCTTCGTC-3' (SEQ ID NO: 2423)

5'-AGCCUGCCAUCUGUGCUCUUCGUCA$^{CA-3'}$  (SEQ ID NO: 5751)
3'-UCGGACGGUAGACACGAGAAGCAGU$_{AG-5'}$  (SEQ ID NO: 1315)

βc-1679 Target: 5'-AGCCTGCCATCTGTGCTCTTCGTCATC-3' (SEQ ID NO: 2424)

5'-GCCUGCCAUCUGUGCUCUUCGUCAU$^{AC-3'}$  (SEQ ID NO: 5752)
3'-CGGACGGUAGACACGAGAAGCAGUA$_{GA-5'}$  (SEQ ID NO: 1316)

βc-1680 Target: 5'-GCCTGCCATCTGTGCTCTTCGTCATCT-3' (SEQ ID NO: 2425)

TABLE 7-continued

Selected Anti-β-catenin DsiRNA Agents,
Blunt/Frayed Duplexes

```
5'-CCUGCCAUCUGUGCUCUUCGUCAUC^CA-3'   (SEQ ID NO: 5753)
3'-GGACGGUAGACACGAGAAGCAGUAG_AC-5'   (SEQ ID NO: 1317)
```

βc-1681 Target: 5'-CCTGCCATCTGTGCTCTTCGTCATCTG-3' (SEQ ID NO: 2426)

```
5'-CUGCCAUCUGUGCUCUUCGUCAUCU^AC-3'   (SEQ ID NO: 5754)
3'-GACGGUAGACACGAGAAGCAGUAGA_CU-5'   (SEQ ID NO: 1318)
```

βc-1682 Target: 5'-CTGCCATCTGTGCTCTTCGTCATCTGA-3' (SEQ ID NO: 2427)

```
5'-UGCCAUCUGUGCUCUUCGUCAUCUG^CA-3'   (SEQ ID NO: 5755)
3'-ACGGUAGACACGAGAAGCAGUAGAC_UG-5'   (SEQ ID NO: 1319)
```

βc-1683 Target: 5'-TGCCATCTGTGCTCTTCGTCATCTGAC-3' (SEQ ID NO: 2428)

```
5'-GCCAUCUGUGCUCUUCGUCAUCUGA^AA-3'   (SEQ ID NO: 5756)
3'-CGGUAGACACGAGAAGCAGUAGACU_GG-5'   (SEQ ID NO: 1320)
```

βc-1684 Target: 5'-GCCATCTGTGCTCTTCGTCATCTGACC-3' (SEQ ID NO: 2429)

```
5'-CCAUCUGUGCUCUUCGUCAUCUGAC^AC-3'   (SEQ ID NO: 5757)
3'-GGUAGACACGAGAAGCAGUAGACUG_UG-5'   (SEQ ID NO: 1321)
```

βc-1685 Target: 5'-CCATCTGTGCTCTTCGTCATCTGACCA-3' (SEQ ID NO: 2430)

```
5'-CAUCUGUGCUCUUCGUCAUCUGACC^CA-3'   (SEQ ID NO: 5758)
3'-GUAGACACGAGAAGCAGUAGACUGG_UC-5'   (SEQ ID NO: 1322)
```

βc-1686 Target: 5'-CATCTGTGCTCTTCGTCATCTGACCAG-3' (SEQ ID NO: 2431)

```
5'-AUCUGUGCUCUUCGUCAUCUGACCA^AA-3'   (SEQ ID NO: 5759)
3'-UAGACACGAGAAGCAGUAGACUGGU_CG-5'   (SEQ ID NO: 1323)
```

βc-1687 Target: 5'-ATCTGTGCTCTTCGTCATCTGACCAGC-3' (SEQ ID NO: 2432)

```
5'-UCUGUGCUCUUCGUCAUCUGACCAG^AA-3'   (SEQ ID NO: 5760)
3'-AGACACGAGAAGCAGUAGACUGGUC_GG-5'   (SEQ ID NO: 1324)
```

βc-1688 Target: 5'-TCTGTGCTCTTCGTCATCTGACCAGCC-3' (SEQ ID NO: 2433)

```
5'-CUGUGCUCUUCGUCAUCUGACCAGC^AA-3'   (SEQ ID NO: 5761)
3'-GACACGAGAAGCAGUAGACUGGUCG_GC-5'   (SEQ ID NO: 1325)
```

βc-1689 Target: 5'-CTGTGCTCTTCGTCATCTGACCAGCCG-3' (SEQ ID NO: 2434)

TABLE 7-continued

Selected Anti-β-catenin DsiRNA Agents,
Blunt/Frayed Duplexes

```
                          A C-3'
5'-UGUGCUCUUCGUCAUCUGACCAGCC         (SEQ ID NO: 5762)
3'-ACACGAGAAGCAGUAGACUGGUCGG         (SEQ ID NO: 1326)
                           G
                            C-5'
```

βc-1690 Target: 5'-TGTGCTCTTCGTCATCTGACCAGCCGA-3' (SEQ ID NO: 2435)

```
                          C A-3'
5'-GUGCUCUUCGUCAUCUGACCAGCCG         (SEQ ID NO: 5763)
3'-CACGAGAAGCAGUAGACUGGUCGGC         (SEQ ID NO: 1327)
                           U
                            G-5'
```

βc-1691 Target: 5'-GTGCTCTTCGTCATCTGACCAGCCGAC-3' (SEQ ID NO: 2436)

```
                          A C-3'
5'-UGCUCUUCGUCAUCUGACCAGCCGA         (SEQ ID NO: 5764)
3'-ACGAGAAGCAGUAGACUGGUCGGCU         (SEQ ID NO: 1328)
                           G
                            U-5'
```

βc-1692 Target: 5'-TGCTCTTCGTCATCTGACCAGCCGACA-3' (SEQ ID NO: 2437)

```
                          C A-3'
5'-GCUCUUCGUCAUCUGACCAGCCGAC         (SEQ ID NO: 5765)
3'-CGAGAAGCAGUAGACUGGUCGGCUG         (SEQ ID NO: 1329)
                           U
                            G-5'
```

βc-1693 Target: 5'-GCTCTTCGTCATCTGACCAGCCGACAC-3' (SEQ ID NO: 2438)

```
                          A A-3'
5'-CUCUUCGUCAUCUGACCAGCCGACA         (SEQ ID NO: 5766)
3'-GAGAAGCAGUAGACUGGUCGGCUGU         (SEQ ID NO: 1330)
                           G
                            G-5'
```

βc-1694 Target: 5'-CTCTTCGTCATCTGACCAGCCGACACC-3' (SEQ ID NO: 2439)

```
                          A C-3'
5'-UCUUCGUCAUCUGACCAGCCGACAC         (SEQ ID NO: 5767)
3'-AGAAGCAGUAGACUGGUCGGCUGUG         (SEQ ID NO: 1331)
                           G
                            U-5'
```

βc-1695 Target: 5'-TCTTCGTCATCTGACCAGCCGACACCA-3' (SEQ ID NO: 2440)

```
                          A C-3'
5'-UACACCCACCAUCCCACUGGCCUCU         (SEQ ID NO: 5768)
3'-AUGUGGGUGGUAGGGUGACCGGAGA         (SEQ ID NO: 1332)
                           C
                            U-5'
```

βc-1787 Target: 5'-TACACCCACCATCCCACTGGCCTCTGA-3' (SEQ ID NO: 2441)

```
                          C C-3'
5'-ACACCCACCAUCCCACUGGCCUCUG         (SEQ ID NO: 5769)
3'-UGUGGGUGGUAGGGUGACCGGAGAC         (SEQ ID NO: 1333)
                           U
                            A-5'
```

βc-1788 Target: 5'-ACACCCACCATCCCACTGGCCTCTGAT-3' (SEQ ID NO: 2442)

```
                          C C-3'
5'-CACCCACCAUCCCACUGGCCUCUGA         (SEQ ID NO: 5770)
3'-GUGGGUGGUAGGGUGACCGGAGACU         (SEQ ID NO: 1334)
                           A
                            U-5'
```

βc-1789 Target: 5'-CACCCACCATCCCACTGGCCTCTGATA-3' (SEQ ID NO: 2443)

TABLE 7-continued

Selected Anti-β-catenin DsiRNA Agents,
Blunt/Frayed Duplexes

5'-ACCCACCAUCCCACUGGCCUCUGAU$^{C}$$^{C-3'}$ (SEQ ID NO: 5771)
3'-UGGGUGGUAGGGUGACCGGAGACUA$_{U}$$_{U-5'}$ (SEQ ID NO: 1335)

βc-1790 Target: 5'-ACCCACCATCCCACTGGCCTCTGATAA-3' (SEQ ID NO: 2444)

5'-CCCACCAUCCCACUGGCCUCUGAUA$^{C}$$^{C-3'}$ (SEQ ID NO: 5772)
3'-GGGUGGUAGGGUGACCGGAGACUAU$_{U}$$_{U-5'}$ (SEQ ID NO: 1336)

βc-1791 Target: 5'-CCCACCATCCCACTGGCCTCTGATAAA-3' (SEQ ID NO: 2445)

5'-CCACCAUCCCACUGGCCUCUGAUAA$^{C}$$^{A-3'}$ (SEQ ID NO: 5773)
3'-GGUGGUAGGGUGACCGGAGACUAUU$_{U}$$_{C-5'}$ (SEQ ID NO: 1337)

βc-1792 Target: 5'-CCACCATCCCACTGGCCTCTGATAAAG-3' (SEQ ID NO: 2446)

5'-CACCAUCCCACUGGCCUCUGAUAAA$^{A}$$^{A-3'}$ (SEQ ID NO: 5774)
3'-GUGGUAGGGUGACCGGAGACUAUUU$_{C}$$_{C-5'}$ (SEQ ID NO: 1338)

βc-1793 Target: 5'-CACCATCCCACTGGCCTCTGATAAAGG-3' (SEQ ID NO: 2447)

5'-ACCAUCCCACUGGCCUCUGAUAAAG$^{A}$$^{A-3'}$ (SEQ ID NO: 5775)
3'-UGGUAGGGUGACCGGAGACUAUUUC$_{G-5'}$ (SEQ ID NO: 1339)

βc-1794 Target: 5'-ACCATCCCACTGGCCTCTGATAAAGGC-3' (SEQ ID NO: 2448)

5'-CCAUCCCACUGGCCUCUGAUAAAGG$^{A}$$^{C-3'}$ (SEQ ID NO: 5776)
3'-GGUAGGGUGACCGGAGACUAUUUCC$_{G}$$_{A-5'}$ (SEQ ID NO: 1340)

βc-1795 Target: 5'-CCATCCCACTGGCCTCTGATAAAGGCT-3' (SEQ ID NO: 2449)

5'-CAUCCCACUGGCCUCUGAUAAAGGC$^{C}$$^{C-3'}$ (SEQ ID NO: 5777)
3'-GUAGGGUGACCGGAGACUAUUUCCG$_{A}$$_{U-5'}$ (SEQ ID NO: 1341)

βc-1796 Target: 5'-CATCCCACTGGCCTCTGATAAAGGCTA-3' (SEQ ID NO: 2450)

5'-AUCCCACUGGCCUCUGAUAAAGGCU$^{C}$$^{A-3'}$ (SEQ ID NO: 5778)
3'-UAGGGUGACCGGAGACUAUUUCCGA$_{U}$$_{G-5'}$ (SEQ ID NO: 1342)

βc-1797 Target: 5'-ATCCCACTGGCCTCTGATAAAGGCTAC-3' (SEQ ID NO: 2451)

5'-UCCCACUGGCCUCUGAUAAAGGCUA$^{A}$$^{C-3'}$ (SEQ ID NO: 5779)
3'-AGGGUGACCGGAGACUAUUUCCGAU$_{G}$$_{A-5'}$ (SEQ ID NO: 1343)

βc-1798 Target: 5'-TCCCACTGGCCTCTGATAAAGGCTACT-3' (SEQ ID NO: 2452)

TABLE 7-continued

Selected Anti-β-catenin DsiRNA Agents,
Blunt/Frayed Duplexes

```
5'-CCCACUGGCCUCUGAUAAAGGCUAC^(CA-3')    (SEQ ID NO: 5780)
3'-GGGUGACCGGAGACUAUUUCCGAUG_(AC-5')    (SEQ ID NO: 1344)
```

βc-1799 Target: 5'-CCCACTGGCCTCTGATAAAGGCTACTG-3' (SEQ ID NO: 2453)

```
5'-CCACUGGCCUCUGAUAAAGGCUACU^(AC-3')    (SEQ ID NO: 5781)
3'-GGUGACCGGAGACUAUUUCCGAUGA_(CA-5')    (SEQ ID NO: 1345)
```

βc-1800 Target: 5'-CCACTGGCCTCTGATAAAGGCTACTGT-3' (SEQ ID NO: 2454)

```
5'-CUACUGUUGGAUUGAUUCGAAAUCU^(CA-3')    (SEQ ID NO: 5782)
3'-GAUGACAACCUAACUAAGCUUUAGA_(AC-5')    (SEQ ID NO: 1346)
```

βc-1820 Target: 5'-CTACTGTTGGATTGATTCGAAATCTTG-3' (SEQ ID NO: 2455)

```
5'-UACUGUUGGAUUGAUUCGAAAUCUU^(AA-3')    (SEQ ID NO: 5783)
3'-AUGACAACCUAACUAAGCUUUAGAA_(CG-5')    (SEQ ID NO: 1347)
```

βc-1821 Target: 5'-TACTGTTGGATTGATTCGAAATCTTGC-3' (SEQ ID NO: 2456)

```
5'-UAAAUACCAUUCCAUUGUUUGUGCA^(AA-3')    (SEQ ID NO: 5784)
3'-AUUUAUGGUAAGGUAACAAACACGU_(CG-5')    (SEQ ID NO: 1348)
```

βc-2072 Target: 5'-TAAATACCATTCCATTGTTTGTGCAGC-3' (SEQ ID NO: 2457)

```
5'-AAAUACCAUUCCAUUGUUUGUGCAG^(AC-3')    (SEQ ID NO: 5785)
3'-UUUAUGGUAAGGUAACAAACACGUC_(GA-5')    (SEQ ID NO: 1349)
```

βc-2073 Target: 5'-AAATACCATTCCATTGTTTGTGCAGCT-3' (SEQ ID NO: 2458)

```
5'-AAUACCAUUCCAUUGUUUGUGCAGC^(CA-3')    (SEQ ID NO: 5786)
3'-UUAUGGUAAGGUAACAAACACGUCG_(AC-5')    (SEQ ID NO: 1350)
```

βc-2074 Target: 5'-AATACCATTCCATTGTTTGTGCAGCTG-3' (SEQ ID NO: 2459)

```
5'-AUACCAUUCCAUUGUUUGUGCAGCU^(AA-3')    (SEQ ID NO: 5787)
3'-UAUGGUAAGGUAACAAACACGUCGA_(CG-5')    (SEQ ID NO: 1351)
```

βc-2075 Target: 5'-ATACCATTCCATTGTTTGTGCAGCTGC-3' (SEQ ID NO: 2460)

```
5'-UACCAUUCCAUUGUUUGUGCAGCUG^(AC-3')    (SEQ ID NO: 5788)
3'-AUGGUAAGGUAACAAACACGUCGAC_(GA-5')    (SEQ ID NO: 1352)
```

βc-2076 Target: 5'-TACCATTCCATTGTTTGTGCAGCTGCT-3' (SEQ ID NO: 2461)

TABLE 7-continued

Selected Anti-β-catenin DsiRNA Agents,
Blunk/Frayed Duplexes

5'-ACCAUUCCAUUGUUUGUGCAGCUGC$^{C}$C-3'  (SEQ ID NO: 5789)
3'-UGGUAAGGUAACAAACACGUCGACG$_{A}$A-5'  (SEQ ID NO: 1353)

βc-2077 Target: 5'-ACCATTCCATTGTTTGTGCAGCTGCTT-3' (SEQ ID NO: 2462)

5'-GCUGCUUUAUUCUCCCAUUGAAAAC$^{C}$C-3'  (SEQ ID NO: 5790)
3'-CGACGAAAUAAGAGGGUAACUUUUG$_{U}$A-5'  (SEQ ID NO: 1354)

βc-2097 Target: 5'-GCTGCTTTATTCTCCCATTGAAAAC-3' (SEQ ID NO: 2463)

5'-CUGCUUUAUUCUCCCAUUGAAAACA$^{C}$A-3'  (SEQ ID NO: 5791)
3'-GACGAAAUAAGAGGGUAACUUUUGU$_{A}$G-5'  (SEQ ID NO: 1355)

βc-2098 Target: 5'-CTGCTTTATTCTCCCATTGAAAACATC-3' (SEQ ID NO: 2464)

5'-UGCUUUAUUCUCCCAUUGAAAACAU$^{A}$A-3'  (SEQ ID NO: 5792)
3'-ACGAAAUAAGAGGGUAACUUUUGUA$_{G}$-5'  (SEQ ID NO: 1356)

βc-2099 Target: 5'-TGCTTTATTCTCCCATTGAAAACATCC-3' (SEQ ID NO: 2465)

5'-GCUUUAUUCUCCCAUUGAAAACAUC$^{A}$C-3'  (SEQ ID NO: 5793)
3'-CGAAAUAAGAGGGUAACUUUUGUAG$_{U}$-5'  (SEQ ID NO: 1357)

βc-2100 Target: 5'-GCTTTATTCTCCCATTGAAAACATCCA-3' (SEQ ID NO: 2466)

5'-GGGUCCUCUGUGAACUUGCUCAGGA$^{A}$C-3'  (SEQ ID NO: 5794)
3'-CCCAGGAGACACUUGAACGAGUCCU$_{G}$-5'  (SEQ ID NO: 1358)

βc-2141 Target: 5'-GGGTCCTCTGTGAACTTGCTCAGGACA-3' (SEQ ID NO: 2467)

5'-GGUCCUCUGUGAACUUGCUCAGGAC$^{C}$C-3'  (SEQ ID NO: 5795)
3'-CCAGGAGACACUUGAACGAGUCCUG$_{U}$-5'  (SEQ ID NO: 1359)

βc-2142 Target: 5'-GGTCCTCTGTGAACTTGCTCAGGACAA-3' (SEQ ID NO: 2468)

5'-GUCCUCUGUGAACUUGCUCAGGACA$^{C}$A-3'  (SEQ ID NO: 5796)
3'-CAGGAGACACUUGAACGAGUCCUGU$_{C}$-5'  (SEQ ID NO: 1360)

βc-2143 Target: 5'-GTCCTCTGTGAACTTGCTCAGGACAAG-3' (SEQ ID NO: 2469)

5'-UCCUCUGUGAACUUGCUCAGGACAA$^{A}$A-3'  (SEQ ID NO: 5797)
3'-AGGAGACACUUGAACGAGUCCUGUU$_{C}$-5'  (SEQ ID NO: 1361)

βc-2144 Target: 5'-TCCTCTGTGAACTTGCTCAGGACAAGG-3' (SEQ ID NO: 2470)

TABLE 7-continued

Selected Anti-β-catenin DsiRNA Agents,
Blunt/Frayed Duplexes

5'-CCUCUGUGAACUUGCUCAGGACAAG$^{A}$$^{C-3'}$ (SEQ ID NO: 5798)
3'-GGAGACACUUGAACGAGUCCUGUUC$_{C}$$_{U-5'}$ (SEQ ID NO: 1362)

βc-2145 Target: 5'-CCTCTGTGAACTTGCTCAGGACAAGGA-3' (SEQ ID NO: 2471)

5'-CUCUGUGAACUUGCUCAGGACAAGG$^{C}$$^{C-3'}$ (SEQ ID NO: 5799)
3'-GAGACACUUGAACGAGUCCUGUUCC$_{U}$$_{U-5'}$ (SEQ ID NO: 1363)

βc-2146 Target: 5'-CTCTGTGAACTTGCTCAGGACAAGGAA-3' (SEQ ID NO: 2472)

5'-UCUGUGAACUUGCUCAGGACAAGGA$^{C}$$^{A-3'}$ (SEQ ID NO: 5800)
3'-AGACACUUGAACGAGUCCUGUUCCU$_{U}$$_{C-5'}$ (SEQ ID NO: 1364)

βc-2147 Target: 5'-TCTGTGAACTTGCTCAGGACAAGGAAG-3'(SEQ ID NO: 2473)

5'-CUGUGAACUUGCUCAGGACAAGGAA$^{A}$$^{A-3'}$ (SEQ ID NO: 5801)
3'-GACACUUGAACGAGUCCUGUUCCUU$_{C}$$_{G-5'}$ (SEQ ID NO: 1365)

βc-2148 Target: 5'-CTGTGAACTTGCTCAGGACAAGGAAGC-3' (SEQ ID NO: 2474)

5'-UGUGAACUUGCUCAGGACAAGGAAG$^{A}$$^{C-3'}$ (SEQ ID NO: 5802)
3'-ACACUUGAACGAGUCCUGUUCCUUC$_{G}$$_{A-5'}$ (SEQ ID NO: 1366)

βc-2149 Target: 5'-TGTGAACTTGCTCAGGACAAGGAAGCT-3' (SEQ ID NO: 2475)

5'-GUGAACUUGCUCAGGACAAGGAAGC$^{C}$$^{A-3'}$ (SEQ ID NO: 5803)
3'-CACUUGAACGAGUCCUGUUCCUUCG$_{A}$$_{C-5'}$ (SEQ ID NO: 1367)

βc-2150 Target: 5'-GTGAACTTGCTCAGGACAAGGAAGCTG-3' (SEQ ID NO: 2476)

5'-UGAACUUGCUCAGGACAAGGAAGCU$^{A}$$^{A-3'}$ (SEQ ID NO: 5804)
3'-ACUUGAACGAGUCCUGUUCCUUCGA$_{C}$$_{G-5'}$ (SEQ ID NO: 1368)

βc-2151 Target: 5'-TGAACTTGCTCAGGACAAGGAAGCTGC-3' (SEQ ID NO: 2477)

5'-CUAUUGAAGCUGAGGGAGCCACAGC$^{C}$$^{A-3'}$ (SEQ ID NO: 5805)
3'-GAUAACUUCGACUCCCUCGGUGUCG$_{A}$$_{G-5'}$ (SEQ ID NO: 1369)

βc-2183 Target: 5'-CTATTGAAGCTGAGGGAGCCACAGCTC-3' (SEQ ID NO: 2478)

5'-UAUUGAAGCUGAGGGAGCCACAGCU$^{A}$$^{A-3'}$ (SEQ ID NO: 5806)
3'-AUAACUUCGACUCCCUCGGUGUCGA$_{G}$$_{G-5'}$ (SEQ ID NO: 1370)

βc-2184 Target: 5'-TATTGAAGCTGAGGGAGCCACAGCTCC-3' (SEQ ID NO: 2479)

TABLE 7-continued

Selected Anti-β-catenin DsiRNA Agents,
Blunt/Frayed Duplexes

```
                                    A  C-3'
5'-AUUGAAGCUGAGGGAGCCACAGCUC           (SEQ ID NO: 5807)
3'-UAACUUCGACUCCCUCGGUGUCGAG
                              G
                               A-5'
```

βc-2185 Target: 5'-ATTGAAGCTGAGGGAGCCACAGCTCCT-3' (SEQ ID NO: 2480)

```
                                   C  A-3'
5'-UGUUCCGAAUGUCUGAGGACAAGCC           (SEQ ID NO: 5808)
3'-ACAAGGCUUACAGACUCCUGUUCGG
                              U
                               G-5'
```

βc-2270 Target: 5'-TGTTCCGAATGTCTGAGGACAAGCCAC-3' (SEQ ID NO: 2481)

```
                                   A  C-3'
5'-GUUCCGAAUGUCUGAGGACAAGCCA           (SEQ ID NO: 5809)
3'-CAAGGCUUACAGACUCCUGUUCGGU
                              G
                               U-5'
```

βc-2271 Target: 5'-GTTCCGAATGTCTGAGGACAAGCCACA-3' (SEQ ID NO: 2482)

```
                                    C  C-3'
5'-UUCCGAAUGUCUGAGGACAAGCCAC             (SEQ ID NO: 5810)
3'-AAGGCUUACAGACUCCUGUUCGGUG
                              U
                               U-5'
```

βc-2272 Target: 5'-TTCCGAATGTCTGAGGACAAGCCACAA-3' (SEQ ID NO: 2483)

```
                                    C  A-3'
5'-UCCGAAUGUCUGAGGACAAGCCACA             (SEQ ID NO: 5811)
3'-AGGCUUACAGACUCCUGUUCGGUGU
                              U
                               C-5'
```

βc-2273 Target: 5'-TCCGAATGTCTGAGGACAAGCCACAAG-3' (SEQ ID NO: 2484)

```
                                     A  C-3'
5'-CCGAAUGUCUGAGGACAAGCCACAA             (SEQ ID NO: 5812)
3'-GGCUUACAGACUCCUGUUCGGUGUU
                              C
                               U-5'
```

βc-2274 Target: 5'-CCGAATGTCTGAGGACAAGCCACAAGA-3' (SEQ ID NO: 2485)

```
                                    C  C-3'
5'-CGAAUGUCUGAGGACAAGCCACAAG             (SEQ ID NO: 5813)
3'-GCUUACAGACUCCUGUUCGGUGUUC
                              U
                               A-5'
```

βc-2275 Target: 5'-CGAATGTCTGAGGACAAGCCACAAGAT-3' (SEQ ID NO: 2486)

```
                                     C  C-3'
5'-GAAUGUCUGAGGACAAGCCACAAGA             (SEQ ID NO: 5814)
3'-CUUACAGACUCCUGUUCGGUGUUCU
                              A
                               A-5'
```

βc-2276 Target: 5'-GAATGTCTGAGGACAAGCCACAAGATT-3' (SEQ ID NO: 2487)

```
                                    C  C-3'
5'-AAUGUCUGAGGACAAGCCACAAGAU             (SEQ ID NO: 5815)
3'-UUACAGACUCCUGUUCGGUGUUCUA
                              A
                               U-5'
```

βc-2277 Target: 5'-AATGTCTGAGGACAAGCCACAAGATTA-3' (SEQ ID NO: 2488)

TABLE 7-continued

Selected Anti-β-catenin DsiRNA Agents, Blunt/Frayed Duplexes

5'-GAACAGAGCCAAUGGCUUGGAAUGA$_A$$^{C-3'}$ (SEQ ID NO: 5816)
3'-CUUGUCUCGGUUACCGAACCUUACU$_C$$_{U-5'}$ (SEQ ID NO: 1380)

βc-2345 Target: 5'-GAACAGAGCCAATGGCTTGGAATGAGA-3' (SEQ ID NO: 2489)

5'-AACAGAGCCAAUGGCUUGGAAUGAG$_C$$^{A-3'}$ (SEQ ID NO: 5817)
3'-UUGUCUCGGUUACCGAACCUUACUC$_U$$_{G-5'}$ (SEQ ID NO: 1381)

βc-2346 Target: 5'-AACAGAGCCAATGGCTTGGAATGAGAC-3' (SEQ ID NO: 2490)

5'-ACAGAGCCAAUGGCUUGGAAUGAGA$_A$$^{C-3'}$ (SEQ ID NO: 5818)
3'-UGUCUCGGUUACCGAACCUUACUCU$_G$$_{A-5'}$ (SEQ ID NO: 1382)

βc-2347 Target: 5'-ACAGAGCCAATGGCTTGGAATGAGACT-3' (SEQ ID NO: 2491)

5'-CAGAGCCAAUGGCUUGGAAUGAGAC$_C$$^{A-3'}$ (SEQ ID NO: 5819)
3'-GUCUCGGUUACCGAACCUUACUCUG$_A$$_{C-5'}$ (SEQ ID NO: 1383)

βc-2348 Target: 5'-CAGAGCCAATGGCTTGGAATGAGACTG-3' (SEQ ID NO: 2492)

5'-AGAGCCAAUGGCUUGGAAUGAGACU$_A$$^{A-3'}$ (SEQ ID NO: 5820)
3'-UCUCGGUUACCGAACCUUACUCUGA$_C$$_{G-5'}$ (SEQ ID NO: 1384)

βc-2349 Target: 5'-AGAGCCAATGGCTTGGAATGAGACTGC-3' (SEQ ID NO: 2493)

5'-GAGCCAAUGGCUUGGAAUGAGACUG$_A$$^{C-3'}$ (SEQ ID NO: 5821)
3'-GUCGGUUACCGAACCUUACUCUGAC$_G$$_{A-5'}$ (SEQ ID NO: 1385)

βc-2350 Target: 5'-GAGCCAATGGCTTGGAATGAGACTGCT-3' (SEQ ID NO: 2494)

5'-AGCCAAUGGCUUGGAAUGAGACUGC$_C$$^{A-3'}$ (SEQ ID NO: 5822)
3'-UCGGUUACCGAACCUUACUCUGACG$_A$$_{C-5'}$ (SEQ ID NO: 1386)

βc-2351 Target: 5'-AGCCAATGGCTTGGAATGAGACTGCTG-3' (SEQ ID NO: 2495)

5'-GCCAAUGGCUUGGAAUGAGACUGCU$_A$$^{C-3'}$ (SEQ ID NO: 5823)
3'-CGGUUACCGAACCUUACUCUGACGA$_C$$_{U-5'}$ (SEQ ID NO: 1387)

βc-2352 Target: 5'-GCCAATGGCTTGGAATGAGACTGCTGA-3' (SEQ ID NO: 2496)

5'-CCAAUGGCUUGGAAUGAGACUGCUG$_C$$^{C-3'}$ (SEQ ID NO: 5824)
3'-GGUUACCGAACCUUACUCUGACGAC$_U$$_{A-5'}$ (SEQ ID NO: 1388)

βc-2353 Target: 5'-CCAATGGCTTGGAATGAGACTGCTGAT-3' (SEQ ID NO: 2497)

TABLE 7-continued

Selected Anti-β-catenin DsiRNA Agents,
Blunt/Frayed Duplexes

5'-CAAUGGCUUGGAAUGAGACUGCUGA$_A{}^{A-3'}$ (SEQ ID NO: 5825)
3'-GUUACCGAACCUUACUCUGACGACU$_A{}_{G-5'}$ (SEQ ID NO: 1389)

βc-2354 Target: 5'-CAATGGCTTGGAATGAGACTGCTGATC-3' (SEQ ID NO: 2498)

5'-AAUGGCUUGGAAUGAGACUGCUGAU$_A{}^{C-3'}$ (SEQ ID NO: 5826)
3'-UUACCGAACCUUACUCUGACGACU$_G{}_{A-5'}$ (SEQ ID NO: 1390)

βc-2355 Target: 5'-AATGGCTTGGAATGAGACTGCTGATCT-3' (SEQ ID NO: 2499)

5'-CCCUUGGAUAUCGCCAGGAUGAUCC$_A{}^{C-3'}$ (SEQ ID NO: 5827)
3'-GGGAACCUAUAGCGGUCCUACUAGG$_A{}_{U-5'}$ (SEQ ID NO: 1391)

βc-2411 Target: 5'-CCCTTGGATATCGCCAGGATGATCCTA-3' (SEQ ID NO: 2500)

5'-CCUUGGAUAUCGCCAGGAUGAUCCU$_C{}^{A-3'}$ (SEQ ID NO: 5828)
3'-GGAACCUAUAGCGGUCCUACUAGGA$_U{}_{C-5'}$ (SEQ ID NO: 1392)

βc-2412 Target: 5'-CCTTGGATATCGCCAGGATGATCCTAG-3' (SEQ ID NO: 2501)

5'-CUUGGAUAUCGCCAGGAUGAUCCUA$_A{}^{A-3'}$ (SEQ ID NO: 5829)
3'-GAACCUAUAGCGGUCCUACUAGGAU$_C{}_{G-5'}$ (SEQ ID NO: 1393)

βc-2413 Target: 5'-CTTGGATATCGCCAGGATGATCCTAGC-3' (SEQ ID NO: 2502)

5'-UUGGAUAUCGCCAGGAUGAUCCUAG$_A{}^{C-3'}$ (SEQ ID NO: 5830)
3'-AACCUAUAGCGGUCCUACUAGGAUC$_G{}_{A-5'}$ (SEQ ID NO: 1394)

βc-2414 Target: 5'-TTGGATATCGCCAGGATGATCCTAGCT-3' (SEQ ID NO: 2503)

5'-UGGAUAUCGCCAGGAUGAUCCUAGC$_C{}^{C-3'}$ (SEQ ID NO: 5831)
3'-ACCUAUAGCGGUCCUACUAGGAUCG$_A{}_{U-5'}$ (SEQ ID NO: 1395)

βc-2415 Target: 5'-TGGATATCGCCAGGATGATCCTAGCTA-3' (SEQ ID NO: 2504)

5'-AUCGUUCUUUUCACUCUGGUGGAUA$_C{}^{A-3'}$ (SEQ ID NO: 5832)
3'-UAGCAAGAAAAGUGAGACCACCUAU$_A{}_{C-5'}$ (SEQ ID NO: 1396)

βc-2441 Target: 5'-ATCGTTCTTTTCACTCTGGTGGATATG-3' (SEQ ID NO: 2505)

5'-UCGUUCUUUUCACUCUGGUGGAUAU$_A{}^{A-3'}$ (SEQ ID NO: 5833)
3'-AGCAAGAAAAGUGAGACCACCUAUA$_C{}_{C-5'}$ (SEQ ID NO: 1397)

βc-2442 Target: 5'-TCGTTCTTTTCACTCTGGTGGATATGG-3' (SEQ ID NO: 2506)

TABLE 7-continued

Selected Anti-β-catenin DsiRNA Agents,
Blunt/Frayed Duplexes

```
5'-CGUUCUUUUCACUCUGGUGGAUAUG^(A-3')_A         (SEQ ID NO: 5834)
3'-GCAAGAAAAGUGAGACCACCUAUAC_(G-5')^C         (SEQ ID NO: 1398)
```

βc-2443 Target: 5'-CGTTCTTTTCACTCTGGTGGATATGGC-3' (SEQ ID NO: 2507)

```
5'-GUUCUUUUCACUCUGGUGGAUAUGG^(A-3')_A         (SEQ ID NO: 5835)
3'-CAAGAAAAGUGAGACCACCUAUACC_(G-5')^G         (SEQ ID NO: 1399)
```

βc-2444 Target: 5'-GTTCTTTTCACTCTGGTGGATATGGCC-3' (SEQ ID NO: 2508)

```
5'-UUCUUUUCACUCUGGUGGAUAUGGC^(C-3')_A         (SEQ ID NO: 5836)
3'-AAGAAAAGUGAGACCACCUAUACCG_(U-5')^G         (SEQ ID NO: 1400)
```

βc-2445 Target: 5'-TTCTTTTCACTCTGGTGGATATGGCCA-3' (SEQ ID NO: 2509)

```
5'-AACAUGAGAUGGGUGGCCACCACCC^(C-3')_C         (SEQ ID NO: 5837)
3'-UUGUACUCUACCCACCGGUGGUGGG_(C-5')^A         (SEQ ID NO: 1401)
```

βc-2501 Target: 5'-AACATGAGATGGGTGGCCACCACCCTG-3' (SEQ ID NO: 2510)

```
5'-ACAUGAGAUGGGUGGCCACCACCCU^(A-3')_A         (SEQ ID NO: 5838)
3'-UGUACUCUACCCACCGGUGGUGGGA_(C-5')         (SEQ ID NO: 1402)
```

βc-2502 Target: 5'-ACATGAGATGGGTGGCCACCACCCTGG-3' (SEQ ID NO: 2511)

```
5'-CAUGAGAUGGGUGGCCACCACCCUG^(C-3')_A         (SEQ ID NO: 5839)
3'-GUACUCUACCCACCGGUGGUGGGAC_(A-5')^C         (SEQ ID NO: 1403)
```

βc-2503 Target: 5'-CATGAGATGGGTGGCCACCACCCTGGT-3' (SEQ ID NO: 2512)

```
5'-AUGAGAUGGGUGGCCACCACCCUGG^(A-3')_C         (SEQ ID NO: 5840)
3'-UACUCUACCCACCGGUGGUGGGACC_(C-5')^A         (SEQ ID NO: 1404)
```

βc-2504 Target: 5'-ATGAGATGGGTGGCCACCACCCTGGTG-3' (SEQ ID NO: 2513)

```
5'-UGAGAUGGGUGGCCACCACCCUGGU^(A-3')_A         (SEQ ID NO: 5841)
3'-ACUCUACCCACCGGUGGUGGGACCA_(G-5')^C         (SEQ ID NO: 1405)
```

βc-2505 Target: 5'-TGAGATGGGTGGCCACCACCCTGGTGC-3' (SEQ ID NO: 2514)

```
5'-GAGAUGGGUGGCCACCACCCUGGUG^(C-3')_A         (SEQ ID NO: 5842)
3'-CUCUACCCACCGGUGGUGGGACCAC_(A-5')^G         (SEQ ID NO: 1406)
```

βc-2506 Target: 5'-GAGATGGGTGGCCACCACCCTGGTGCT-3' (SEQ ID NO: 2515)

TABLE 7-continued

Selected Anti-β-catenin DsiRNA Agents,
Blunt/Frayed Duplexes

5'-AGAUGGGUGGCCACCACCCUGGUGC$^{CA-3'}$          (SEQ ID NO: 5843)
3'-UCUACCCACCGGUGGUGGGACCACG$_{AC-5'}$          (SEQ ID NO: 1407)

βc-2507 Target: 5'-AGATGGGTGGCCACCACCCTGGTGCTG-3' (SEQ ID NO: 2516)

5'-GAUGGGUGGCCACCACCCUGGUGCU$^{AC-3'}$          (SEQ ID NO: 5844)
3'-CUACCCACCGGUGGUGGGACCACGA$_{CU-5'}$          (SEQ ID NO: 1408)

βc-2508 Target: 5'-GATGGGTGGCCACCACCCTGGTGCTGA-3' (SEQ ID NO: 2517)

5'-AUGGGUGGCCACCACCCUGGUGCUG$^{CA-3'}$          (SEQ ID NO: 5845)
3'-UACCCACCGGUGGUGGGACCACGAC$_{UG-5'}$          (SEQ ID NO: 1409)

βc-2509 Target: 5'-ATGGGTGGCCACCACCCTGGTGCTGAC-3' (SEQ ID NO: 2518)

5'-UGGGUGGCCACCACCCUGGUGCUGA$^{AC-3'}$          (SEQ ID NO: 5846)
3'-ACCCACCGGUGGUGGGACCACGACU$_{GA-5'}$          (SEQ ID NO: 1410)

βc-2510 Target: 5'-TGGGTGGCCACCACCCTGGTGCTGACT-3' (SEQ ID NO: 2519)

5'-GGGUGGCCACCACCCUGGUGCUGAC$^{CC-3'}$          (SEQ ID NO: 5847)
3'-CCCACCGGUGGUGGGACCACGACUG$_{AU-5'}$          (SEQ ID NO: 1411)

βc-2511 Target: 5'-GGGTGGCCACCACCCTGGTGCTGACTA-3' (SEQ ID NO: 2520)

5'-GGUGGCCACCACCCUGGUGCUGACU$^{CC-3'}$          (SEQ ID NO: 5848)
3'-CCACCGGUGGUGGGACCACGACUGA$_{UA-5'}$          (SEQ ID NO: 1412)

βc-2512 Target: 5'-GGTGGCCACCACCCTGGTGCTGACTAT-3' (SEQ ID NO: 2521)

5'-GUGGCCACCACCCUGGUGCUGACUA$^{CA-3'}$          (SEQ ID NO: 5849)
3'-CACCGGUGGUGGGACCACGACUGAU$_{AG-5'}$          (SEQ ID NO: 1413)

βc-2513 Target: 5'-GTGGCCACCACCCTGGTGCTGACTATC-3' (SEQ ID NO: 2522)

5'-UGGCCACCACCCUGGUGCUGACUAU$^{AA-3'}$          (SEQ ID NO: 5850)
3'-ACCGGUGGUGGGACCACGACUGAUA$_{AG-5'}$          (SEQ ID NO: 1414)

βc-2514 Target: 5'-TGGCCACCACCCTGGTGCTGACTATCC-3' (SEQ ID NO: 2523)

5'-GGCCACCACCCUGGUGCUGACUAUC$^{AC-3'}$          (SEQ ID NO: 5851)
3'-CCGGUGGUGGGACCACGACUGAUAG$_{GU-5'}$          (SEQ ID NO: 1415)

βc-2515 Target: 5'-GGCCACCACCCTGGTGCTGACTATCCA-3' (SEQ ID NO: 2524)

TABLE 7-continued

Selected Anti-β-catenin DsiRNA Agents,
Blunt/Frayed Duplexes

```
5'-GCCACCACCCUGGUGCUGACUAUCC^CA-3'   (SEQ ID NO: 5852)
3'-CGGUGGUGGGACCACGACUGAUAGG_UC-5'   (SEQ ID NO: 1416)
```

βc-2516 Target: 5'-GCCACCACCCTGGTGCTGACTATCCAG-3' (SEQ ID NO: 2525)

```
5'-CCACCACCCUGGUGCUGACUAUCCA^AC-3'   (SEQ ID NO: 5853)
3'-GGUGGUGGGACCACGACUGAUAGGU_CA-5'   (SEQ ID NO: 1417)
```

βc-2517 Target: 5'-CCACCACCCTGGTGCTGACTATCCAGT-3' (SEQ ID NO: 2526)

```
5'-CACCACCCUGGUGCUGACUAUCCAG^CC-3'   (SEQ ID NO: 5854)
3'-GUGGUGGGACCACGACUGAUAGGUC_AA-5'   (SEQ ID NO: 1418)
```

βc-2518 Target: 5'-CACCACCCTGGTGCTGACTATCCAGTT-3' (SEQ ID NO: 2527)

```
5'-ACCACCCUGGUGCUGACUAUCCAGU^CA-3'   (SEQ ID NO: 5855)
3'-UGGUGGGACCACGACUGAUAGGUCA_AC-5'   (SEQ ID NO: 1419)
```

βc-2519 Target: 5'-ACCACCCTGGTGCTGACTATCCAGTTG-3' (SEQ ID NO: 2528)

```
5'-CCACCCUGGUGCUGACUAUCCAGUU^AC-3'   (SEQ ID NO: 5856)
3'-GGUGGGACCACGACUGAUAGGUCAA_CU-5'   (SEQ ID NO: 1420)
```

βc-2520 Target: 5'-CCACCCTGGTGCTGACTATCCAGTTGA-3' (SEQ ID NO: 2529)

```
5'-CACCCUGGUGCUGACUAUCCAGUUG^CC-3'   (SEQ ID NO: 5857)
3'-GUGGGACCACGACUGAUAGGUCAAC_UA-5'   (SEQ ID NO: 1421)
```

βc-2521 Target: 5'-CACCCTGGTGCTGACTATCCAGTTGAT-3' (SEQ ID NO: 2530)

```
5'-ACCCUGGUGCUGACUAACCAGUUGA^CA-3'   (SEQ ID NO: 5858)
3'-UGGGACCACGACUGAUAGGUCAACU_AC-5'   (SEQ ID NO: 1422)
```

βc-2522 Target: 5'-ACCCTGGTGCTGACTATCCAGTTGATG-3' (SEQ ID NO: 2531)

```
5'-CCCUGGUGCUGACUAUCCAGUUGAU^AA-3'   (SEQ ID NO: 5859)
3'-GGGACCACGACUGAUAGGUCAACUA_CC-5'   (SEQ ID NO: 1423)
```

βc-2523 Target: 5'-CCCTGGTGCTGACTATCCAGTTGATGG-3' (SEQ ID NO: 2532)

```
5'-CCUGGUGCUGACUAUCCAGUUGAUG^AA-3'   (SEQ ID NO: 5860)
3'-GGACCACGACUGAUAGGUCAACUAC_CC-5'   (SEQ ID NO: 1424)
```

βc-2524 Target: 5'-CCTGGTGCTGACTATCCAGTTGATGGG-3' (SEQ ID NO: 2533)

TABLE 7-continued

Selected Anti-β-catenin DsiRNA Agents,
Blunt/Frayed Duplexes

```
                        A-3'
                       A
5'-CUGGUGCUGACUAUCCAGUUGAUGG       (SEQ ID NO: 5861)
3'-GACCACGACUGAUAGGUCAACUACC       (SEQ ID NO: 1425)
                            G-5'
```

βc-2525 Target: 5'-CTGGTGCTGACTATCCAGTTGATGGGC-3' (SEQ ID NO: 2534)

```
                        C-3'
                       A
5'-UGGUGCUGACUAUCCAGUUGAUGGG       (SEQ ID NO: 5862)
3'-ACCACGACUGAUAGGUCAACUACCC       (SEQ ID NO: 1426)
                            G
                             A-5'
```

βc-2526 Target: 5'-TGGTGCTGACTATCCAGTTGATGGGCT-3' (SEQ ID NO: 2535)

```
                        C-3'
                       A
5'-GGUGCUGACUAUCCAGUUGAUGGGC       (SEQ ID NO: 5863)
3'-CCACGACUGAUAGGUCAACUACCCG       (SEQ ID NO: 1427)
                            A
                             C-5'
```

βc-2527 Target: 5'-GGTGCTGACTATCCAGTTGATGGGCTG-3' (SEQ ID NO: 2536)

```
                        A-3'
                       A
5'-GUGCUGACUAUCCAGUUGAUGGGCU       (SEQ ID NO: 5864)
3'-CACGACUGAUAGGUCAACUACCCGA       (SEQ ID NO: 1428)
                            C
                             G-5'
```

βc-2528 Target: 5'-GTGCTGACTATCCAGTTGATGGGCTGC-3' (SEQ ID NO: 2537)

```
                        A-3'
                       A
5'-UGCUGACUAUCCAGUUGAUGGGCUG       (SEQ ID NO: 5865)
3'-ACGACUGAUAGGUCAACUACCCGAC       (SEQ ID NO: 1429)
                            G-5'
```

βc-2529 Target: 5'-TGCTGACTATCCAGTTGATGGGCTGCC-3' (SEQ ID NO: 2538)

```
                        C-3'
                       A
5'-GCUGACUAUCCAGUUGAUGGGCUGC       (SEQ ID NO: 5866)
3'-CGACUGAUAGGUCAACUACCCGACG       (SEQ ID NO: 1430)
                            U-5'
```

βc-2530 Target: 5'-GCTGACTATCCAGTTGATGGGCTGCCA-3' (SEQ ID NO: 2539)

```
                        A-3'
                       C
5'-CUGACUAUCCAGUUGAUGGGCUGCC       (SEQ ID NO: 5867)
3'-GACUGAUAGGUCAACUACCCGACGG       (SEQ ID NO: 1431)
                            U
                             C-5'
```

βc-2531 Target: 5'-CTGACTATCCAGTTGATGGGCTGCCAG-3' (SEQ ID NO: 2540)

```
                        C-3'
                       A
5'-UGACUAUCCAGUUGAUGGGCUGCCA       (SEQ ID NO: 5868)
3'-ACUGAUAGGUCAACUACCCGACGGU       (SEQ ID NO: 1432)
                            C
                             U-5'
```

βc-2532 Target: 5'-TGACTATCCAGTTGATGGGCTGCCAGA-3' (SEQ ID NO: 2541)

```
                        C-3'
                       C
5'-GACUAUCCAGUUGAUGGGCUGCCAG       (SEQ ID NO: 5869)
3'-CUGAUAGGUCAACUACCCGACGGUC       (SEQ ID NO: 1433)
                            U
                             A-5'
```

βc-2533 Target: 5'-GACTATCCAGTTGATGGGCTGCCAGAT-3' (SEQ ID NO: 2542)

TABLE 7-continued

Selected Anti-β-catenin DsiRNA Agents,
Blunt/Frayed Duplexes

5'-ACUAUCCAGUUGAUGGGCUGCCAGA$^{CA-3'}$  (SEQ ID NO: 5870)
3'-UGAUAGGUCAACUACCCGACGGUCU$_{AG-5'}$  (SEQ ID NO: 1434)

βc-2534 Target: 5'-ACTATCCAGTTGATGGGCTGCCAGATC-3' (SEQ ID NO: 2543)

5'-CUAUCCAGUUGAUGGGCUGCCAGAU$^{AC-3'}$  (SEQ ID NO: 5871)
3'-GAUAGGUCAACUACCCGACGGUCUA$_{GA-5'}$  (SEQ ID NO: 1435)

βc-2535 Target: 5'-CTATCCAGTTGATGGGCTGCCAGATCT-3' (SEQ ID NO: 2544)

5'-AUGCCCAGGACCUCAUGGAUGGGCU$^{AA-3'}$  (SEQ ID NO: 5872)
3'-UACGGGUCCUGGAGUACCUACCCGA$_{CG-5'}$  (SEQ ID NO: 1436)

βc-2567 Target: 5'-ATGCCCAGGACCTCATGGATGGGCTGC-3' (SEQ ID NO: 2545)

5'-UGCCCAGGACCUCAAGGAUGGGCUG$^{AA-3'}$  (SEQ ID NO: 5873)
3'-ACGGGUCCUGGAGUACCUACCCGAC$_{GG-5'}$  (SEQ ID NO: 1437)

βc-2568 Target: 5'-TGCCCAGGACCTCATGGATGGGCTGCC-3' (SEQ ID NO: 2546)

5'-GCCCAGGACCUCAUGGAUGGGCUGC$^{AC-3'}$  (SEQ ID NO: 5874)
3'-CGGGUCCUGGAGUACCUACCCGACG$_{GA-5'}$  (SEQ ID NO: 1438)

βc-2569 Target: 5'-GCCCAGGACCTCATGGATGGGCTGCCT-3' (SEQ ID NO: 2547)

5'-ACAGCAAUCAGCUGGCCUGGUUUGA$^{CC-3'}$  (SEQ ID NO: 5875)
3'-UGUCGUUAGUCGACCGGACCAAACU$_{AU-5'}$  (SEQ ID NO: 1439)

βc-2603 Target: 5'-ACAGCAATCAGCTGGCCTGGTTTGATA-3' (SEQ ID NO: 2548)

5'-CAGCAAUCAGCUGGCCUGGUUUGAU$^{CA-3'}$  (SEQ ID NO: 5876)
3'-GUCGUUAGUCGACCGGACCAAACUA$_{UG-5'}$  (SEQ ID NO: 1440)

βc-2604 Target: 5'-CAGCAATCAGCTGGCCTGGTTTGATAC-3' (SEQ ID NO: 2549)

5'-AGCAAUCAGCUGGCCUGGUUUGAUA$^{AC-3'}$  (SEQ ID NO: 5877)
3'-UCGUUAGUCGACCGGACCAAACUAU$_{GA-5'}$  (SEQ ID NO: 1441)

βc-2605 Target: 5'-AGCAATCAGCTGGCCTGGTTTGATACT-3' (SEQ ID NO: 2550)

5'-GCAAUCAGCUGGCCUGGUUUGAUAC$^{CA-3'}$  (SEQ ID NO: 5878)
3'-CGUUAGUCGACCGGACCAAACUAUG$_{AC-5'}$  (SEQ ID NO: 1442)

βc-2606 Target: 5'-GCAATCAGCTGGCCTGGTTTGATACTG-3' (SEQ ID NO: 2551)

TABLE 7-continued

Selected Anti-β-catenin DsiRNA Agents,
Blunt/Frayed Duplexes

```
5'-CAAUCAGCUGGCCUGGUUUGAUACU^AC-3'   (SEQ ID NO: 5879)
3'-GUUAGUCGACCGGACCAAACUAUGA_CU-5'   (SEQ ID NO: 1443)
```

βc-2607 Target: 5'-CAATCAGCTGGCCTGGTTTGATACTGA-3' (SEQ ID NO: 2552)

```
5'-AAUCAGCUGGCCUGGUUUGAUACUG^CA-3'   (SEQ ID NO: 5880)
3'-UUAGUCGACCGGACCAAACUAUGAC_UG-5'   (SEQ ID NO: 1444)
```

βc-2608 Target: 5'-AATCAGCTGGCCTGGTTTGATACTGAC-3' (SEQ ID NO: 2553)

```
5'-AUCAGCUGGCCUGGUUUGAUACUGA^AA-3'   (SEQ ID NO: 5881)
3'-UAGUCGACCGGACCAAACUAUGACU_G-5'    (SEQ ID NO: 1445)
```

βc-2609 Target: 5'-ATCAGCTGGCCTGGTTTGATACTGACC-3' (SEQ ID NO: 2554)

```
5'-UCAGCUGGCCUGGUUUGAUACUGAC^AC-3'   (SEQ ID NO: 5882)
3'-AGUCGACCGGACCAAACUAUGACUG_GA-5'   (SEQ ID NO: 1446)
```

βc-2610 Target: 5'-TCAGCTGGCCTGGTTTGATACTGACCT-3' (SEQ ID NO: 2555)

```
5'-CAGCUGGCCUGGUUUGAUACUGACC^CA-3'   (SEQ ID NO: 5883)
3'-GUCGACCGGACCAAACUAUGACUGG_AC-5'   (SEQ ID NO: 1447)
```

βc-2611 Target: 5'-CAGCTGGCCTGGTTTGATACTGACCTG-3' (SEQ ID NO: 2556)

```
5'-AGCUGGCCUGGUUUGAUACUGACCU^AC-3'   (SEQ ID NO: 5884)
3'-UCGACCGGACCAAACUAUGACUGGA_CA-5'   (SEQ ID NO: 1448)
```

βc-2612 Target: 5'-AGCTGGCCTGGTTTGATACTGACCTGT-3' (SEQ ID NO: 2557)

```
5'-GCUGGCCUGGUUUGAUACUGACCUG^CC-3'   (SEQ ID NO: 5885)
3'-CGACCGGACCAAACUAUGACUGGAC_AU-5'   (SEQ ID NO: 1449)
```

βc-2613 Target: 5'-GCTGGCCTGGTTTGATACTGACCTGTA-3' (SEQ ID NO: 2558)

```
5'-CUGGCCUGGUUUGAUACUGACCUGU^CC-3'   (SEQ ID NO: 5886)
3'-GACCGGACCAAACUAUGACUGGACA_U-5'    (SEQ ID NO: 1450)
```

βc-2614 Target: 5'-CTGGCCTGGTTTGATACTGACCTGTAA-3' (SEQ ID NO: 2559)

```
5'-UGGCCUGGUUUGAUACUGACCUGUA^CC-3'   (SEQ ID NO: 5887)
3'-ACCGGACCAAACUAUGACUGGACAU_U-5'    (SEQ ID NO: 1451)
```

βc-2615 Target: 5'-TGGCCTGGTTTGATACTGACCTGTAAA-3' (SEQ ID NO: 2560)

TABLE 7-continued

Selected Anti-β-catenin DsiRNA Agents,
Blunk/Frayed Duplexes

5'-GGCCUGGUUUGAUACUGACCUGUAA$^{C^{C-3'}}$ (SEQ ID NO: 5888)
3'-CCGGACCAAACUAUGACUGGACAUU$_{U_{A-5'}}$ (SEQ ID NO: 1452)

βc-2616 Target: 5'-GGCCTGGTTTGATACTGACCTGTAAAT-3' (SEQ ID NO: 2561)

5'-GCCUGGUUUGAUACUGACCUGUAAA$^{C^{A-3'}}$ (SEQ ID NO: 5889)
3'-CGGACCAAACUAUGACUGGACAUUU$_{A_{G-5'}}$ (SEQ ID NO: 1453)

βc-2617 Target: 5'-GCCTGGTTTGATACTGACCTGTAAATC-3' (SEQ ID NO: 2562)

5'-CCUGGUUUGAUACUGACCUGUAAAU$^{A^{C-3'}}$ (SEQ ID NO: 5890)
3'-GGACCAAACUAUGACUGGACAUUUA$_{G_{U-5'}}$ (SEQ ID NO: 1454)

βc-2618 Target: 5'-CCTGGTTTGATACTGACCTGTAAATCA-3' (SEQ ID NO: 2563)

5'-CUGGUUUGAUACUGACCUGUAAAUC$^{C^{C-3'}}$ (SEQ ID NO: 5891)
3'-GACCAAACUAUGACUGGACAUUUAG$_{U_{A-5'}}$ (SEQ ID NO: 1455)

βc-2619 Target: 5'-CTGGTTTGATACTGACCTGTAAATC-3' (SEQ ID NO: 2564)

5'-UGGUUUGAUACUGACCUGUAAAUCA$^{C^{A-3'}}$ (SEQ ID NO: 5892)
3'-ACCAAACUAUGACUGGACAUUUAGU$_{A_{G-5'}}$ (SEQ ID NO: 1456)

βc-2620 Target: 5'-TGGTTTGATACTGACCTGTAAATCATC-3' (SEQ ID NO: 2565)

5'-GGUUUGAUACUGACCUGUAAAUCAU$^{A^{A-3'}}$ (SEQ ID NO: 5893)
3'-CCAAACUAUGACUGGACAUUUAGUA$_{G_{G-5'}}$ (SEQ ID NO: 1457)

βc-2621 Target: 5'-GGTTTGATACTGACCTGTAAATCATCC-3' (SEQ ID NO: 2566)

5'-GUUUGAUACUGACCUGUAAAUCAUC$^{A^{C-3'}}$ (SEQ ID NO: 5894)
3'-CAAACUAUGACUGGACAUUUAGUAG$_{A_{A-5'}}$ (SEQ ID NO: 1458)

βc-2622 Target: 5'-GTTTGATACTGACCTGTAAATCATCCT-3' (SEQ ID NO: 2567)

5'-UUUGAUACUGACCUGUAAAUCAUCC$^{C^{C-3'}}$ (SEQ ID NO: 5895)
3'-AAACUAUGACUGGACAUUUAGUAGG$_{A_{A-5'}}$ (SEQ ID NO: 1459)

βc-2623 Target: 5'-TTTGATACTGACCTGTAAATCATCCTT-3' (SEQ ID NO: 2568)

5'-UUUUUUGCCACAGCUUUUGCAACUU$^{C^{C-3'}}$ (SEQ ID NO: 5896)
3'-AAAAAACGGUGUCGAAAACGUUGAA$_{U_{U-5'}}$ (SEQ ID NO: 1460)

βc-2869 Target: 5'-TTTTTTGCCACAGCTTTTGCAACTTAA-3' (SEQ ID NO: 2569)

TABLE 7-continued

Selected Anti-β-catenin DsiRNA Agents,
Blunt/Frayed Duplexes

```
                             AC-3'
5'-AAUGAGUAACAUUUGCUGUUUUAAA       (SEQ ID NO: 5897)
3'-UUACUCAUUGUAAACGACAAAAUUU       (SEQ ID NO: 1461)
                             GU-5'
```

βc-2902 Target: 5'-AATGAGTAACATTTGCTGTTTTAAACA-3' (SEQ ID NO: 2570)

```
                            AC-3'
5'-UAAACAUUAAUAGCAGCCUUUCUCU      (SEQ ID NO: 5898)
3'-AUUUGUAAUUAUCGUCGGAAAGAGA      (SEQ ID NO: 1462)
                            GA-5'
```

βc-2923 Target: 5'-TAAACATTAATAGCAGCCTTTCTCTCT-3' (SEQ ID NO: 2571)

```
                             CC-3'
5'-AACAUUAAUAGCAGCCUUUCUCUCU       (SEQ ID NO: 5899)
3'-UUGUAAUUAUCGUCGGAAAGAGAGA       (SEQ ID NO: 1463)
                             AA-5'
```

βc-2925 Target: 5'-AACATTAATAGCAGCCTTTCTCTCTTT-3' (SEQ ID NO: 2572)

```
                            CC-3'
5'-CAUUAAUAGCAGCCUUUCUCUCUUU      (SEQ ID NO: 5900)
3'-GUAAUUAUCGUCGGAAAGAGAGAAA      (SEQ ID NO: 1464)
                            UA-5'
```

βc-2927 Target: 5'-CATTAATAGCAGCCTTTCTCTCTTTAT-3' (SEQ ID NO: 2573)

```
                            CA-3'
5'-UUAAUAGCAGCCUUUCUCUCUUUAU      (SEQ ID NO: 5901)
3'-AAUUAUCGUCGGAAAGAGAGAAAUA      (SEQ ID NO: 1465)
                            UG-5'
```

βc-2929 Target: 5'-TTAATAGCAGCCTTTCTCTCTTTATAC-3' (SEQ ID NO: 2574)

```
                            CA-3'
5'-UUGCAUUGUGAUUGGCCUGUAGAGU      (SEQ ID NO: 5902)
3'-AACGUAACACUAACCGGACAUCUCA      (SEQ ID NO: 1466)
                            AC-5'
```

βc-2973 Target: 5'-TTGCATTGTGATTGGCCTGTAGAGTTG-3' (SEQ ID NO: 2575)

```
                            AC-3'
5'-GCAUUGUGAUUGGCCUGUAGAGUUG      (SEQ ID NO: 5903)
3'-CGUAACACUAACCGGACAUCUCAAC      (SEQ ID NO: 1467)
                            GA-5'
```

βc-2975 Target: 5'-GCATTGTGATTGGCCTGTAGAGTTGCT-3' (SEQ ID NO: 2576)

```
                            AC-3'
5'-AUUGUGAUUGGCCUGUAGAGUUGCU      (SEQ ID NO: 5904)
3'-UAACACUAACCGGACAUCUCAACGA      (SEQ ID NO: 1468)
                            CU-5'
```

βc-2977 Target: 5'-ATTGTGATTGGCCTGTAGAGTTGCTGA-3' (SEQ ID NO: 2577)

```
                            AC-3'
5'-UGUGAUUGGCCUGUAGAGUUGCUGA      (SEQ ID NO: 5905)
3'-ACACUAACCGGACAUCUCAACGACU      (SEQ ID NO: 1469)
                            CU-5'
```

βc-2979 Target: 5'-TGTGATTGGCCTGTAGAGTTGCTGAGA-3' (SEQ ID NO: 2578)

TABLE 7-continued

Selected Anti-β-catenin DsiRNA Agents,
Blunt/Frayed Duplexes

```
                              A-3'
                             A
5'-UGAUUGGCCUGUAGAGUUGCUGAGA        (SEQ ID NO: 5906)
3'-ACUAACCGGACAUCUCAACGACUCU        (SEQ ID NO: 1470)
                             C
                              C-5'
```

βc-2981 Target: 5'-TGATTGGCCTGTAGAGTTGCTGAGAGG-3' (SEQ ID NO: 2579)

```
                             A-3'
                            A
5'-AUUGGCCUGUAGAGUUGCUGAGAGG      (SEQ ID NO: 5907)
3'-UAACCGGACAUCUCAACGACUCUCC      (SEQ ID NO: 1471)
                            C
                             G-5'
```

βc-2983 Target: 5'-ATTGGCCTGTAGAGTTGCTGAGAGGGC-3' (SEQ ID NO: 2580)

```
                            A-3'
                           C
5'-UGGCCUGUAGAGUUGCUGAGAGGGC      (SEQ ID NO: 5908)
3'-ACCGGACAUCUCAACGACUCUCCCG      (SEQ ID NO: 1472)
                           A
                            G-5'
```

βc-2985 Target: 5'-TGGCCTGTAGAGTTGCTGAGAGGGCTC-3' (SEQ ID NO: 2581)

```
                            C-3'
                           A
5'-GCCUGUAGAGUUGCUGAGAGGGCUC      (SEQ ID NO: 5909)
3'-CGGACAUCUCAACGACUCUCCCGAG      (SEQ ID NO: 1473)
                           C
                            U-5'
```

βc-2987 Target: 5'-GCCTGTAGAGTTGCTGAGAGGGCTCGA-3' (SEQ ID NO: 2582)

```
                            A-3'
                           A
5'-CUGUAGAGUUGCUGAGAGGGCUCGA      (SEQ ID NO: 5910)
3'-GACAUCUCAACGACUCUCCCGAGCU      (SEQ ID NO: 1474)
                           C
                            C-5'
```

βc-2989 Target: 5'-CTGTAGAGTTGCTGAGAGGGCTCGAGG-3' (SEQ ID NO: 2583)

```
                            A-3'
                           A
5'-GGGUGGGCUGGUAUCUCAGAAAGUG      (SEQ ID NO: 5911)
3'-CCCACCCGACCAUAGAGUCUUUCAC      (SEQ ID NO: 1475)
                           G
                            G-5'
```

βc-3015 Target: 5'-GGGTGGGCTGGTATCTCAGAAAGTGCC-3' (SEQ ID NO: 2584)

```
                            A-3'
                           C
5'-GUGGGCUGGUAUCUCAGAAAGUGCC      (SEQ ID NO: 5912)
3'-CACCCGACCAUAGAGUCUUUCACGG      (SEQ ID NO: 1476)
                           A
                            C-5'
```

βc-3017 Target: 5'-GTGGGCTGGTATCTCAGAAAGTGCCTG-3' (SEQ ID NO: 2585)

```
                            A-3'
                           C
5'-GGGCUGGUAUCUCAGAAAGUGCCUG      (SEQ ID NO: 5913)
3'-CCCGACCAUAGAGUCUUUCACGGAC      (SEQ ID NO: 1477)
                           U
                            G-5'
```

βc-3019 Target: 5'-GGGCTGGTATCTCAGAAAGTGCCTGAC-3' (SEQ ID NO: 2586)

```
                            A-3'
                           C
5'-GCUGGUAUCUCAGAAAGUGCCUGAC      (SEQ ID NO: 5914)
3'-CGACCAUAGAGUCUUUCACGGACUG      (SEQ ID NO: 1478)
                           U
                            G-5'
```

βc-3021 Target: 5'-GCTGGTATCTCAGAAAGTGCCTGACAC-3' (SEQ ID NO: 2587)

TABLE 7-continued

Selected Anti-β-catenin DsiRNA Agents,
Blunt/Frayed Duplexes

```
5'-ACACUAACCAAGCUGAGUUUCCUAU^CA-3'    (SEQ ID NO: 5915)
3'-UGUGAUUGGUUCGACUCAAAGGAUA_CC-5'    (SEQ ID NO: 1479)
```

βc-3046 Target: 5'-ACACTAACCAAGCTGAGTTTCCTATGG-3' (SEQ ID NO: 2588)

```
5'-ACUAACCAAGCUGAGUUUCCUAUGG^AC-3'    (SEQ ID NO: 5916)
3'-UGAUUGGUUCGACUCAAAGGAUACC_CC-5'    (SEQ ID NO: 1480)
```

βc-3048 Target: 5'-ACTAACCAAGCTGAGTTTCCTATGGGA-3' (SEQ ID NO: 2589)

```
5'-UAACCAAGCUGAGUUUCCUAUGGGA^CA-3'    (SEQ ID NO: 5917)
3'-AUUGGUUCGACUCAAAGGAUACCCU_UG-5'    (SEQ ID NO: 1481)
```

βc-3050 Target: 5'-TAACCAAGCTGAGTTTCCTATGGGAAC-3' (SEQ ID NO: 2590)

```
5'-ACCAAGCUGAGUUUCCUAUGGGAAC^CC-3'    (SEQ ID NO: 5918)
3'-UGGUUCGACUCAAAGGAUACCCUUG_UU-5'    (SEQ ID NO: 1482)
```

βc-3052 Target: 5'-ACCAAGCTGAGTTTCCTATGGGAACAA-3' (SEQ ID NO: 2591)

```
5'-CAAGCUGAGUUUCCUAUGGGAACAA^CC-3'    (SEQ ID NO: 5919)
3'-GUUCGACUCAAAGGAUACCCUUGUU_AA-5'    (SEQ ID NO: 1483)
```

βc-3054 Target: 5'-CAAGCTGAGTTTCCTATGGGAACAATT-3' (SEQ ID NO: 2592)

```
5'-AGCUGAGUUUCCUAUGGGAACAAU^AC-3'     (SEQ ID NO: 5920)
3'-UCGACUCAAAGGAUACCCUUGUUAA_CU-5'    (SEQ ID NO: 1484)
```

βc-3056 Target: 5'-AGCTGAGTTTCCTATGGGAACAATTGA-3' (SEQ ID NO: 2593)

```
5'-AACUUUUGUUCUGGUCCUUUUUGG^CA-3'     (SEQ ID NO: 5921)
3'-UUGAAAACAAGACCAGGAAAAACC_AG-5'     (SEQ ID NO: 1485)
```

βc-3087 Target: 5'-AACTTTTGTTCTGGTCCTTTTTGGTC-3' (SEQ ID NO: 2594)

```
5'-CUUUUUGUUCUGGUCCUUUUUGGUC^AC-3'    (SEQ ID NO: 5922)
3'-GAAAACAAGACCAGGAAAAACCAG_CU-5'     (SEQ ID NO: 1486)
```

βc-3089 Target: 5'-CTTTTTGTTCTGGTCCTTTTTGGTCGA-3' (SEQ ID NO: 2595)

```
5'-UUUUGUUCUGGUCCUUUUUGGUCGA^AA-3'    (SEQ ID NO: 5923)
3'-AAAACAAGACCAGGAAAAACCAGCU_CC-5'    (SEQ ID NO: 1487)
```

βc-3091 Target: 5'-TTTTGTTCTGGTCCTTTTTGGTCGAGG-3' (SEQ ID NO: 2596)

TABLE 7-continued

Selected Anti-β-catenin DsiRNA Agents,
Blunt/Frayed Duplexes

5'-UUGUUCUGGUCCUUUUUGGUCGAGG$^{CA-3'}$     (SEQ ID NO: 5924)
3'-AACAAGACCAGGAAAAACCAGCUCC$_{UC-5'}$     (SEQ ID NO: 1488)

βc-3093 Target: 5'-TTGTTCTGGTCCTTTTTGGTCGAGGAG-3' (SEQ ID NO: 2597)

5'-GUUCUGGUCCUUUUUGGUCGAGGAG$^{CC-3'}$     (SEQ ID NO: 5925)
3'-CAAGACCAGGAAAAACCAGCUCCUC$_{AU-5'}$     (SEQ ID NO: 1489)

βc-3095 Target: 5'-GTTCTGGTCCTTTTTGGTCGAGGAGTA-3' (SEQ ID NO: 2598)

5'-UCUGGUCCUUUUUGGUCGAGGAGUA$^{CA-3'}$     (SEQ ID NO: 5926)
3'-AGACCAGGAAAAACCAGCUCCUCAU$_{UG-5'}$     (SEQ ID NO: 1490)

βc-3097 Target: 5'-TCTGGTCCTTTTTGGTCGAGGAGTAAC-3' (SEQ ID NO: 2599)

5'-UGGUCCUUUUUGGUCGAGGAGUAAC$^{CC-3'}$     (SEQ ID NO: 5927)
3'-ACCAGGAAAAACCAGCUCCUCAUUG$_{UU-5'}$     (SEQ ID NO: 1491)

βc-3099 Target: 5'-TGGTCCTTTTTGGTCGAGGAGTAACAA-3' (SEQ ID NO: 2600)

5'-GUCCUUUUUGGUCGAGGAGUAACAA$^{CC-3'}$     (SEQ ID NO: 5928)
3'-CAGGAAAAACCAGCUCCUCAUUGUU$_{AU-5'}$     (SEQ ID NO: 1492)

βc-3101 Target: 5'-GTCCTTTTTGGTCGAGGAGTAACAATA-3' (SEQ ID NO: 2601)

5'-CCUUUUUGGUCGAGGAGUAACAAUA$^{AC-3'}$     (SEQ ID NO: 5929)
3'-GGAAAAACCAGCUCCUCAUUGUUAU$_{GU-5'}$     (SEQ ID NO: 1493)

βc-3103 Target: 5'-CCTTTTTGGTCGAGGAGTAACAATACA-3' (SEQ ID NO: 2602)

5'-UUUUUGGUCGAGGAGUAACAAUACA$^{CC-3'}$     (SEQ ID NO: 5930)
3'-AAAAACCAGCUCCUCAUUGUUAUGU$_{UU-5'}$     (SEQ ID NO: 1494)

βc-3105 Target: 5'-TTTTTGGTCGAGGAGTAACAATACAAA-3' (SEQ ID NO: 2603)

5'-UUUGGUCGAGGAGUAACAAUACAAA$^{CA-3'}$     (SEQ ID NO: 5931)
3'-AAACCAGCUCCUCAUUGUUAUGUUU$_{AC-5'}$     (SEQ ID NO: 1495)

βc-3107 Target: 5'-TTTGGTCGAGGAGTAACAATACAAATG-3' (SEQ ID NO: 2604)

5'-UGGUCGAGGAGUAACAAUACAAAUG$^{AC-3'}$     (SEQ ID NO: 5932)
3'-ACCAGCUCCUCAUUGUUAUGUUUAC$_{CU-5'}$     (SEQ ID NO: 1496)

βc-3109 Target: 5'-TGGTCGAGGAGTAACAATACAAATGGA-3' (SEQ ID NO: 2605)

TABLE 7-continued

Selected Anti-β-catenin DsiRNA Agents,
Blunt/Frayed Duplexes

5'-GUCGAGGAGUAACAAUACAAAUGGA$^{\text{C}^{\text{C-3'}}}$  (SEQ ID NO: 5933)
3'-CAGCUCCUCAUUGUUAUGUUUACCU$_{\text{A}_{\text{A-5'}}}$  (SEQ ID NO: 1497)

βc-3111 Target: 5'-GTCGAGGAGTAACAATACAAATGGATT-3' (SEQ ID NO: 2606)

5'-CGAGGAGUAACAAUACAAAUGGAUU$^{\text{C}^{\text{C-3'}}}$  (SEQ ID NO: 5934)
3'-GCUCCUCAUUGUUAUGUUUACCUAA$_{\text{A}_{\text{A-5'}}}$  (SEQ ID NO: 1498)

βc-3113 Target: 5'-CGAGGAGTAACAATACAAATGGATTTT-3' (SEQ ID NO: 2607)

5'-AGGAGUAACAAUACAAAUGGAUUUU$^{\text{A}^{\text{A-3'}}}$  (SEQ ID NO: 5935)
3'-UCCUCAUUGUUAUGUUUACCUAAAA$_{\text{C}_{\text{C-5'}}}$  (SEQ ID NO: 1499)

βc-3115 Target: 5'-AGGAGTAACAATACAAATGGATTTTGG-3' (SEQ ID NO: 2608)

5'-UUUAUCAAACCCUAGCCUUGCUUGU$^{\text{C}^{\text{C-3'}}}$  (SEQ ID NO: 5936)
3'-AAAUAGUUUGGGAUCGGAACGAACA$_{\text{A}_{\text{U-5'}}}$  (SEQ ID NO: 1500)

βc-3191 Target: 5'-TTTATCAAACCCTAGCCTTGCTTGTTA-3' (SEQ ID NO: 2609)

5'-UAUCAAACCCUAGCCUUGCUUGUUA$^{\text{C}^{\text{C-3'}}}$  (SEQ ID NO: 5937)
3'-AUAGUUUGGGAUCGGAACGAACAAU$_{\text{U-5'}}$  (SEQ ID NO: 1501)

βc-3193 Target: 5'-TATCAAACCCTAGCCTTGCTTGTTAAA-3' (SEQ ID NO: 2610)

5'-UCAAACCCUAGCCUUGCUUGUUAAA$^{\text{C}^{\text{C-3'}}}$  (SEQ ID NO: 5938)
3'-AGUUUGGGAUCGGAACGAACAAUUU$_{\text{A}_{\text{A-5'}}}$  (SEQ ID NO: 1502)

βc-3195 Target: 5'-TCAAACCCTAGCCTTGCTTGTTAAATT-3' (SEQ ID NO: 2611)

5'-UUGAGUAAUGGUGUAGAACACUAAU$^{\text{C}^{\text{A-3'}}}$  (SEQ ID NO: 5939)
3'-AACUCAUUACCACAUCUUGUGAUUA$_{\text{A}_{\text{G-5'}}}$  (SEQ ID NO: 1503)

βc-3387 Target: 5'-TTGAGTAATGGTGTAGAACACTAATTC-3' (SEQ ID NO: 2612)

5'-GAGUAAUGGUGUAGAACACUAAUUC$^{\text{C}^{\text{C-3'}}}$  (SEQ ID NO: 5940)
3'-CUCAUUACCACAUCUUGUGAUUAAG$_{\text{U}_{\text{A-5'}}}$  (SEQ ID NO: 1504)

βc-3389 Target: 5'-GAGTAATGGTGTAGAACACTAATTC-3' (SEQ ID NO: 2613)

5'-GUAAUGGUGUAGAACACUAAUUCAU$^{\text{C}^{\text{C-3'}}}$  (SEQ ID NO: 5941)
3'-CAUUACCACAUCUUGUGAUUAAGUA$_{\text{U-5'}}$  (SEQ ID NO: 1505)

βc-3391 Target: 5'-GTAATGGTGTAGAACACTAATTCATAA-3' (SEQ ID NO: 2614)

TABLE 7-continued

Selected Anti-β-catenin DsiRNA Agents,
Blunt/Frayed Duplexes

5'-AAUGGUGUAGAACACUAAUUCAUAA$^{C}$$^{A-3'}$  (SEQ ID NO: 5942)
3'-UUACCACAUCUUGUGAUUAAGUAUU$_{A}$$_{G-5'}$  (SEQ ID NO: 1506)

βc-3393 Target: 5'-AATGGTGTAGAACACTAATTCATAATC-3' (SEQ ID NO: 2615)

5'-UGGUGUAGAACACUAAUUCAUAAUC$^{C}$$^{A-3'}$  (SEQ ID NO: 5943)
3'-ACCACAUCUUGUGAUUAAGUAUUAG$_{U}$$_{G-5'}$  (SEQ ID NO: 1507)

βc-3395 Target: 5'-TGGTGTAGAACACTAATTCATAATCAC-3' (SEQ ID NO: 2616)

5'-GUGUAGAACACUAAUUCAUAAUCAC$^{C}$$^{A-3'}$  (SEQ ID NO: 5944)
3'-CACAUCUUGUGAUUAAGUAUUAGUG$_{A}$$_{G-5'}$  (SEQ ID NO: 1508)

βc-3397 Target: 5'-GTGTAGAACACTAATTCATAATCACTC-3' (SEQ ID NO: 2617)

5'-GUAGAACACUAAUUCAUAAUCACUC$^{C}$$^{C-3'}$  (SEQ ID NO: 5945)
3'-CAUCUUGUGAUUAAGUAUUAGUGAG$_{A}$$_{U-5'}$  (SEQ ID NO: 1509)

βc-3399 Target: 5'-GTAGAACACTAATTCATAATCACTCTA-3' (SEQ ID NO: 2618)

5'-AGAACACUAAUUCAUAAUCACUCUA$^{C}$$^{C-3'}$  (SEQ ID NO: 5946)
3'-UCUUGUGAUUAAGUAUUAGUGAGAU$_{U}$$_{A-5'}$  (SEQ ID NO: 1510)

βc-3401 Target: 5'-AGAACACTAATTCATAATCACTCTAAT-3' (SEQ ID NO: 2619)

5'-AAUUAGUUUCCUUUUUAAUAUGCUU$^{C}$$^{C-3'}$  (SEQ ID NO: 5947)
3'-UUAAUCAAAGGAAAAAUUAUACGAA$_{U}$$_{U-5'}$  (SEQ ID NO: 1511)

βc-3500 Target: 5'-AATTAGTTTCCTTTTTAATATGCTTAA-3' (SEQ ID NO: 2620)

5'-UUAGUUUCCUUUUUAAUAUGCUUAA$^{C}$$^{C-3'}$  (SEQ ID NO: 5948)
3'-AAUCAAAGGAAAAAUUAUACGAAUU$_{U}$$_{U-5'}$  (SEQ ID NO: 1512)

βc-3502 Target: 5'-TTAGTTTCCTTTTTAATATGCTTAAAA-3' (SEQ ID NO: 2621)

5'-AGUUUCCUUUUUAAUAUGCUUAAAA$^{C}$$^{C-3'}$  (SEQ ID NO: 5949)
3'-UCAAAGGAAAAAUUAUACGAAUUUU$_{A}$$_{U-5'}$  (SEQ ID NO: 1513)

βc-3504 Target: 5'-AGTTTCCTTTTTAATATGCTTAAAATA-3' (SEQ ID NO: 2622)

5'-UUUCCUUUUUAAUAUGCUUAAAAUA$^{C}$$^{A-3'}$  (SEQ ID NO: 5950)
3'-AAAGGAAAAAUUAUACGAAUUUUAU$_{U}$$_{C-5'}$  (SEQ ID NO: 1514)

βc-3506 Target: 5'-TTTCCTTTTTAATATGCTTAAAATAAG-3' (SEQ ID NO: 2623)

TABLE 7-continued

Selected Anti-β-catenin DsiRNA Agents,
Blunt/Frayed Duplexes

5'-UCCUUUUAAUAUGCUUAAAAUAAG$_A{}^{C-3'}$ (SEQ ID NO: 5951)
3'-AGGAAAAAUUAUACGAAUUUUAUUC$_G{}_{U-5'}$ (SEQ ID NO: 1515)

βc-3508 Target: 5'-TCCTTTTTAATATGCTTAAAATAAGCA-3' (SEQ ID NO: 2624)

5'-CCUUUUUAAUAUGCUUAAAAUAAGC$^{A-3'}$ (SEQ ID NO: 5952)
3'-GGAAAAAUUAUACGAAUUUUAUUCG$_U{}_{C-5'}$ (SEQ ID NO: 1516)

βc-3509 Target: 5'-CCTTTTTAATATGCTTAAAATAAGCAG-3' (SEQ ID NO: 2625)

5'-CUUUUUAAUAUGCUUAAAAUAAGCA$_A{}^{A-3'}$ (SEQ ID NO: 5953)
3'-GAAAAAUUAUACGAAUUUUAUUCGU$_C{}_{C-5'}$ (SEQ ID NO: 1517)

βc-3510 Target: 5'-CTTTTTAATATGCTTAAAATAAGCAGG-3' (SEQ ID NO: 2626)

5'-UUUUAAUAUGCUUAAAAUAAGCAGG$^{CA-3'}$ (SEQ ID NO: 5954)
3'-AAAAUUAUACGAAUUUUAUUCGUCC$_A{}_{C-5'}$ (SEQ ID NO: 1518)

βc-3512 Target: 5'-TTTTAATATGCTTAAAATAAGCAGGTG-3' (SEQ ID NO: 2627)

5'-UUAAUAUGCUUAAAAUAAGCAGGUG$_A{}^{C-3'}$ (SEQ ID NO: 5955)
3'-AAUUAUACGAAUUUUAUUCGUCCAC$_C{}_{U-5'}$ (SEQ ID NO: 1519)

βc-3514 Target: 5'-TTAATATGCTTAAAATAAGCAGGTGGA-3' (SEQ ID NO: 2628)

5'-AAUAUGCUUAAAAUAAGCAGGUGGA$_C{}^{A-3'}$ (SEQ ID NO: 5956)
3'-UUAUACGAAUUUUAUUCGUCCACCU$_A{}_{G-5'}$ (SEQ ID NO: 1520)

βc-3516 Target: 5'-AATATGCTTAAAATAAGCAGGTGGATC-3' (SEQ ID NO: 2629)

5'-UAUGCUUAAAAUAAGCAGGUGGAUC$_C{}^{C-3'}$ (SEQ ID NO: 5957)
3'-AUACGAAUUUUAUUCGUCCACCUAG$_A{}_{U-5'}$ (SEQ ID NO: 1521)

βc-3518 Target: 5'-TATGCTTAAAATAAGCAGGTGGATCTA-3' (SEQ ID NO: 2630)

5'-UGCUUAAAAUAAGCAGGUGGAUCUA$_C{}^{C-3'}$ (SEQ ID NO: 5958)
3'-ACGAAUUUUAUUCGUCCACCUAGAU$_A{}_{A-5'}$ (SEQ ID NO: 1522)

βc-3520 Target: 5'-TGCTTAAAATAAGCAGGTGGATCTATT-3' (SEQ ID NO: 2631)

5'-CUUAAAAUAAGCAGGUGGAUCUAUU$_C{}^{A-3'}$ (SEQ ID NO: 5959)
3'-GAAUUUUAUUCGUCCACCUAGAUAA$_A{}_{G-5'}$ (SEQ ID NO: 1523)

βc-3522 Target: 5'-CTTAAAATAAGCAGGTGGATCTATTTC-3' (SEQ ID NO: 2632)

TABLE 7-continued

Selected Anti-β-catenin DsiRNA Agents,
Blunt/Frayed Duplexes

```
5'-UAAAAUAAGCAGGUGGAUCUAUUUC^(C C-3')     (SEQ ID NO: 5960)
3'-AUUUUAUUCGUCCACCUAGAUAAAG_(U A-5')     (SEQ ID NO: 1524)
```

βc-3524 Target: 5'-TAAAATAAGCAGGTGGATCTATTTC-3' (SEQ ID NO: 2633)

```
5'-AAAUAAGCAGGUGGAUCUAUUUCAU^(A C-3')     (SEQ ID NO: 5961)
3'-UUUAUUCGUCCACCUAGAUAAAGUA_(C A-5')     (SEQ ID NO: 1525)
```

βc-3526 Target: 5'-AAATAAGCAGGTGGATCTATTTCATGT-3' (SEQ ID NO: 2634)

```
5'-AUAAGCAGGUGGAUCUAUUUCAUGU^(C C-3')     (SEQ ID NO: 5962)
3'-UAUUCGUCCACCUAGAUAAAGUACA_(A A-5')     (SEQ ID NO: 1526)
```

βc-3528 Target: 5'-ATAAGCAGGTGGATCTATTTCATGTTT-3' (SEQ ID NO: 2635)

```
5'-AAGCAGGUGGAUCUAUUUCAUGUUU^(C C-3')     (SEQ ID NO: 5963)
3'-UUCGUCCACCUAGAUAAAGUACAAA_(A A-5')     (SEQ ID NO: 1527)
```

βc-3530 Target: 5'-AAGCAGGTGGATCTATTTCATGTTTTT-3' (SEQ ID NO: 2636)

```
5'-GCAGGUGGAUCUAUUUCAUGUUUUU^(A C-3')     (SEQ ID NO: 5964)
3'-CGUCCACCUAGAUAAAGUACAAAAA_(C U-5')     (SEQ ID NO: 1528)
```

βc-3532 Target: 5'-GCAGGTGGATCTATTTCATGTTTTTGA-3' (SEQ ID NO: 2637)

```
5'-AGGUGGAUCUAUUUCAUGUUUUUGA^(C A-3')     (SEQ ID NO: 5965)
3'-UCCACCUAGAUAAAGUACAAAAACU_(A G-5')     (SEQ ID NO: 1529)
```

βc-3534 Target: 5'-AGGTGGATCTATTTCATGTTTTTGATC-3' (SEQ ID NO: 2638)

```
5'-GUGGAUCUAUUUCAUGUUUUUGAUC^(C C-3')     (SEQ ID NO: 5966)
3'-CACCUAGAUAAAGUACAAAAACUAG_(U U-5')     (SEQ ID NO: 1530)
```

βc-3536 Target: 5'-GTGGATCTATTTCATGTTTTTGATCAA-3' (SEQ ID NO: 2639)

```
5'-GGAUCUAUUUCAUGUUUUUGAUCAA^(C C-3')     (SEQ ID NO: 5967)
3'-CCUAGAUAAAGUACAAAAACUAGUU_(U U-5')     (SEQ ID NO: 1531)
```

βc-3538 Target: 5'-GGATCTATTTCATGTTTTTGATCAAAA-3' (SEQ ID NO: 2640)

```
5'-GGGUAGGGUAAAUCAGUAAGAGGUG^(C C-3')     (SEQ ID NO: 5968)
3'-CCCAUCCCAUUUAGUCAUUCUCCAC_(A A-5')     (SEQ ID NO: 1532)
```

βc-3583 Target: 5'-GGGTAGGGTAAATCAGTAAGAGGTGTT-3' (SEQ ID NO: 2641)

TABLE 7-continued

Selected Anti-β-catenin DsiRNA Agents,
Blunt/Frayed Duplexes

5'-GUAGGGUAAAUCAGUAAGAGGUGUU$^{CC-3'}$   (SEQ ID NO: 5969)
3'-CAUCCCAUUUAGUCAUUCUCCACAA$_{UA-5'}$   (SEQ ID NO: 1533)

βc-3585 Target: 5'-GTAGGGTAAATCAGTAAGAGGTGTTAT-3' (SEQ ID NO: 2642)

5'-AGGGUAAAUCAGUAAGAGGUGUUAU$^{CC-3'}$   (SEQ ID NO: 5970)
3'-UCCCAUUUAGUCAUUCUCCACAAUA$_{A-5'}$   (SEQ ID NO: 1534)

βc-3587 Target: 5'-AGGGTAAATCAGTAAGAGGTGTTATTT-3' (SEQ ID NO: 2643)

5'-GGUAAAUCAGUAAGAGGUGUUAUUU$^{AA-3'}$   (SEQ ID NO: 5971)
3'-CCAUUUAGUCAUUCUCCACAAUAAA$_{CC-5'}$   (SEQ ID NO: 1535)

βc-3589 Target: 5'-GGTAAATCAGTAAGAGGTGTTATTTGG-3' (SEQ ID NO: 2644)

5'-UAAAUCAGUAAGAGGUGUUAUUUGG$^{CC-3'}$   (SEQ ID NO: 5972)
3'-AUUUAGUCAUUCUCCACAAUAAACC$_{U U-5'}$   (SEQ ID NO: 1536)

βc-3591 Target: 5'-TAAATCAGTAAGAGGTGTTATTTGGAA-3' (SEQ ID NO: 2645)

5'-AAUCAGUAAGAGGUGUUAUUUGGAA$^{AA-3'}$   (SEQ ID NO: 5973)
3'-UUAGUCAUUCUCCACAAUAAACCUU$_{G-5'}$   (SEQ ID NO: 1537)

βc-3593 Target: 5'-AATCAGTAAGAGGTGTTATTTGGAACC-3' (SEQ ID NO: 2646)

5'-UUUACCAGUUGCCUUUUAUCCCAAA$^{AC-3'}$   (SEQ ID NO: 5974)
3'-AAAUGGUCAACGGAAAAUAGGGUUU$_{CA-5'}$   (SEQ ID NO: 1538)

βc-3633 Target: 5'-TTTACCAGTTGCCTTTTATCCCAAAGT-3' (SEQ ID NO: 2647)

5'-UACCAGUUGCCUUUUAUCCCAAAGU$^{CA-3'}$   (SEQ ID NO: 5975)
3'-AUGGUCAACGGAAAAUAGGGUUUCA$_{AC-5'}$   (SEQ ID NO: 1539)

βc-3635 Target: 5'-TACCAGTTGCCTTTTATCCCAAAGTTG-3' (SEQ ID NO: 2648)

5'-CCAGUUGCCUUUUAUCCCAAAGUUG$^{CC-3'}$   (SEQ ID NO: 5976)
3'-GGUCAACGGAAAAUAGGGUUUCAAC$_{AA-5'}$   (SEQ ID NO: 1540)

βc-3637 Target: 5'-CCAGTTGCCTTTTATCCCAAAGTTGTT-3' (SEQ ID NO: 2649)

5'-AGUUGCCUUUUAUCCCAAAGUUGUU$^{AC-3'}$   (SEQ ID NO: 5977)
3'-UCAACGGAAAAUAGGGUUUCAACAA$_{CA-5'}$   (SEQ ID NO: 1541)

βc-3639 Target: 5'-AGTTGCCTTTTATCCCAAAGTTGTTGT-3' (SEQ ID NO: 2650)

TABLE 7-continued

Selected Anti-β-catenin DsiRNA Agents,
Blunt/Frayed Duplexes

5'-UUGCCUUUUAUCCCAAAGUUGUUGU$^{C}_{C}$C-3' (SEQ ID NO: 5978)
3'-AACGGAAAAUAGGGUUUCAACAACA$_{U}$U-5' (SEQ ID NO: 1542)

βc-3641 Target: 5'-TTGCCTTTTATCCCAAAGTTGTTGTAA-3' (SEQ ID NO: 2651)

5'-GCCUUUUAUCCCAAAGUUGUUGUAA$^{A}$A-3' (SEQ ID NO: 5979)
3'-CGGAAAAUAGGGUUUCAACAACAUU$_{G}$G-5' (SEQ ID NO: 1543)

βc-3643 Target: 5'-GCCTTTTATCCCAAAGTTGTTGTAACC-3' (SEQ ID NO: 2652)

5'-CUUUUAUCCCAAAGUUGUUGUAACC$^{C}$A-3' (SEQ ID NO: 5980)
3'-GAAAAUAGGGUUUCAACAACAUUGG$_{A}$C-5' (SEQ ID NO: 1544)

βc-3645 Target: 5'-CTTTTATCCCAAAGTTGTTGTAACCTG-3' (SEQ ID NO: 2653)

5'-UUUAUCCCAAAGUUGUUGUAACCUG$^{A}$C-3' (SEQ ID NO: 5981)
3'-AAAUAGGGUUUCAACAACAUUGGAC$_{G}$A-5' (SEQ ID NO: 1545)

βc-3647 Target: 5'-TTTATCCCAAAGTTGTTGTAACCTGCT-3' (SEQ ID NO: 2654)

5'-UAUCCCAAAGUUGUUGUAACCUGCU$^{A}$C-3' (SEQ ID NO: 5982)
3'-AUAGGGUUUCAACAACAUUGGACGA$_{C}$A-5' (SEQ ID NO: 1546)

βc-3649 Target: 5'-TATCCCAAAGTTGTTGTAACCTGCTGT-3' (SEQ ID NO: 2655)

5'-UCCCAAAGUUGUUGUAACCUGCUCU$^{A}$C-3' (SEQ ID NO: 5983)
3'-AGGGUUUCAACAACAUUGGACGACA$_{C}$U-5' (SEQ ID NO: 1547)

βc-3651 Target: 5'-TCCCAAAGTTGTTGTAACCTGCTGTGA-3' (SEQ ID NO: 2656)

5'-CCAAAGUUGUUGUAACCUGCUGUGA$^{C}_{C}$C-3' (SEQ ID NO: 5984)
3'-GGUUUCAACAACAUUGGACGACACU$_{A}$U-5' (SEQ ID NO: 1548)

βc-3653 Target: 5'-CCAAAGTTGTTGTAACCTGCTGTGATA-3' (SEQ ID NO: 2657)

5'-AAAGUUGUUGUAACCUGCUGUGAUA$^{A}$A-3' (SEQ ID NO: 5985)
3'-UUUCAACAACAUUGGACGACACUAU$_{G}$C-5' (SEQ ID NO: 1549)

βc-3655 Target: 5'-AAAGTTGTTGTAACCTGCTGTGATACG-3' (SEQ ID NO: 2658)

5'-AGUUGUUGUAACCUGCUGUGAUACG$^{C}_{C}$C-3' (SEQ ID NO: 5986)
3'-UCAACAACAUUGGACGACACUAUGC$_{U}$A-5' (SEQ ID NO: 1550)

βc-3657 Target: 5'-AGTTGTTGTAACCTGCTGTGATACGAT-3' (SEQ ID NO: 2659)

TABLE 7-continued

Selected Anti-β-catenin DsiRNA Agents,
Blunt/Frayed Duplexes

5'-UUGUUGUAACCUGCUGUGAUACGAU$^{AA\text{-}3'}$ (SEQ ID NO: 5987)
3'-AACAACAUUGGACGACACUAUGCUA$_{G\text{-}5'}$ (SEQ ID NO: 1551)

βc-3659 Target: 5'-TTGTTGTAACCTGCTGTGATACGATGC-3' (SEQ ID NO: 2660)

5'-AAAAAUGGUUCAGAAUUAAACUUUU$^{CC\text{-}3'}$ (SEQ ID NO: 5988)
3'-UUUUUACCAAGUCUUAAUUUGAAAA$_{U\text{-}5'}$ (SEQ ID NO: 1552)

βc-3708 Target: 5'-AAAAATGGTTCAGAATTAAACTTTTAA-3' (SEQ ID NO: 2661)

5'-AAAUGGUUCAGAAUUAAACUUUUAA$^{CC\text{-}3'}$ (SEQ ID NO: 5989)
3'-UUUACCAAGUCUUAAUUUGAAAAUU$_{A\text{-}5'}$ (SEQ ID NO: 1553)

βc-3710 Target: 5'-AAATGGTTCAGAATTAAACTTTTAATT-3' (SEQ ID NO: 2662)

5'-AUGGUUCAGAAUUAAACUUUUAAUU$^{AC\text{-}3'}$ (SEQ ID NO: 5990)
3'-UACCAAGUCUUAAUUUGAAAAUUAA$_{U\text{-}5'}$ (SEQ ID NO: 1554)

βc-3712 Target: 5'-ATGGTTCAGAATTAAACTTTTAATTCA-3' (SEQ ID NO: 2663)

5'-GGUUCAGAAUUAAACUUUUAAUUCA$^{CC\text{-}3'}$ (SEQ ID NO: 5991)
3'-CCAAGUCUUAAUUUGAAAAUUAAGU$_{A\text{-}5'}$ (SEQ ID NO: 1555)

βc-3714 Target: 5'-GGTTCAGAATTAAACTTTTAATTCATT-3' (SEQ ID NO: 2664)

5'-UUCAGAAUUAAACUUUUAAUUCAUU$^{AA\text{-}3'}$ (SEQ ID NO: 5992)
3'-AAGUCUUAAUUUGAAAAUUAAGUAA$_{C\text{-}5'}$ (SEQ ID NO: 1556)

βc-3716 Target: 5'-TTCAGAATTAAACTTTTAATTCATTCG-3' (SEQ ID NO: 2665)

5'-CAGCAGCAGUCUUACUUGGAUUCUG$^{AC\text{-}3'}$ (SEQ ID NO: 5993)
3'-GUCGUCGUCAGAAUGAACCUAAGAC$_{U\text{-}5'}$ (SEQ ID NO: 1557)

βc-m314 Target: 5'-CAGCAGCAGTCTTACTTGGATTCTGGA-3' (SEQ ID NO: 2666)

5'-UUACUUGGAUUCUGGAAUCCAUUCU$^{AA\text{-}3'}$ (SEQ ID NO: 5994)
3'-AAUGAACCUAAGACCUUAGGUAAGA$_{C\text{-}5'}$ (SEQ ID NO: 1558)

βc-m325 Target: 5'-TTACTTGGATTCTGGAATCCATTCTGG-3' (SEQ ID NO: 2667)

5'-UUGACACCUCCCAAGUCCUUUAUGA$^{CC\text{-}3'}$ (SEQ ID NO: 5995)
3'-AACUGUGGAGGGUUCAGGAAAUACU$_{A\text{-}5'}$ (SEQ ID NO: 1559)

βc-m408 Target: 5'-TTGACACCTCCCAAGTCCTTTATGAAT-3' (SEQ ID NO: 2668)

TABLE 7-continued

Selected Anti-β-catenin DsiRNA Agents,
Blunt/Frayed Duplexes

5'-CACGCAAGAGCAAGUAGCUGAUAUU$_\text{U}^\text{A}$$^\text{C-3'}$ (SEQ ID NO: 5996)
3'-GUGCGUUCUCGUUCAUCGACUAUAA$_\text{C}$$_\text{U-5'}$ (SEQ ID NO: 1560)

βc-m460 Target: 5'-CACGCAAGAGCAAGTAGCTGATATTGA-3' (SEQ ID NO: 2669)

5'-UGCCAUGUUCCCUGAGACGCUAGAU$_\text{U}^\text{A}$$^\text{C-3'}$ (SEQ ID NO: 5997)
3'-ACGGUACAAGGGACUCUGCGAUCUA$_\text{C}$$_\text{U-5'}$ (SEQ ID NO: 1561)

βc-m526 Target: 5'-TGCCATGTTCCCTGAGACGCTAGATGA-3' (SEQ ID NO: 2670)

5'-GUUGAAACAUGCAGUUGUCAAUUUG$^\text{C}$$^\text{C-3'}$ (SEQ ID NO: 5998)
3'-CAACUUUGUACGUCAACAGUUAAAC$_\text{U}$$_\text{A-5'}$ (SEQ ID NO: 1562)

βc-m631 Target: 5'-GTTGAAACATGCAGTTGTCAATTTGAT-3' (SEQ ID NO: 2671)

5'-AACAUGCAGUUGUCAAUUUGAUUAA$_\text{A}$$^\text{C-3'}$ (SEQ ID NO: 5999)
3'-UUGUACGUCAACAGUUAAACUAAUU$_\text{G}$$_\text{A-5'}$ (SEQ ID NO: 1563)

βc-m636 Target: 5'-AACATGCAGTTGTCAATTTGATTAACT-3' (SEQ ID NO: 2672)

5'-CAGUUGUCAAUUUGAUUAACUAUCA$_\text{A}$$^\text{A-3'}$ (SEQ ID NO: 6000)
3'-GUCAACAGUUAAACUAAUUGAUAGU$_\text{C}$$_\text{C-5'}$ (SEQ ID NO: 1564)

βc-m642 Target: 5'-CAGTTGTCAATTTGATTAACTATCAGG-3' (SEQ ID NO: 2673)

5'-AUGAGGACCAGGUGGUAGUUAAUAA$_\text{C}$$^\text{A-3'}$ (SEQ ID NO: 6001)
3'-UACUCCUGGUCCACCAUCAAUUAUU$_\text{U}$$_\text{C-5'}$ (SEQ ID NO: 1565)

βc-m723 Target: 5'-ATGAGGACCAGGTGGTAGTTAATAAAG-3' (SEQ ID NO: 2674)

5'-UGGGUCACCAGUGGAUUCUGUACUG$^\text{C}$$^\text{C-3'}$ (SEQ ID NO: 6002)
3'-ACCCAGUGGUCACCUAAGACAUGAC$_\text{A}$$_\text{A-5'}$ (SEQ ID NO: 1566)

βc-m970 Target: 5'-TGGGTCACCAGTGGATTCTGTACTGTT-3' (SEQ ID NO: 2675)

5'-ACCAGUGGAUUCUGUACUGUUCUAC$_\text{A}$$^\text{A-3'}$ (SEQ ID NO: 6003)
3'-UGGUCACCUAAGACAUGACAAGAUG$_\text{C}$$_\text{G-5'}$ (SEQ ID NO: 1567)

βc-m976 Target: 5'-ACCAGTGGATTCTGTACTGTTCTACGC-3' (SEQ ID NO: 2676)

5'-UGGAUUCUGUACUGUUCUACGCCAU$_\text{U}^\text{A}$$^\text{C-3'}$ (SEQ ID NO: 6004)
3'-ACCUAAGACAUGACAAGAUGCGGUA$_\text{G}$$_\text{U-5'}$ (SEQ ID NO: 1568)

βc-m981 Target: 5'-TGGATTCTGTACTGTTCTACGCCATCA-3' (SEQ ID NO: 2677)

TABLE 7-continued

Selected Anti-β-catenin DsiRNA Agents,
Blunk/Frayed Duplexes

5'-UGGUGGACUGCAGAAAAUGGUUGCU$_C{}^{C-3'}$ (SEQ ID NO: 6005)
3'-ACCACCUGACGUCUUUUACCAACGA$_A{}_{A-5'}$ (SEQ ID NO: 1569)

βc-m1066 Target: 5'-TGGTGGACTGCAGAAAATGGTTGCTTT-3' (SEQ ID NO: 2678)

5'-AACGUGAAAUUCUUGGCUAUUACAA$_A{}^{C-3'}$ (SEQ ID NO: 6006)
3'-UUGCACUUUAAGAACCGAUAAUGUU$_G{}_{U-5'}$ (SEQ ID NO: 1570)

βc-m1106 Target: 5'-AACGTGAAATTCTTGGCTATTACAACA-3' (SEQ ID NO: 2679)

5'-CCCAAGUCAGCGACUUGUUCAAAAC$_C{}^{A-3'}$ (SEQ ID NO: 6007)
3'-GGGUUCAGUCGCUGAACAAGUUUUG$_A{}_{C-5'}$ (SEQ ID NO: 1571)

βc-m1354 Target: 5'-CCCAAGTCAGCGACTTGTTCAAAACTG-3' (SEQ ID NO: 2680)

5'-GCGACUUGUUCAAAACUGUCUUUGG$_C{}^{A-3'}$ (SEQ ID NO: 6008)
3'-CGCUGAACAAGUUUUGACAGAAACC$_U{}_{G-5'}$ (SEQ ID NO: 1572)

βc-m1363 Target: 5'-GCGACTTGTTCAAAACTGTCTTTGGAC-3' (SEQ ID NO: 2681)

5'-CAAAACUGUCUUUGGACUCUCAGAA$_C{}^{A-3'}$ (SEQ ID NO: 6009)
3'-GUUUUGACAGAAACCUGAGAGUCUU$_U{}_{G-5'}$ (SEQ ID NO: 1573)

βc-m1373 Target: 5'-CAAAACTGTCTTTGGACTCTCAGAAAC-3' (SEQ ID NO: 2682)

5'-CUCUCUAACCUCACUUGCAAUAAUU$_C{}^{A-3'}$ (SEQ ID NO: 6010)
3'-GAGAGAUUGGAGUGAACGUUAUUAA$_U{}_{G-5'}$ (SEQ ID NO: 1574)

βc-m1508 Target: 5'-CTCTCTAACCTCACTTGCAATAATTAC-3' (SEQ ID NO: 2683)

5'-ACCUCACUUGCAAUAAUUACAAAAA$_A{}^{C-3'}$ (SEQ ID NO: 6011)
3'-UGGAGUHAACGUUAUUAAUGUUUUU$_G{}_{U-5'}$ (SEQ ID NO: 1575)

βc-m1515 Target: 5'-ACCTCACTTGCAATAATTACAAAAACA-3' (SEQ ID NO: 2684)

5'-CAGAAUGCCGUUCGCCUUCAUUAUG$_A{}^{C-3'}$ (SEQ ID NO: 6012)
3'-GUCUUACGGCAAGCGGAAGUAAUAC$_C{}_{U-5'}$ (SEQ ID NO: 1576)

βc-m1682 Target: 5'-CAGAATGCCGTTCGCCTTCATTATGGA-3' (SEQ ID NO: 2685)

5'-UCGCCUUCAUUAUGGACUGCCUGUU$_A{}^{C-3'}$ (SEQ ID NO: 6013)
3'-AGCGGAAGUAAUACCUGACGGACAA$_C{}_{A-5'}$ (SEQ ID NO: 1577)

βc-m1693 Target: 5'-TCGCCTTCATTATGGACTGCCTGTTGT-3' (SEQ ID NO: 2686)

TABLE 7-continued

Selected Anti-β-catenin DsiRNA Agents,
Blunt/Frayed Duplexes

5'-UUCAUUAUGGACUGCCUGUUGUGGU$^{C}$$^{C-3'}$    (SEQ ID NO: 6014)
3'-AAGUAAUACCUGACGGACAACACCA$_{A}$            (SEQ ID NO: 1578)
                              $_{U-5'}$

βc-m1698 Target: 5'-TTCATTATGGACTGCCTGTTGTGGTTA-3' (SEQ ID NO: 2687)

5'-UGGACUGCCUGUUGUGGUUAAACUC$^{A}$$^{C-3'}$    (SEQ ID NO: 6015)
3'-ACCUGACGGACAACACCAAUUUGAG$_{G}$            (SEQ ID NO: 1579)
                              $_{A-5'}$

βc-m1705 Target: 5'-TGGACTGCCTGTTGTGGTTAAACTCCT-3' (SEQ ID NO: 2688)

5'-GCAACUGUUGGAUUGAUUCGAAACC$^{C}$$^{C-3'}$    (SEQ ID NO: 6016)
3'-CGUUGACAACCUAACUAAGCUUUGG$_{A}$            (SEQ ID NO: 1580)
                              $_{A-5'}$

βc-m1763 Target: 5'-GCAACTGTTGGATTGATTCGAAACCTT-3' (SEQ ID NO: 2689)

5'-CCGAGGACUCAAUACCAUUCCAUUG$^{C}$$^{C-3'}$    (SEQ ID NO: 6017)
3'-GGCUCCUGAGUUAUGGUAAGGUAAC$_{A}$            (SEQ ID NO: 1581)
                              $_{A-5'}$

βc-m2008 Target: 5'-CCGAGGACTCAATACCATTCCATTGTT-3' (SEQ ID NO: 2690)

5'-CUGAGGACAAGCCACAGGAUUACAA$^{A}$$^{C-3'}$    (SEQ ID NO: 6018)
3'-GACUCCUGUUCGGUGUCCUAAUGUU$_{C}$            (SEQ ID NO: 1582)
                              $_{U-5'}$

βc-m2226 Target: 5'-CTGAGGACAAGCCACAGGATTACAAGA-3' (SEQ ID NO: 2691)

5'-GGAUGGACCCUAUGAUGGAGCAUGA$^{A}$$^{C-3'}$    (SEQ ID NO: 6019)
3'-CCUACCUGGGAUACUACCUCGUACU$_{C}$            (SEQ ID NO: 1583)
                              $_{U-5'}$

βc-m2427 Target: 5'-GGATGGACCCTATGATGGAGCATGAGA-3' (SEQ ID NO: 2692)

5'-UUGAUACUGACCUGUAAAUCGUCCU$^{C}$$^{C-3'}$    (SEQ ID NO: 6020)
3'-AACUAUGACUGGACAUUUAGCAGGA$_{A}$            (SEQ ID NO: 1584)
                              $_{A-5'}$

βc-m2568 Target: 5'-TTGATACTGACCTGTAAATCGTCCTTT-3' (SEQ ID NO: 2693)

5'-AGCCAGUGUGGGUGAAUACUUUACU$^{A}$$^{C-3'}$    (SEQ ID NO: 6021)
3'-UCGGUCACACCCACUUAUGAAAUGA$_{G}$            (SEQ ID NO: 1585)
                              $_{A-5'}$

βc-m2614 Target: 5'-AGCCAGTGTGGGTGAATACTTTACTCT-3' (SEQ ID NO: 2694)

5'-UGCCACAGCUUUUGCAGCGUUAUAC$^{C}$$^{A-3'}$    (SEQ ID NO: 6022)
3'-ACGGUGUCGAAAACGUCGCAAUAUG$_{A}$            (SEQ ID NO: 1586)
                              $_{G-5'}$

βc-m2770 Target: 5'-TGCCACAGCTTTTGCAGCGTTATACTC-3' (SEQ ID NO: 2695)

TABLE 7-continued

Selected Anti-β-catenin DsiRNA Agents,
Blunt/Frayed Duplexes

```
5'-GCUUUUGCAGCGUUAUACUCAGAUG(CA)-3'    (SEQ ID NO: 6023)
3'-CGAAAACGUCGCAAUAUGAGUCUAC(UC)-5'    (SEQ ID NO: 1587)
```

βc-m2777 Target: 5'-GCTTTTGCAGCGTTATACTCAGATGAG-3' (SEQ ID NO: 2696)

```
5'-CAGCGUUAUACUCAGAUGAGUAACA(CC)-3'    (SEQ ID NO: 6024)
3'-GUCGCAAUAUGAGUCUACUCAUUGU(AA)-5'    (SEQ ID NO: 1588)
```

βc-m2784 Target: 5'-CAGCGTTATACTCAGATGAGTAACATT-3' (SEQ ID NO: 2697)

```
5'-ACAUUUGCUGUUUUCAACAUUAAUA(AA)-3'    (SEQ ID NO: 6025)
3'-UGUAAACGACAAAAGUUGUAAUUAU(CG)-5'    (SEQ ID NO: 1589)
```

βc-m2806 Target: 5'-ACATTTGCTGTTTTCAACATTAATAGC-3' (SEQ ID NO: 2698)

```
5'-AGCUGUAGUGUCUGAACGUGCAUUG(CA)-3'    (SEQ ID NO: 6026)
3'-UCGACAUCACAGACUUGCACGUAAC(AC)-5'    (SEQ ID NO: 1590)
```

βc-m2850 Target: 5'-AGCTGTAGTGTCTGAACGTGCATTGTG-3' (SEQ ID NO: 2699)

```
5'-GGGAACAGUCGAAGUACGCUUUUUG(CC)-3'    (SEQ ID NO: 6027)
3'-CCCUUGUCAGCUUCAUGCGAAAAAC(AA)-5'    (SEQ ID NO: 1591)
```

βc-m2965 Target: 5'-GGGAACAGTCGAAGTACGCTTTTTGTT-3' (SEQ ID NO: 2700)

```
5'-CAGUCGAAGUACGCUUUUUGUUCUG(AC)-3'    (SEQ ID NO: 6028)
3'-GUCAGCUUCAUGCGAAAAACAAGAC(CA)-5'    (SEQ ID NO: 1592)
```

βc-m2970 Target: 5'-CAGTCGAAGTACGCTTTTTGTTCTGGT-3' (SEQ ID NO: 2701)

```
5'-AAGUACGCUUUUUGUUCUGGUCCUU(CC)-3'    (SEQ ID NO: 6029)
3'-UUCAUGCGAAAAACAAGACCAGGAA(AA)-5'    (SEQ ID NO: 1593)
```

βc-m2976 Target: 5'-AAGTACGCTTTTTGTTCTGGTCCTTTT-3' (SEQ ID NO: 2702)

```
5'-ACCCUAGCCUUGCUUGUUCUUUGUU(CC)-3'    (SEQ ID NO: 6030)
3'-UGGGAUCGGAACGAACAAGAAACAA(AA)-5'    (SEQ ID NO: 1594)
```

βc-m3092 Target: 5'-ACCCTAGCCTTGCTTGTTCTTTGTTTT-3' (SEQ ID NO: 2703)

```
5'-AGCCUUGCUUGUUCUUUGUUUUAAU(CC)-3'    (SEQ ID NO: 6031)
3'-ACGGAACGAACAAGAAACAAAAUUA(UA)-5'    (SEQ ID NO: 1595)
```

βc-m3097 Target: 5'-AGCCTTGCTTGTTCTTTGTTTTAATAT-3' (SEQ ID NO: 2704)

TABLE 7-continued

Selected Anti-β-catenin DsiRNA Agents,
Blunt/Frayed Duplexes

5'-UGAACCUGCUACAGCAAUUUCUGAU$^{CC-3'}$     (SEQ ID NO: 6032)
3'-ACUUGGACGAUGUCGUUAAAGACUA$_{A-5'}^{A}$  (SEQ ID NO: 1596)

βc-m3198 Target: 5'-TGAACCTGCTACAGCAATTTCTGATTT-3' (SEQ ID NO: 2705)

5'-UACAGCAAUUUCUGAUUUCUAAGAA$^{AA-3'}$     (SEQ ID NO: 6033)
3'-AUGUCGUUAAAGACUAAAGAUUCUU$_{G-5'}^{G}$  (SEQ ID NO: 1597)

βc-m3207 Target: 5'-TACAGCAATTTCTGATTTCTAAGAACC-3' (SEQ ID NO: 2706)

5'-CAGUAAGAGGUGUUAUUUGAGCCUU$^{AC-3'}$     (SEQ ID NO: 6034)
3'-GUCAUUCUCCACAAUAAACUCGGAA$_{A-5'}^{C}$  (SEQ ID NO: 1598)

βc-m3433 Target: 5'-CAGTAAGAGGTGTTATTTGAGCCTTGT-3' (SEQ ID NO: 2707)

5'-GAGGUGUUAUUUGAGCCUUGUUUUG$^{AC-3'}$     (SEQ ID NO: 6035)
3'-CUCCACAAUAAACUCGGAACAAAAC$_{U-5'}^{C}$  (SEQ ID NO: 1599)

βc-m3439 Target: 5'-GAGGTGTTATTTGAGCCTTGTTTTGGA-3' (SEQ ID NO: 2708)

5'-GUUAUUUGAGCCUUGUUUUGGACAG$^{CC-3'}$     (SEQ ID NO: 6036)
3'-CAAUAAACUCGGAACAAAACCUGUC$_{U-5'}^{A}$  (SEQ ID NO: 1600)

βc-m3444 Target: 5'-GTTATTTGAGCCTTGTTTTGGACAGTA-3' (SEQ ID NO: 2709)

5'-UUGAGCCUUGUUUUGGACAGUAUAC$^{AC-3'}$     (SEQ ID NO: 6037)
3'-AACUCGGAACAAAACCUGUCAUAUG$_{U-5'}^{G}$  (SEQ ID NO: 1601)

βc-m3449 Target: 5'-TTGAGCCTTGTTTTGGACAGTATACCA-3' (SEQ ID NO: 2710)

5'-UUCAACAGAUGCGGUUAUAGAAAUG$^{AC-3'}$     (SEQ ID NO: 6038)
3'-AAGUUGUCUACGCCAAUAUCUUUAC$_{A-5'}^{C}$  (SEQ ID NO: 1602)

βc-m3522 Target: 5'-TTCAACAGATGCGGTTATAGAAATGGT-3' (SEQ ID NO: 2711)

5'-CGGUUAUAGAAAUGGUUCAGAAUUA$^{CC-3'}$     (SEQ ID NO: 6039)
3'-GCCAAUAUCUUUACCAAGUCUUAAU$_{U-5'}^{U}$  (SEQ ID NO: 1603)

βc-m3533 Target: 5'-CGGTTATAGAAATGGTTCAGAATTAAA-3' (SEQ ID NO: 2712)

5'-AUAGAAAUGGUUCAGAAUUAAACUU$^{CC-3'}$     (SEQ ID NO: 6040)
3'-UAUCUUUACCAAGUCUUAAUUUGAA$_{A-5'}^{A}$  (SEQ ID NO: 1604)

βc-m3538 Target: 5'-ATAGAAATGGTTCAGAATTAAACTTTT-3' (SEQ ID NO: 2713)

TABLE 8

Selected Anti-β-catenin DsiRNA Agents, Blunt Duplexes

|  |  |  |
|---|---|---|
|  | 5'-CCCUGAGGGUAUUUGAAGUAUACCAUA-3' | (SEQ ID NO: 6662) |
|  | 3'-GGGACUCCCAUAAACUUCAUAUGGUAU-5' | (SEQ ID NO: 1117) |
| βc-240 Target: | 5'-CCCTGAGGGTATTTGAAGTATACCATA-3' | (SEQ ID NO: 2226) |
|  | 5'-GAGGGUAUUUGAAGUAUACCAUACAAC-3' | (SEQ ID NO: 6663) |
|  | 3'-CUCCCAUAAACUUCAUAUGGUAUGUUG-5' | (SEQ ID NO: 1118) |
| βc-244 Target: | 5'-GAGGGTATTTGAAGTATACCATACAAC-3' | (SEQ ID NO: 2227) |
|  | 5'-UGAAGUAUACCAUACAACUGUUUUGAA-3' | (SEQ ID NO: 6664) |
|  | 3'-ACUUCAUAUGGUAUGUUGACAAAACUU-5' | (SEQ ID NO: 1119) |
| βc-253 Target: | 5'-TGAAGTATACCATACAACTGTTTTGAA-3' | (SEQ ID NO: 2228) |
|  | 5'-AUACCAUACAACUGUUUUGAAAAUCCA-3' | (SEQ ID NO: 6665) |
|  | 3'-UAUGGUAUGUUGACAAAACUUUUAGGU-5' | (SEQ ID NO: 1120) |
| βc-259 Target: | 5'-ATACCATACAACTGTTTTGAAAATCCA-3' | (SEQ ID NO: 2229) |
|  | 5'-AUACAACUGUUUUGAAAAUCCAGCGUG-3' | (SEQ ID NO: 6666) |
|  | 3'-UAUGUUGACAAAACUUUUAGGUCGCAC-5' | (SEQ ID NO: 1121) |
| βc-264 Target: | 5'-ATACAACTGTTTTGAAAATCCAGCGTG-3' | (SEQ ID NO: 2230) |
|  | 5'-CAGGGAUUUUCUCAGUCCUUCACUCAA-3' | (SEQ ID NO: 6667) |
|  | 3'-GUCCCUAAAAGAGUCAGGAAGUGAGUU-5' | (SEQ ID NO: 1122) |
| βc-496 Target: | 5'-CAGGGATTTTCTCAGTCCTTCACTCAA-3' | (SEQ ID NO: 2231) |
|  | 5'-CACUCAAGAACAAGUAGCUGAUAUUGA-3' | (SEQ ID NO: 6668) |
|  | 3'-GUGAGUUCUUGUUCAUCGACUAUAACU-5' | (SEQ ID NO: 1123) |
| βc-516 Target: | 5'-CACTCAAGAACAAGTAGCTGATATTGA-3' | (SEQ ID NO: 2232) |
|  | 5'-AGAACAAGUAGCUGAUAUUGAUGGACA-3' | (SEQ ID NO: 6669) |
|  | 3'-UCUUGUUCAUCGACUAUAACUACCUGU-5' | (SEQ ID NO: 1124) |
| βc-522 Target: | 5'-AGAACAAGTAGCTGATATTGATGGACA-3' | (SEQ ID NO: 2233) |
|  | 5'-AACAAGUAGCUGAUAUUGAUGGACAGU-3' | (SEQ ID NO: 6670) |
|  | 3'-UUGUUCAUCGACUAUAACUACCUGUCA-5' | (SEQ ID NO: 1125) |
| βc-524 Target: | 5'-AACAAGTAGCTGATATTGATGGACAGT-3' | (SEQ ID NO: 2234) |
|  | 5'-UGAUGGACAGUAUGCAAUGACUCGAGC-3' | (SEQ ID NO: 6671) |
|  | 3'-ACUACCUGUCAUACGUUACUGAGCUCG-5' | (SEQ ID NO: 1126) |
| βc-540 Target: | 5'-TGATGGACAGTATGCAATGACTCGAGC-3' | (SEQ ID NO: 2235) |
|  | 5'-UGCUAUGUUCCCUGAGACAUUAGAUGA-3' | (SEQ ID NO: 6672) |
|  | 3'-ACGAUACAAGGGACUCUGUAAUCUACU-5' | (SEQ ID NO: 1127) |
| βc-582 Target: | 5'-TGCTATGTTCCCTGAGACATTAGATGA-3' | (SEQ ID NO: 2236) |
|  | 5'-UGCUGAAACAUGCAGUUGUAAACUUGA-3' | (SEQ ID NO: 6673) |
|  | 3'-ACGACUUUGUACGUCAACAUUUGAACU-5' | (SEQ ID NO: 1128) |
| βc-686 Target: | 5'-TGCTGAAACATGCAGTTGTAAACTTGA-3' | (SEQ ID NO: 2237) |
|  | 5'-AACAUGCAGUUGUAAACUUGAUUAACU-3' | (SEQ ID NO: 6674) |
|  | 3'-UUGUACGUCAACAUUUGAACUAAUUGA-5' | (SEQ ID NO: 1129) |
| βc-692 Target: | 5'-AACATGCAGTTGTAAACTTGATTAACT-3' | (SEQ ID NO: 2238) |

TABLE 8-continued

Selected Anti-β-catenin DsiRNA Agents, Blunt Duplexes

|  |  |  |  |
|---|---|---|---|
|  | 5'-GCAGUUGUAAACUUGAUUAACUAUCAA-3' | (SEQ ID NO: 6675) |  |
|  | 3'-CGUCAACAUUUGAACUAAUUGAUAGUU-5' | (SEQ ID NO: 1130) |  |
| βc-697 Target: | 5'-GCAGTTGTAAACTTGATTAACTATCAA-3' | (SEQ ID NO: 2239) |  |
|  | 5'-ACUUGAUUAACUAUCAAGAUGAUGCAG-3' | (SEQ ID NO: 6676) |  |
|  | 3'-UGAACUAAUUGAUAGUUCUACUACGUC-5' | (SEQ ID NO: 1131) |  |
| βc-707 Target: | 5'-ACTTGATTAACTATCAAGATGATGCAG-3' | (SEQ ID NO: 2240) |  |
|  | 5'-CCCUGAACUGACAAAACUGCUAAAUGA-3' | (SEQ ID NO: 6677) |  |
|  | 3'-GGGACUUGACUGUUUUGACGAUUUACU-5' | (SEQ ID NO: 1132) |  |
| βc-753 Target: | 5'-CCCTGAACTGACAAAACTGCTAAATGA-3' | (SEQ ID NO: 2241) |  |
|  | 5'-UCAGAUGGUGUCUGCUAUUGUACGUAC-3' | (SEQ ID NO: 6678) |  |
|  | 3'-AGUCUACCACAGACGAUAACAUGCAUG-5' | (SEQ ID NO: 1133) |  |
| βc-870 Target: | 5'-TCAGATGGTGTCTGCTATTGTACGTAC-3' | (SEQ ID NO: 2242) |  |
|  | 5'-GUACGUACCAUGCAGAAUACAAAUGAU-3' | (SEQ ID NO: 6679) |  |
|  | 3'-CAUGCAUGGUACGUCUUAUGUUUACUA-5' | (SEQ ID NO: 1134) |  |
| βc-889 Target: | 5'-GTACGTACCATGCAGAATACAAATGAT-3' | (SEQ ID NO: 2243) |  |
|  | 5'-AUUACAACUCUCCACAACCUUUUAUUA-3' | (SEQ ID NO: 6680) |  |
|  | 3'-UAAUGUUGAGAGGUGUUGGAAAAUAAU-5' | (SEQ ID NO: 1135) |  |
| βc-1060 Target: | 5'-ATTACAACTCTCCACAACCTTTTATTA-3' | (SEQ ID NO: 2244) |  |
|  | 5'-AACUCUCCACAACCUUUUAUUACAUCA-3' | (SEQ ID NO: 6681) |  |
|  | 3'-UUGAGAGGUGUUGGAAAAUAAUGUAGU-5' | (SEQ ID NO: 1136) |  |
| βc-1065 Target: | 5'-AACTCTCCACAACCTTTTATTACATCA-3' | (SEQ ID NO: 2245) |  |
|  | 5'-UCCACAACCUUUUAUUACAUCAAGAAG-3' | (SEQ ID NO: 6682) |  |
|  | 3'-AGGUGUUGGAAAAUAAUGUAGUUCUUC-5' | (SEQ ID NO: 1137) |  |
| βc-1070 Target: | 5'-TCCACAACCTTTTATTACATCAAGAAG-3' | (SEQ ID NO: 2246) |  |
|  | 5'-ACCUUUUAUUACAUCAAGAAGGAGCUA-3' | (SEQ ID NO: 6683) |  |
|  | 3'-UGGAAAAUAAUGUAGUUCUUCCUCGAU-5' | (SEQ ID NO: 1138) |  |
| βc-1076 Target: | 5'-ACCTTTTATTACATCAAGAAGGAGCTA-3' | (SEQ ID NO: 2247) |  |
|  | 5'-ACAAAACAAAUGUUAAAUUCUUGGCUA-3' | (SEQ ID NO: 6684) |  |
|  | 3'-UGUUUUGUUUACAAUUUAAGAACCGAU-5' | (SEQ ID NO: 1139) |  |
| βc-1154 Target: | 5'-ACAAAACAAATGTTAAATTCTTGGCTA-3' | (SEQ ID NO: 2248) |  |
|  | 5'-AUUACGACAGACUGCCUUCAAAUUUUA-3' | (SEQ ID NO: 6685) |  |
|  | 3'-UAAUGCUGUCUGACGGAAGUUUAAAAU-5' | (SEQ ID NO: 1140) |  |
| βc-1180 Target: | 5'-ATTACGACAGACTGCCTTCAAATTTTA-3' | (SEQ ID NO: 2249) |  |
|  | 5'-GACAGACUGCCUUCAAAUUUUAGCUUA-3' | (SEQ ID NO: 6686) |  |
|  | 3'-CUGUCUGACGGAAGUUUAAAAUCGAAU-5' | (SEQ ID NO: 1141) |  |
| βc-1185 Target: | 5'-GACAGACTGCCTTCAAATTTTAGCTTA-3' | (SEQ ID NO: 2250) |  |
|  | 5'-AGCUUUAGUAAAUAUAAUGAGGACCUA-3' | (SEQ ID NO: 6687) |  |
|  | 3'-UCGAAAUCAUUUAUAUUACUCCUGGAU-5' | (SEQ ID NO: 1142) |  |
| βc-1260 Target: | 5'-AGCTTTAGTAAATATAATGAGGACCTA-3' | (SEQ ID NO: 2251) |  |

TABLE 8-continued

Selected Anti-β-catenin DsiRNA Agents, Blunt Duplexes

|  |  |  |
|---|---|---|
|  | 5'-GAAAAACUACUGUGGACCACAAGCAGA-3' | (SEQ ID NO: 6688) |
|  | 3'-CUUUUUGAUGACACCUGGUGUUCGUCU-5' | (SEQ ID NO: 1143) |
| βc-1294 Target: | 5'-GAAAAACTACTGTGGACCACAAGCAGA-3' | (SEQ ID NO: 2252) |
|  | 5'-CAAGUCAACGUCUUGUUCAGAACUGUC-3' | (SEQ ID NO: 6689) |
|  | 3'-GUUCAGUUGCAGAACAAGUCUUGACAG-5' | (SEQ ID NO: 1144) |
| βc-1412 Target: | 5'-CAAGTCAACGTCTTGTTCAGAACTGTC-3' | (SEQ ID NO: 2253) |
|  | 5'-AACGUCUUGUUCAGAACUGUCUUUGGA-3' | (SEQ ID NO: 6690) |
|  | 3'-UUGCAGAACAAGUCUUGACAGAAACCU-5' | (SEQ ID NO: 1145) |
| βc-1418 Target: | 5'-AACGTCTTGTTCAGAACTGTCTTTGGA-3' | (SEQ ID NO: 2254) |
|  | 5'-CUUGUUCAGAACUGUCUUUGGACUCUC-3' | (SEQ ID NO: 6691) |
|  | 3'-GAACAAGUCUUGACAGAAACCUGAGAG-5' | (SEQ ID NO: 1146) |
| βc-1423 Target: | 5'-CTTGTTCAGAACTGTCTTTGGACTCTC-3' | (SEQ ID NO: 2255) |
|  | 5'-UGGGUUCAGAUGAUAUAAAUGUGGUCA-3' | (SEQ ID NO: 6692) |
|  | 3'-ACCCAAGUCUACUAUAUUUACACCAGU-5' | (SEQ ID NO: 1147) |
| βc-1520 Target: | 5'-TGGGTTCAGATGATATAAATGTGGTCA-3' | (SEQ ID NO: 2256) |
|  | 5'-AUUCUUUCUAACCUCACUUGCAAUAAU-3' | (SEQ ID NO: 6693) |
|  | 3'-UAAGAAAGAUUGGAGUGAACGUUAUUA-5' | (SEQ ID NO: 1148) |
| βc-1561 Target: | 5'-ATTCTTTCTAACCTCACTTGCAATAAT-3' | (SEQ ID NO: 2257) |
|  | 5'-ACCUCACUUGCAAUAAUUAUAAGAACA-3' | (SEQ ID NO: 6694) |
|  | 3'-UGGAGUGAACGUUAUUAAUAUUCUUGU-5' | (SEQ ID NO: 1149) |
| βc-1571 Target: | 5'-ACCTCACTTGCAATAATTATAAGAACA-3' | (SEQ ID NO: 2258) |
|  | 5'-UGCAAUAAUUAUAAGAACAAGAUGAUG-3' | (SEQ ID NO: 6695) |
|  | 3'-ACGUUAUUAAUAUUCUUGUUCUACUAC-5' | (SEQ ID NO: 1150) |
| βc-1579 Target: | 5'-TGCAATAATTATAAGAACAAGATGATG-3' | (SEQ ID NO: 2259) |
|  | 5'-UGGUAUAGAGGCUCUUGUGCGUACUGU-3' | (SEQ ID NO: 6696) |
|  | 3'-ACCAUAUCUCCGAGAACACGCAUGACA-5' | (SEQ ID NO: 1151) |
| βc-1620 Target: | 5'-TGGTATAGAGGCTCTTGTGCGTACTGT-3' | (SEQ ID NO: 2260) |
|  | 5'-AAGGCUACUGUUGGAUUGAUUCGAAAU-3' | (SEQ ID NO: 6697) |
|  | 3'-UUCCGAUGACAACCUAACUAAGCUUUA-5' | (SEQ ID NO: 1152) |
| βc-1816 Target: | 5'-AAGGCTACTGTTGGATTGATTCGAAAT-3' | (SEQ ID NO: 2261) |
|  | 5'-CGCAUGGAAGAAAUAGUUGAAGGUUGU-3' | (SEQ ID NO: 6698) |
|  | 3'-GCGUACCUUCUUUAUCAACUUCCAACA-5' | (SEQ ID NO: 1153) |
| βc-1987 Target: | 5'-CGCATGGAAGAAATAGTTGAAGGTTGT-3' | (SEQ ID NO: 2262) |
|  | 5'-CAUGGAAGAAAUAGUUGAAGGUUGUAC-3' | (SEQ ID NO: 6699) |
|  | 3'-GUACCUUCUUUAUCAACUUCCAACAUG-5' | (SEQ ID NO: 1154) |
| βc-1989 Target: | 5'-CATGGAAGAAATAGTTGAAGGTTGTAC-3' | (SEQ ID NO: 2263) |
|  | 5'-CCAUUGAAAACAUCCAAAGAGUAGCUG-3' | (SEQ ID NO: 6700) |
|  | 3'-GGUAACUUUUGUAGGUUUCUCAUCGAC-5' | (SEQ ID NO: 1155) |
| βc-2111 Target: | 5'-CCATTGAAAACATCCAAAGAGTAGCTG-3' | (SEQ ID NO: 2264) |

TABLE 8-continued

Selected Anti-β-catenin DsiRNA Agents, Blunt Duplexes

|  |  |  |  |
|---|---|---|---|
|  | 5'-CUGAGGACAAGCCACAAGAUUACAAGA-3' | (SEQ ID NO: 6701) |
|  | 3'-GACUCCUGUUCGGUGUUCUAAUGUUCU-5' | (SEQ ID NO: 1156) |
| βc-2282 Target: | 5'-CTGAGGACAAGCCACAAGATTACAAGA-3' | (SEQ ID NO: 2265) |
|  | 5'-UUGAUACUGACCUGUAAAUCAUCCUUU-3' | (SEQ ID NO: 6702) |
|  | 3'-AACUAUGACUGGACAUUUAGUAGGAAA-5' | (SEQ ID NO: 1157) |
| βc-2624 Target: | 5'-TTGATACTGACCTGTAAATCATCCTTT-3' | (SEQ ID NO: 2266) |
|  | 5'-CUUUAGGUAAGAAGUUUUAAAAAGCCA-3' | (SEQ ID NO: 6703) |
|  | 3'-GAAAUCCAUUCUUCAAAAUUUUUCGGU-5' | (SEQ ID NO: 1158) |
| βc-2647 Target: | 5'-CTTTAGGTAAGAAGTTTTAAAAAGCCA-3' | (SEQ ID NO: 2267) |
|  | 5'-AACAGGUAUAUACUUUGAAAGGAGAUG-3' | (SEQ ID NO: 6704) |
|  | 3'-UUGUCCAUAUAUGAAACUUUCCUCUAC-5' | (SEQ ID NO: 1159) |
| βc-2770 Target: | 5'-AACAGGTATATACTTTGAAAGGAGATG-3' | (SEQ ID NO: 2268) |
|  | 5'-UGGAAGUUAUUAACUUUAAUGUUUUUU-3' | (SEQ ID NO: 6705) |
|  | 3'-ACCUUCAAUAAUUGAAAUUACAAAAAA-5' | (SEQ ID NO: 1160) |
| βc-2848 Target: | 5'-TGGAAGTTATTAACTTTAATGTTTTTT-3' | (SEQ ID NO: 2269) |
|  | 5'-UGCCACAGCUUUUGCAACUUAAUACUC-3' | (SEQ ID NO: 6706) |
|  | 3'-ACGGUGUCGAAAACGUUGAAUUAUGAG-5' | (SEQ ID NO: 1161) |
| βc-2874 Target: | 5'-TGCCACAGCTTTTGCAACTTAATACTC-3' | (SEQ ID NO: 2270) |
|  | 5'-AACAUUUGCUGUUUUAAACAUUAAUAG-3' | (SEQ ID NO: 6707) |
|  | 3'-UUGUAAACGACAAAAUUUGUAAUUAUC-5' | (SEQ ID NO: 1162) |
| βc-2909 Target: | 5'-AACATTTGCTGTTTTAAACATTAATAG-3' | (SEQ ID NO: 2271) |
|  | 5'-AACAAUUGAAGUAAACUUUUUGUUCUG-3' | (SEQ ID NO: 6708) |
|  | 3'-UUGUUAACUUCAUUUGAAAAACAAGAC-5' | (SEQ ID NO: 1163) |
| βc-3074 Target: | 5'-AACAATTGAAGTAAACTTTTGTTCTG-3' | (SEQ ID NO: 2272) |
|  | 5'-AAACCCUAGCCUUGCUUGUAAAUUUU-3' | (SEQ ID NO: 6709) |
|  | 3'-UUUGGGAUCGGAACGAACAAUUUAAAA-5' | (SEQ ID NO: 1164) |
| βc-3197 Target: | 5'-AAACCCTAGCCTTGCTTGTTAAATTTT-3' | (SEQ ID NO: 2273) |
|  | 5'-UAGCCUUGCUUGUUAAAUUUUUUUUU-3' | (SEQ ID NO: 6710) |
|  | 3'-AUCGGAACGAACAAUUUAAAAAAAAAA-5' | (SEQ ID NO: 1165) |
| βc-3203 Target: | 5'-TAGCCTTGCTTGTTAAATTTTTTTTT-3' | (SEQ ID NO: 2274) |
|  | 5'-UUGAAGUAGCUCUUUUUUUUUUUUUU-3' | (SEQ ID NO: 6711) |
|  | 3'-AACUUCAUCGAGAAAAAAAAAAAAAAA-5' | (SEQ ID NO: 1166) |
| βc-3273 Target: | 5'-TTGAAGTAGCTCTTTTTTTTTTTTTT-3' | (SEQ ID NO: 2275) |
|  | 5'-UCGUAGUGUUAAGUUAUAGUGAAUACU-3' | (SEQ ID NO: 6712) |
|  | 3'-AGCAUCACAAUUCAAUAUCACUUAUGA-5' | (SEQ ID NO: 1167) |
| βc-3333 Target: | 5'-TCGTAGTGTTAAGTTATAGTGAATACT-3' | (SEQ ID NO: 2276) |
|  | 5'-UAGUGAAUACUGCUACAGCAAUUUCUA-3' | (SEQ ID NO: 6713) |
|  | 3'-AUCACUUAUGACGAUGUCGUUAAAGAU-5' | (SEQ ID NO: 1168) |
| βc-3349 Target: | 5'-TAGTGAATACTGCTACAGCAATTTCTA-3' | (SEQ ID NO: 2277) |

TABLE 8-continued

Selected Anti-β-catenin DsiRNA Agents, Blunt Duplexes

|  |  |  |  |
|---|---|---|---|
|  | 5'-AAUACUGCUACAGCAAUUUCUAAUUUU-3' | (SEQ ID NO: 6714) |  |
|  | 3'-UUAUGACGAUGUCGUUAAAGAUUAAAA-5' | (SEQ ID NO: 1169) |  |
| βc-3354 Target: | 5'-AATACTGCTACAGCAATTTCTAATTTT-3' | (SEQ ID NO: 2278) |  |
|  | 5'-UUCUAAUUUUUAAGAAUUGAGUAAUGG-3' | (SEQ ID NO: 6715) |  |
|  | 3'-AAGAUUAAAAAUUCUUAACUCAUUACC-5' | (SEQ ID NO: 1170) |  |
| βc-3371 Target: | 5'-TTCTAATTTTTAAGAATTGAGTAATGG-3' | (SEQ ID NO: 2279) |  |
|  | 5'-AUUUUUAAGAAUUGAGUAAUGGUGUAG-3' | (SEQ ID NO: 6716) |  |
|  | 3'-UAAAAAUUCUUAACUCAUUACCACAUC-5' | (SEQ ID NO: 1171) |  |
| βc-3376 Target: | 5'-ATTTTTAAGAATTGAGTAATGGTGTAG-3' | (SEQ ID NO: 2280) |  |
|  | 5'-UUCAUAAUCACUCUAAUUAAUUGUAAU-3' | (SEQ ID NO: 6717) |  |
|  | 3'-AAGUAUUAGUGAGAUUAAUUAACAUUA-5' | (SEQ ID NO: 1172) |  |
| βc-3411 Target: | 5'-TTCATAATCACTCTAATTAATTGTAAT-3' | (SEQ ID NO: 2281) |  |
|  | 5'-AUUAAUUGUAAUCUGAAUAAAGUGUAA-3' | (SEQ ID NO: 6718) |  |
|  | 3'-UAAUUAACAUUAGACUUAUUUCACAUU-5' | (SEQ ID NO: 1173) |  |
| βc-3426 Target: | 5'-ATTAATTGTAATCTGAATAAAGTGTAA-3' | (SEQ ID NO: 2282) |  |
|  | 5'-UUGUAAUCUGAAUAAAGUGUAACAAUU-3' | (SEQ ID NO: 6719) |  |
|  | 3'-AACAUUAGACUUAUUUCACAUUGUUAA-5' | (SEQ ID NO: 1174) |  |
| βc-3431 Target: | 5'-TTGTAATCTGAATAAAGTGTAACAATT-3' | (SEQ ID NO: 2283) |  |
|  | 5'-UCUGAAUAAAGUGUAACAAUUGUGUAG-3' | (SEQ ID NO: 6720) |  |
|  | 3'-AGACUUAUUUCACAUUGUUAACACAUC-5' | (SEQ ID NO: 1175) |  |
| βc-3437 Target: | 5'-TCTGAATAAAGTGTAACAATTGTGTAG-3' | (SEQ ID NO: 2284) |  |
|  | 5'-GUGUAGCCUUUUUGUAUAAAAUAGACA-3' | (SEQ ID NO: 6721) |  |
|  | 3'-CACAUCGGAAAAACAUAUUUUAUCUGU-5' | (SEQ ID NO: 1176) |  |
| βc-3458 Target: | 5'-GTGTAGCCTTTTTGTATAAAATAGACA-3' | (SEQ ID NO: 2285) |  |
|  | 5'-UUUGUAUAAAAUAGACAAAUAGAAAAU-3' | (SEQ ID NO: 6722) |  |
|  | 3'-AAACAUAUUUUAUCUGUUUAUCUUUUA-5' | (SEQ ID NO: 1177) |  |
| βc-3468 Target: | 5'-TTTGTATAAAATAGACAAATAGAAAAT-3' | (SEQ ID NO: 2286) |  |
|  | 5'-AGAAAAUGGUCCAAUUAGUUUCCUUUU-3' | (SEQ ID NO: 6723) |  |
|  | 3'-UCUUUUACCAGGUUAAUCAAAGGAAAA-5' | (SEQ ID NO: 1178) |  |
| βc-3488 Target: | 5'-AGAAAATGGTCCAATTAGTTTCCTTTT-3' | (SEQ ID NO: 2287) |  |
|  | 5'-GUCCAAUUAGUUUCCUUUUUAAUAUGC-3' | (SEQ ID NO: 6724) |  |
|  | 3'-CAGGUUAAUCAAAGGAAAAAUUAUACG-5' | (SEQ ID NO: 1179) |  |
| βc-3496 Target: | 5'-GTCCAATTAGTTTCCTTTTTAATATGC-3' | (SEQ ID NO: 2288) |  |
|  | 5'-UUUUUGAUCAAAACUAUUUGGGAUAU-3' | (SEQ ID NO: 6725) |  |
|  | 3'-AAAAACUAGUUUUUGAUAAACCCUAUA-5' | (SEQ ID NO: 1180) |  |
| βc-3552 Target: | 5'-TTTTTGATCAAAACTATTTGGGATAT-3' | (SEQ ID NO: 2289) |  |
|  | 5'-AAGAGGUGUUAUUUGGAACCUUGUUUU-3' | (SEQ ID NO: 6726) |  |
|  | 3'-UUCUCCACAAUAAACCUUGGAACAAAA-5' | (SEQ ID NO: 1181) |  |
| βc-3600 Target: | 5'-AAGAGGTGTTATTTGGAACCTTGTTTT-3' | (SEQ ID NO: 2290) |  |

TABLE 8-continued

Selected Anti-β-catenin DsiRNA Agents, Blunt Duplexes

|  |  |  |  |
|---|---|---|---|
|  | 5'-GUGUUAUUUGGAACCUUGUUUUGGACA-3' | (SEQ ID NO: 6727) |
|  | 3'-CACAAUAAACCUUGGAACAAAACCUGU-5' | (SEQ ID NO: 1182) |
| βc-3605 Target: | 5'-GTGTTATTTGGAACCTTGTTTTGGACA-3' | (SEQ ID NO: 2291) |
|  | 5'-GAACCUUGUUUUGGACAGUUUACCAGU-3' | (SEQ ID NO: 6728) |
|  | 3'-CUUGGAACAAAACCUGUCAAAUGGUCA-5' | (SEQ ID NO: 1183) |
| βc-3615 Target: | 5'-GAACCTTGTTTTGGACAGTTTACCAGT-3' | (SEQ ID NO: 2292) |
|  | 5'-GUGAUACGAUGCUUCAAGAGAAAAUGC-3' | (SEQ ID NO: 6729) |
|  | 3'-CACUAUGCUACGAAGUUCUCUUUUACG-5' | (SEQ ID NO: 1184) |
| βc-3674 Target: | 5'-GTGATACGATGCTTCAAGAGAAAATGC-3' | (SEQ ID NO: 2293) |
|  | 5'-UUCAAGAGAAAAUGCGGUUAUAAAAAA-3' | (SEQ ID NO: 6730) |
|  | 3'-AAGUUCUCUUUUACGCCAAUAUUUUUU-5' | (SEQ ID NO: 1185) |
| βc-3686 Target: | 5'-TTCAAGAGAAAATGCGGTTATAAAAAA-3' | (SEQ ID NO: 2294) |
|  | 5'-GAGAAAAUGCGGUUAUAAAAAAUGGUU-3' | (SEQ ID NO: 6731) |
|  | 3'-CUCUUUUACGCCAAUAUUUUUUACCAA-5' | (SEQ ID NO: 1186) |
| βc-3691 Target: | 5'-GAGAAAATGCGGTTATAAAAAATGGTT-3' | (SEQ ID NO: 2295) |
|  | 5'-CGGUUAUAAAAAAUGGUUCAGAAUUAA-3' | (SEQ ID NO: 6732) |
|  | 3'-GCCAAUAUUUUUUACCAAGUCUUAAUU-5' | (SEQ ID NO: 1187) |
| βc-3700 Target: | 5'-CGGTTATAAAAAATGGTTCAGAATTAA-3' | (SEQ ID NO: 2296) |
|  | 5'-AAAAAAUGGUUCAGAAUUAAACUUUUA-3' | (SEQ ID NO: 6733) |
|  | 3'-UUUUUUACCAAGUCUUAAUUUGAAAAU-5' | (SEQ ID NO: 1188) |
| βc-3707 Target: | 5'-AAAAAATGGTTCAGAATTAAACTTTTA-3' | (SEQ ID NO: 2297) |
|  | 5'-CAGCGUGGACAAUGGCUACUCAAGCUG-3' | (SEQ ID NO: 6734) |
|  | 3'-GUCGCACCUGUUACCGAUGAGUUCGAC-5' | (SEQ ID NO: 1189) |
| βc-284 Target: | 5'-CAGCGTGGACAATGGCTACTCAAGCTG-3' | (SEQ ID NO: 2298) |
|  | 5'-AGCGUGGACAAUGGCUACUCAAGCUGA-3' | (SEQ ID NO: 6735) |
|  | 3'-UCGCACCUGUUACCGAUGAGUUCGACU-5' | (SEQ ID NO: 1190) |
| βc-285 Target: | 5'-AGCGTGGACAATGGCTACTCAAGCTGA-3' | (SEQ ID NO: 2299) |
|  | 5'-GCGUGGACAAUGGCUACUCAAGCUGAU-3' | (SEQ ID NO: 6736) |
|  | 3'-CGCACCUGUUACCGAUGAGUUCGACUA-5' | (SEQ ID NO: 1191) |
| βc-286 Target: | 5'-GCGTGGACAATGGCTACTCAAGCTGAT-3' | (SEQ ID NO: 2300) |
|  | 5'-CGUGGACAAUGGCUACUCAAGCUGAUU-3' | (SEQ ID NO: 6737) |
|  | 3'-GCACCUGUUACCGAUGAGUUCGACUAA-5' | (SEQ ID NO: 1192) |
| βc-287 Target: | 5'-CGTGGACAATGGCTACTCAAGCTGATT-3' | (SEQ ID NO: 2301) |
|  | 5'-GUGGACAAUGGCUACUCAAGCUGAUUU-3' | (SEQ ID NO: 6738) |
|  | 3'-CACCUGUUACCGAUGAGUUCGACUAAA-5' | (SEQ ID NO: 1193) |
| βc-288 Target: | 5'-GTGGACAATGGCTACTCAAGCTGATTT-3' | (SEQ ID NO: 2302) |
|  | 5'-UGGACAAUGGCUACUCAAGCUGAUUUG-3' | (SEQ ID NO: 6739) |
|  | 3'-ACCUGUUACCGAUGAGUUCGACUAAAC-5' | (SEQ ID NO: 1194) |
| βc-289 Target: | 5'-TGGACAATGGCTACTCAAGCTGATTTG-3' | (SEQ ID NO: 2303) |

TABLE 8-continued

Selected Anti-β-catenin DsiRNA Agents, Blunt Duplexes

|  |  |  |  |
|---|---|---|---|
|  | 5'-GGACAAUGGCUACUCAAGCUGAUUUGA-3' | (SEQ ID NO: 6740) |
|  | 3'-CCUGUUACCGAUGAGUUCGACUAAACU-5' | (SEQ ID NO: 1195) |
| βc-290 Target: | 5'-GGACAATGGCTACTCAAGCTGATTTGA-3' | (SEQ ID NO: 2304) |
|  | 5'-GACAAUGGCUACUCAAGCUGAUUUGAU-3' | (SEQ ID NO: 6741) |
|  | 3'-CUGUUACCGAUGAGUUCGACUAAACUA-5' | (SEQ ID NO: 1196) |
| βc-291 Target: | 5'-GACAATGGCTACTCAAGCTGATTTGAT-3' | (SEQ ID NO: 2305) |
|  | 5'-UUUGAUGGAGUUGGACAUGGCCAUGGA-3' | (SEQ ID NO: 6742) |
|  | 3'-AAACUACCUCAACCUGUACCGGUACCU-5' | (SEQ ID NO: 1197) |
| βc-312 Target: | 5'-TTTGATGGAGTTGGACATGGCCATGGA-3' | (SEQ ID NO: 2306) |
|  | 5'-UUGAUGGAGUUGGACAUGGCCAUGGAA-3' | (SEQ ID NO: 6743) |
|  | 3'-AACUACCUCAACCUGUACCGGUACCUU-5' | (SEQ ID NO: 1198) |
| βc-313 Target: | 5'-TTGATGGAGTTGGACATGGCCATGGAA-3' | (SEQ ID NO: 2307) |
|  | 5'-UGAUGGAGUUGGACAUGGCCAUGGAAC-3' | (SEQ ID NO: 6744) |
|  | 3'-ACUACCUCAACCUGUACCGGUACCUUG-5' | (SEQ ID NO: 1199) |
| βc-314 Target: | 5'-TGATGGAGTTGGACATGGCCATGGAAC-3' | (SEQ ID NO: 2308) |
|  | 5'-GAUGGAGUUGGACAUGGCCAUGGAACC-3' | (SEQ ID NO: 6745) |
|  | 3'-CUACCUCAACCUGUACCGGUACCUUGG-5' | (SEQ ID NO: 1200) |
| βc-315 Target: | 5'-GATGGAGTTGGACATGGCCATGGAACC-3' | (SEQ ID NO: 2309) |
|  | 5'-AUGGAGUUGGACAUGGCCAUGGAACCA-3' | (SEQ ID NO: 6746) |
|  | 3'-UACCUCAACCUGUACCGGUACCUUGGU-5' | (SEQ ID NO: 1201) |
| βc-316 Target: | 5'-ATGGAGTTGGACATGGCCATGGAACCA-3' | (SEQ ID NO: 2310) |
|  | 5'-UGGAGUUGGACAUGGCCAUGGAACCAG-3' | (SEQ ID NO: 6747) |
|  | 3'-ACCUCAACCUGUACCGGUACCUUGGUC-5' | (SEQ ID NO: 1202) |
| βc-317 Target: | 5'-TGGAGTTGGACATGGCCATGGAACCAG-3' | (SEQ ID NO: 2311) |
|  | 5'-GGAGUUGGACAUGGCCAUGGAACCAGA-3' | (SEQ ID NO: 6748) |
|  | 3'-CCUCAACCUGUACCGGUACCUUGGUCU-5' | (SEQ ID NO: 1203) |
| βc-318 Target: | 5'-GGAGTTGGACATGGCCATGGAACCAGA-3' | (SEQ ID NO: 2312) |
|  | 5'-ACUCUGGAAUCCAUUCUGGUGCCACUA-3' | (SEQ ID NO: 6749) |
|  | 3'-UGAGACCUUAGGUAAGACCACGGUGAU-5' | (SEQ ID NO: 1204) |
| βc-389 Target: | 5'-ACTCTGGAATCCATTCTGGTGCCACTA-3' | (SEQ ID NO: 2313) |
|  | 5'-CUCUGGAAUCCAUUCUGGUGCCACUAC-3' | (SEQ ID NO: 6750) |
|  | 3'-GAGACCUUAGGUAAGACCACGGUGAUG-5' | (SEQ ID NO: 1205) |
| βc-390 Target: | 5'-CTCTGGAATCCATTCTGGTGCCACTAC-3' | (SEQ ID NO: 2314) |
|  | 5'-UCUGGAAUCCAUUCUGGUGCCACUACC-3' | (SEQ ID NO: 6751) |
|  | 3'-AGACCUUAGGUAAGACCACGGUGAUGG-5' | (SEQ ID NO: 1206) |
| βc-391 Target: | 5'-TCTGGAATCCATTCTGGTGCCACTACC-3' | (SEQ ID NO: 2315) |
|  | 5'-CUGGAAUCCAUUCUGGUGCCACUACCA-3' | (SEQ ID NO: 6752) |
|  | 3'-GACCUUAGGUAAGACCACGGUGAUGGU-5' | (SEQ ID NO: 1207) |
| βc-392 Target: | 5'-CTGGAATCCATTCTGGTGCCACTACCA-3' | (SEQ ID NO: 2316) |

TABLE 8-continued

Selected Anti-β-catenin DsiRNA Agents, Blunt Duplexes

|  |  |  |
|---|---|---|
|  | 5'-UGGAAUCCAUUCUGGUGCCACUACCAC-3' | (SEQ ID NO: 6753) |
|  | 3'-ACCUUAGGUAAGACCACGGUGAUGGUG-5' | (SEQ ID NO: 1208) |
| βc-393 Target: | 5'-TGGAATCCATTCTGGTGCCACTACCAC-3' | (SEQ ID NO: 2317) |
|  | 5'-AUUAGAUGAGGGCAUGCAGAUCCCAUC-3' | (SEQ ID NO: 6754) |
|  | 3'-UAAUCUACUCCCGUACGUCUAGGGUAG-5' | (SEQ ID NO: 1209) |
| βc-600 Target: | 5'-ATTAGATGAGGGCATGCAGATCCCATC-3' | (SEQ ID NO: 2318) |
|  | 5'-UUAGAUGAGGGCAUGCAGAUCCCAUCU-3' | (SEQ ID NO: 6755) |
|  | 3'-AAUCUACUCCCGUACGUCUAGGGUAGA-5' | (SEQ ID NO: 1210) |
| βc-601 Target: | 5'-TTAGATGAGGGCATGCAGATCCCATCT-3' | (SEQ ID NO: 2319) |
|  | 5'-UAGAUGAGGGCAUGCAGAUCCCAUCUA-3' | (SEQ ID NO: 6756) |
|  | 3'-AUCUACUCCCGUACGUCUAGGGUAGAU-5' | (SEQ ID NO: 1211) |
| βc-602 Target: | 5'-TAGATGAGGGCATGCAGATCCCATCTA-3' | (SEQ ID NO: 2320) |
|  | 5'-AGAUGAGGGCAUGCAGAUCCCAUCUAC-3' | (SEQ ID NO: 6757) |
|  | 3'-UCUACUCCCGUACGUCUAGGGUAGAUG-5' | (SEQ ID NO: 1212) |
| βc-603 Target: | 5'-AGATGAGGGCATGCAGATCCCATCTAC-3' | (SEQ ID NO: 2321) |
|  | 5'-GAUGAGGGCAUGCAGAUCCCAUCUACA-3' | (SEQ ID NO: 6758) |
|  | 3'-CUACUCCCGUACGUCUAGGGUAGAUGU-5' | (SEQ ID NO: 1213) |
| βc-604 Target: | 5'-GATGAGGGCATGCAGATCCCATCTACA-3' | (SEQ ID NO: 2322) |
|  | 5'-AUGAGGGCAUGCAGAUCCCAUCUACAC-3' | (SEQ ID NO: 6759) |
|  | 3'-UACUCCCGUACGUCUAGGGUAGAUGUG-5' | (SEQ ID NO: 1214) |
| βc-605 Target: | 5'-ATGAGGGCATGCAGATCCCATCTACAC-3' | (SEQ ID NO: 2323) |
|  | 5'-AUGCUGCUCAUCCCACUAAUGUCCAGC-3' | (SEQ ID NO: 6760) |
|  | 3'-UACGACGAGUAGGGUGAUUACAGGUCG-5' | (SEQ ID NO: 1215) |
| βc-638 Target: | 5'-ATGCTGCTCATCCCACTAATGTCCAGC-3' | (SEQ ID NO: 2324) |
|  | 5'-UGCUGCUCAUCCCACUAAUGUCCAGCG-3' | (SEQ ID NO: 6761) |
|  | 3'-ACGACGAGUAGGGUGAUUACAGGUCGC-5' | (SEQ ID NO: 1216) |
| βc-639 Target: | 5'-TGCTGCTCATCCCACTAATGTCCAGCG-3' | (SEQ ID NO: 2325) |
|  | 5'-GCUGCUCAUCCCACUAAUGUCCAGCGU-3' | (SEQ ID NO: 6762) |
|  | 3'-CGACGAGUAGGGUGAUUACAGGUCGCA-5' | (SEQ ID NO: 1217) |
| βc-640 Target: | 5'-GCTGCTCATCCCACTAATGTCCAGCGT-3' | (SEQ ID NO: 2326) |
|  | 5'-CUGCUCAUCCCACUAAUGUCCAGCGUU-3' | (SEQ ID NO: 6763) |
|  | 3'-GACGAGUAGGGUGAUUACAGGUCGCAA-5' | (SEQ ID NO: 1218) |
| βc-641 Target: | 5'-CTGCTCATCCCACTAATGTCCAGCGTT-3' | (SEQ ID NO: 2327) |
|  | 5'-UGCUCAUCCCACUAAUGUCCAGCGUUU-3' | (SEQ ID NO: 6764) |
|  | 3'-ACGAGUAGGGUGAUUACAGGUCGCAAA-5' | (SEQ ID NO: 1219) |
| βc-642 Target: | 5'-TGCTCATCCCACTAATGTCCAGCGTTT-3' | (SEQ ID NO: 2328) |
|  | 5'-GCUCAUCCCACUAAUGUCCAGCGUUUG-3' | (SEQ ID NO: 6765) |
|  | 3'-CGAGUAGGGUGAUUACAGGUCGCAAAC-5' | (SEQ ID NO: 1220) |
| βc-643 Target: | 5'-GCTCATCCCACTAATGTCCAGCGTTTG-3' | (SEQ ID NO: 2329) |

TABLE 8-continued

Selected Anti-β-catenin DsiRNA Agents, Blunt Duplexes

|  |  |  |  |
|---|---|---|---|
|  | 5'-CUCAUCCCACUAAUGUCCAGCGUUUGG-3' | (SEQ ID NO: 6766) |
|  | 3'-GAGUAGGGUGAUUACAGGUCGCAAACC-5' | (SEQ ID NO: 1221) |
| βc-644 Target: | 5'-CTCATCCCACTAATGTCCAGCGTTTGG-3' | (SEQ ID NO: 2330) |
|  | 5'-UCAUCCCACUAAUGUCCAGCGUUUGGC-3' | (SEQ ID NO: 6767) |
|  | 3'-AGUAGGGUGAUUACAGGUCGCAAACCG-5' | (SEQ ID NO: 1222) |
| βc-645 Target: | 5'-TCATCCCACTAATGTCCAGCGTTTGGC-3' | (SEQ ID NO: 2331) |
|  | 5'-GUUUGGCUGAACCAUCACAGAUGCUGA-3' | (SEQ ID NO: 6768) |
|  | 3'-CAAACCGACUUGGUAGUGUCUACGACU-5' | (SEQ ID NO: 1223) |
| βc-665 Target: | 5'-GTTTGGCTGAACCATCACAGATGCTGA-3' | (SEQ ID NO: 2332) |
|  | 5'-UUUGGCUGAACCAUCACAGAUGCUGAA-3' | (SEQ ID NO: 6769) |
|  | 3'-AAACCGACUUGGUAGUGUCUACGACUU-5' | (SEQ ID NO: 1224) |
| βc-666 Target: | 5'-TTTGGCTGAACCATCACAGATGCTGAA-3' | (SEQ ID NO: 2333) |
|  | 5'-UUGGCUGAACCAUCACAGAUGCUGAAA-3' | (SEQ ID NO: 6770) |
|  | 3'-AACCGACUUGGUAGUGUCUACGACUUU-5' | (SEQ ID NO: 1225) |
| βc-667 Target: | 5'-TTGGCTGAACCATCACAGATGCTGAAA-3' | (SEQ ID NO: 2334) |
|  | 5'-CAGAACUUGCCACACGUGCAAUCCCUG-3' | (SEQ ID NO: 6771) |
|  | 3'-GUCUUGAACGGUGUGCACGUUAGGGAC-5' | (SEQ ID NO: 1226) |
| βc-731 Target: | 5'-CAGAACTTGCCACACGTGCAATCCCTG-3' | (SEQ ID NO: 2335) |
|  | 5'-AGAACUUGCCACACGUGCAAUCCCUGA-3' | (SEQ ID NO: 6772) |
|  | 3'-UCUUGAACGGUGUGCACGUUAGGGACU-5' | (SEQ ID NO: 1227) |
| βc-732 Target: | 5'-AGAACTTGCCACACGTGCAATCCCTGA-3' | (SEQ ID NO: 2336) |
|  | 5'-CAGUUAUGGUCCAUCAGCUUUCUAAAA-3' | (SEQ ID NO: 6773) |
|  | 3'-GUCAAUACCAGGUAGUCGAAAGAUUUU-5' | (SEQ ID NO: 1228) |
| βc-809 Target: | 5'-CAGTTATGGTCCATCAGCTTTCTAAAA-3' | (SEQ ID NO: 2337) |
|  | 5'-AGUUAUGGUCCAUCAGCUUUCUAAAAA-3' | (SEQ ID NO: 6774) |
|  | 3'-UCAAUACCAGGUAGUCGAAAGAUUUUU-5' | (SEQ ID NO: 1229) |
| βc-810 Target: | 5'-AGTTATGGTCCATCAGCTTTCTAAAAA-3' | (SEQ ID NO: 2338) |
|  | 5'-CUAAAAGGAAGCUUCCAGACACGCUA-3' | (SEQ ID NO: 6775) |
|  | 3'-GAUUUUUCCUUCGAAGGUCUGUGCGAU-5' | (SEQ ID NO: 1230) |
| βc-830 Target: | 5'-CTAAAAGGAAGCTTCCAGACACGCTA-3' | (SEQ ID NO: 2339) |
|  | 5'-UAAAAGGAAGCUUCCAGACACGCUAU-3' | (SEQ ID NO: 6776) |
|  | 3'-AUUUUUCCUUCGAAGGUCUGUGCGAUA-5' | (SEQ ID NO: 1231) |
| βc-831 Target: | 5'-TAAAAGGAAGCTTCCAGACACGCTAT-3' | (SEQ ID NO: 2340) |
|  | 5'-GUACCAUGCAGAAUACAAAUGAUGUAG-3' | (SEQ ID NO: 6777) |
|  | 3'-CAUGGUACGUCUUAUGUUUACUACAUC-5' | (SEQ ID NO: 1232) |
| βc-893 Target: | 5'-GTACCATGCAGAATACAAATGATGTAG-3' | (SEQ ID NO: 2341) |
|  | 5'-UACCAUGCAGAAUACAAAUGAUGUAGA-3' | (SEQ ID NO: 6778) |
|  | 3'-AUGGUACGUCUUAUGUUUACUACAUCU-5' | (SEQ ID NO: 1233) |
| βc-894 Target: | 5'-TACCATGCAGAATACAAATGATGTAGA-3' | (SEQ ID NO: 2342) |

TABLE 8-continued

Selected Anti-β-catenin DsiRNA Agents, Blunt Duplexes

|  |  |  |  |
|---|---|---|---|
|  | 5'-ACCAUGCAGAAUACAAAUGAUGUAGAA-3' | (SEQ ID NO: 6779) |  |
|  | 3'-UGGUACGUCUUAUGUUUACUACAUCUU-5' | (SEQ ID NO: 1234) |  |
| βc-895 Target: | 5'-ACCATGCAGAATACAAATGATGTAGAA-3' | (SEQ ID NO: 2343) |  |
|  | 5'-CCAUGCAGAAUACAAAUGAUGUAGAAA-3' | (SEQ ID NO: 6780) |  |
|  | 3'-GGUACGUCUUAUGUUUACUACAUCUUU-5' | (SEQ ID NO: 1235) |  |
| βc-896 Target: | 5'-CCATGCAGAATACAAATGATGTAGAAA-3' | (SEQ ID NO: 2344) |  |
|  | 5'-CAUGCAGAAUACAAAUGAUGUAGAAAC-3' | (SEQ ID NO: 6781) |  |
|  | 3'-GUACGUCUUAUGUUUACUACAUCUUUG-5' | (SEQ ID NO: 1236) |  |
| βc-897 Target: | 5'-CATGCAGAATACAAATGATGTAGAAAC-3' | (SEQ ID NO: 2345) |  |
|  | 5'-AUGCAGAAUACAAAUGAUGUAGAAACA-3' | (SEQ ID NO: 6782) |  |
|  | 3'-UACGUCUUAUGUUUACUACAUCUUUGU-5' | (SEQ ID NO: 1237) |  |
| βc-898 Target: | 5'-ATGCAGAATACAAATGATGTAGAAACA-3' | (SEQ ID NO: 2346) |  |
|  | 5'-UGCAGAAUACAAAUGAUGUAGAAACAG-3' | (SEQ ID NO: 6783) |  |
|  | 3'-ACGUCUUAUGUUUACUACAUCUUUGUC-5' | (SEQ ID NO: 1238) |  |
| βc-899 Target: | 5'-TGCAGAATACAAATGATGTAGAAACAG-3' | (SEQ ID NO: 2347) |  |
|  | 5'-GCAGAAUACAAAUGAUGUAGAAACAGC-3' | (SEQ ID NO: 6784) |  |
|  | 3'-CGUCUUAUGUUUACUACAUCUUUGUCG-5' | (SEQ ID NO: 1239) |  |
| βc-900 Target: | 5'-GCAGAATACAAATGATGTAGAAACAGC-3' | (SEQ ID NO: 2348) |  |
|  | 5'-UACUGGCCAUCUUUAAGUCUGGAGGCA-3' | (SEQ ID NO: 6785) |  |
|  | 3'-AUGACCGGUAGAAAUUCAGACCUCCGU-5' | (SEQ ID NO: 1240) |  |
| βc-977 Target: | 5'-TACTGGCCATCTTTAAGTCTGGAGGCA-3' | (SEQ ID NO: 2349) |  |
|  | 5'-ACUGGCCAUCUUUAAGUCUGGAGGCAU-3' | (SEQ ID NO: 6786) |  |
|  | 3'-UGACCGGUAGAAAUUCAGACCUCCGUA-5' | (SEQ ID NO: 1241) |  |
| βc-978 Target: | 5'-ACTGGCCATCTTTAAGTCTGGAGGC-3' | (SEQ ID NO: 2350) |  |
|  | 5'-AAGAAGGAGCUAAAAUGGCAGUGCGUU-3' | (SEQ ID NO: 6787) |  |
|  | 3'-UUCUUCCUCGAUUUUACCGUCACGCAA-5' | (SEQ ID NO: 1242) |  |
| βc-1091 Target: | 5'-AAGAAGGAGCTAAAATGGCAGTGCGTT-3' | (SEQ ID NO: 2351) |  |
|  | 5'-AGAAGGAGCUAAAAUGGCAGUGCGUUU-3' | (SEQ ID NO: 6788) |  |
|  | 3'-UCUUCCUCGAUUUUACCGUCACGCAAA-5' | (SEQ ID NO: 1243) |  |
| βc-1092 Target: | 5'-AGAAGGAGCTAAAATGGCAGTGCGTTT-3' | (SEQ ID NO: 2352) |  |
|  | 5'-GAAGGAGCUAAAAUGGCAGUGCGUUUA-3' | (SEQ ID NO: 6789) |  |
|  | 3'-CUUCCUCGAUUUUACCGUCACGCAAAU-5' | (SEQ ID NO: 1244) |  |
| βc-1093 Target: | 5'-GAAGGAGCTAAAATGGCAGTGCGTTTA-3' | (SEQ ID NO: 2353) |  |
|  | 5'-AAGGAGCUAAAAUGGCAGUGCGUUUAG-3' | (SEQ ID NO: 6790) |  |
|  | 3'-UUCCUCGAUUUUACCGUCACGCAAAUC-5' | (SEQ ID NO: 1245) |  |
| βc-1094 Target: | 5'-AAGGAGCTAAAATGGCAGTGCGTTTAG-3' | (SEQ ID NO: 2354) |  |
|  | 5'-AGGAGCUAAAAUGGCAGUGCGUUUAGC-3' | (SEQ ID NO: 6791) |  |
|  | 3'-UCCUCGAUUUUACCGUCACGCAAAUCG-5' | (SEQ ID NO: 1246) |  |
| βc-1095 Target: | 5'-AGGAGCTAAAATGGCAGTGCGTTTAGC-3' | (SEQ ID NO: 2355) |  |

TABLE 8-continued

Selected Anti-β-catenin DsiRNA Agents, Blunt Duplexes

| | | |
|---|---|---|
| | 5'-UACUGUGGACCACAAGCAGAGUGCUGA-3' | (SEQ ID NO: 6792) |
| | 3'-AUGACACCUGGUGUUCGUCUCACGACU-5' | (SEQ ID NO: 1247) |
| βc-1301 Target: | 5'-TACTGTGGACCACAAGCAGAGTGCTGA-3' | (SEQ ID NO: 2356) |
| | 5'-ACUGUGGACCACAAGCAGAGUGCUGAA-3' | (SEQ ID NO: 6793) |
| | 3'-UGACACCUGGUGUUCGUCUCACGACUU-5' | (SEQ ID NO: 1248) |
| βc-1302 Target: | 5'-ACTGTGGACCACAAGCAGAGTGCTGAA-3' | (SEQ ID NO: 2357) |
| | 5'-CUGUGGACCACAAGCAGAGUGCUGAAG-3' | (SEQ ID NO: 6794) |
| | 3'-GACACCUGGUGUUCGUCUCACGACUUC-5' | (SEQ ID NO: 1249) |
| βc-1303 Target: | 5'-CTGTGGACCACAAGCAGAGTGCTGAAG-3' | (SEQ ID NO: 2358) |
| | 5'-UGUGGACCACAAGCAGAGUGCUGAAGG-3' | (SEQ ID NO: 6795) |
| | 3'-ACACCUGGUGUUCGUCUCACGACUUCC-5' | (SEQ ID NO: 1250) |
| βc-1304 Target: | 5'-TGTGGACCACAAGCAGAGTGCTGAAGG-3' | (SEQ ID NO: 2359) |
| | 5'-GUGGACCACAAGCAGAGUGCUGAAGGU-3' | (SEQ ID NO: 6796) |
| | 3'-CACCUGGUGUUCGUCUCACGACUUCCA-5' | (SEQ ID NO: 1251) |
| βc-1305 Target: | 5'-GTGGACCACAAGCAGAGTGCTGAAGGT-3' | (SEQ ID NO: 2360) |
| | 5'-UGGACCACAAGCAGAGUGCUGAAGGUG-3' | (SEQ ID NO: 6797) |
| | 3'-ACCUGGUGUUCGUCUCACGACUUCCAC-5' | (SEQ ID NO: 1252) |
| βc-1306 Target: | 5'-TGGACCACAAGCAGAGTGCTGAAGGTG-3' | (SEQ ID NO: 2361) |
| | 5'-GGACCACAAGCAGAGUGCUGAAGGUGC-3' | (SEQ ID NO: 6798) |
| | 3'-CCUGGUGUUCGUCUCACGACUUCCACG-5' | (SEQ ID NO: 1253) |
| βc-1307 Target: | 5'-GGACCACAAGCAGAGTGCTGAAGGTGC-3' | (SEQ ID NO: 2362) |
| | 5'-GACCACAAGCAGAGUGCUGAAGGUGCU-3' | (SEQ ID NO: 6799) |
| | 3'-CUGGUGUUCGUCUCACGACUUCCACGA-5' | (SEQ ID NO: 1254) |
| βc-1308 Target: | 5'-GACCACAAGCAGAGTGCTGAAGGTGCT-3' | (SEQ ID NO: 2363) |
| | 5'-ACCACAAGCAGAGUGCUGAAGGUGCUA-3' | (SEQ ID NO: 6800) |
| | 3'-UGGUGUUCGUCUCACGACUUCCACGAU-5' | (SEQ ID NO: 1255) |
| βc-1309 Target: | 5'-ACCACAAGCAGAGTGCTGAAGGTGCTA-3' | (SEQ ID NO: 2364) |
| | 5'-CCACAAGCAGAGUGCUGAAGGUGCUAU-3' | (SEQ ID NO: 6801) |
| | 3'-GGUGUUCGUCUCACGACUUCCACGAUA-5' | (SEQ ID NO: 1256) |
| βc-1310 Target: | 5'-CCACAAGCAGAGTGCTGAAGGTGCTAT-3' | (SEQ ID NO: 2365) |
| | 5'-CACAAGCAGAGUGCUGAAGGUGCUAUC-3' | (SEQ ID NO: 6802) |
| | 3'-GUGUUCGUCUCACGACUUCCACGAUAG-5' | (SEQ ID NO: 1257) |
| βc-1311 Target: | 5'-CACAAGCAGAGTGCTGAAGGTGCTATC-3' | (SEQ ID NO: 2366) |
| | 5'-ACAAGCAGAGUGCUGAAGGUGCUAUCU-3' | (SEQ ID NO: 6803) |
| | 3'-UGUUCGUCUCACGACUUCCACGAUAGA-5' | (SEQ ID NO: 1258) |
| βc-1312 Target: | 5'-ACAAGCAGAGTGCTGAAGGTGCTATCT-3' | (SEQ ID NO: 2367) |
| | 5'-CAAGCAGAGUGCUGAAGGUGCUAUCUG-3' | (SEQ ID NO: 6804) |
| | 3'-GUUCGUCUCACGACUUCCACGAUAGAC-5' | (SEQ ID NO: 1259) |
| βc-1313 Target: | 5'-CAAGCAGAGTGCTGAAGGTGCTATCTG-3' | (SEQ ID NO: 2368) |

TABLE 8-continued

Selected Anti-β-catenin DsiRNA Agents, Blunt Duplexes

|  |  |  |  |
|---|---|---|---|
|  | 5'-AAGCAGAGUGCUGAAGGUGCUAUCUGU-3' | (SEQ ID NO: 6805) |
|  | 3'-UUCGUCUCACGACUUCCACGAUAGACA-5' | (SEQ ID NO: 1260) |
| βc-1314 Target: | 5'-AAGCAGAGTGCTGAAGGTGCTATCTGT-3' | (SEQ ID NO: 2369) |
|  | 5'-AGAACUGUCUUUGGACUCUCAGGAAUC-3' | (SEQ ID NO: 6806) |
|  | 3'-UCUUGACAGAAACCUGAGAGUCCUUAG-5' | (SEQ ID NO: 1261) |
| βc-1430 Target: | 5'-AGAACTGTCTTTGGACTCTCAGGAATC-3' | (SEQ ID NO: 2370) |
|  | 5'-GAACUGUCUUUGGACUCUCAGGAAUCU-3' | (SEQ ID NO: 6807) |
|  | 3'-CUUGACAGAAACCUGAGAGUCCUUAGA-5' | (SEQ ID NO: 1262) |
| βc-1431 Target: | 5'-GAACTGTCTTTGGACTCTCAGGAATCT-3' | (SEQ ID NO: 2371) |
|  | 5'-CAGAUGAUAUAAAUGUGGUCACCUGUG-3' | (SEQ ID NO: 6808) |
|  | 3'-GUCUACUAUAUUUACACCAGUGGACAC-5' | (SEQ ID NO: 1263) |
| βc-1526 Target: | 5'-CAGATGATATAAATGTGGTCACCTGTG-3' | (SEQ ID NO: 2372) |
|  | 5'-AGAUGAUAUAAAUGUGGUCACCUGUGC-3' | (SEQ ID NO: 6809) |
|  | 3'-UCUACUAUAUUUACACCAGUGGACACG-5' | (SEQ ID NO: 1264) |
| βc-1527 Target: | 5'-AGATGATATAAATGTGGTCACCTGTGC-3' | (SEQ ID NO: 2373) |
|  | 5'-GAUGAUAUAAAUGUGGUCACCUGUGCA-3' | (SEQ ID NO: 6810) |
|  | 3'-CUACUAUAUUUACACCAGUGGACACGU-5' | (SEQ ID NO: 1265) |
| βc-1528 Target: | 5'-GATGATATAAATGTGGTCACCTGTGCA-3' | (SEQ ID NO: 2374) |
|  | 5'-AUGAUAUAAAUGUGGUCACCUGUGCAG-3' | (SEQ ID NO: 6811) |
|  | 3'-UACUAUAUUUACACCAGUGGACACGUC-5' | (SEQ ID NO: 1266) |
| βc-1529 Target: | 5'-ATGATATAAATGTGGTCACCTGTGCAG-3' | (SEQ ID NO: 2375) |
|  | 5'-UGAUAUAAAUGUGGUCACCUGUGCAGC-3' | (SEQ ID NO: 6812) |
|  | 3'-ACUAUAUUUACACCAGUGGACACGUCG-5' | (SEQ ID NO: 1267) |
| βc-1530 Target: | 5'-TGATATAAATGTGGTCACCTGTGCAGC-3' | (SEQ ID NO: 2376) |
|  | 5'-GAUAUAAAUGUGGUCACCUGUGCAGCU-3' | (SEQ ID NO: 6813) |
|  | 3'-CUAUAUUUACACCAGUGGACACGUCGA-5' | (SEQ ID NO: 1268) |
| βc-1531 Target: | 5'-GATATAAATGTGGTCACCTGTGCAGCT-3' | (SEQ ID NO: 2377) |
|  | 5'-AUAUAAAUGUGGUCACCUGUGCAGCUG-3' | (SEQ ID NO: 6814) |
|  | 3'-UAUAUUUACACCAGUGGACACGUCGAC-5' | (SEQ ID NO: 1269) |
| βc-1532 Target: | 5'-ATATAAATGTGGTCACCTGTGCAGCTG-3' | (SEQ ID NO: 2378) |
|  | 5'-UAUAAAUGUGGUCACCUGUGCAGCUGG-3' | (SEQ ID NO: 6815) |
|  | 3'-AUAUUUACACCAGUGGACACGUCGACC-5' | (SEQ ID NO: 1270) |
| βc-1533 Target: | 5'-TATAAATGTGGTCACCTGTGCAGCTGG-3' | (SEQ ID NO: 2379) |
|  | 5'-AUAAAUGUGGUCACCUGUGCAGCUGGA-3' | (SEQ ID NO: 6816) |
|  | 3'-UAUUUACACCAGUGGACACGUCGACCU-5' | (SEQ ID NO: 1271) |
| βc-1534 Target: | 5'-ATAAATGTGGTCACCTGTGCAGCTGGA-3' | (SEQ ID NO: 2380) |
|  | 5'-UAAAUGUGGUCACCUGUGCAGCUGGAA-3' | (SEQ ID NO: 6817) |
|  | 3'-AUUUACACCAGUGGACACGUCGACCUU-5' | (SEQ ID NO: 1272) |
| βc-1535 Target: | 5'-TAAATGTGGTCACCTGTGCAGCTGGAA-3' | (SEQ ID NO: 2381) |

TABLE 8-continued

Selected Anti-β-catenin DsiRNA Agents, Blunt Duplexes

|  |  |  |  |
|---|---|---|---|
|  | 5'-AAAUGUGGUCACCUGUGCAGCUGGAAU-3' | (SEQ ID NO: 6818) |
|  | 3'-UUUACACCAGUGGACACGUCGACCUUA-5' | (SEQ ID NO: 1273) |
| βc-1536 Target: | 5'-AAATGTGGTCACCTGTGCAGCTGGAAT-3' | (SEQ ID NO: 2382) |
|  | 5'-AAUGUGGUCACCUGUGCAGCUGGAAUU-3' | (SEQ ID NO: 6819) |
|  | 3'-UUACACCAGUGGACACGUCGACCUUAA-5' | (SEQ ID NO: 1274) |
| βc-1537 Target: | 5'-AATGTGGTCACCTGTGCAGCTGGAATT-3' | (SEQ ID NO: 2383) |
|  | 5'-AUGUGGUCACCUGUGCAGCUGGAAUUC-3' | (SEQ ID NO: 6820) |
|  | 3'-UACACCAGUGGACACGUCGACCUUAAG-5' | (SEQ ID NO: 1275) |
| βc-1538 Target: | 5'-ATGTGGTCACCTGTGCAGCTGGAATTC-3' | (SEQ ID NO: 2384) |
|  | 5'-UGUGGUCACCUGUGCAGCUGGAAUUCU-3' | (SEQ ID NO: 6821) |
|  | 3'-ACACCAGUGGACACGUCGACCUUAAGA-5' | (SEQ ID NO: 1276) |
| βc-1539 Target: | 5'-TGTGGTCACCTGTGCAGCTGGAATTCT-3' | (SEQ ID NO: 2385) |
|  | 5'-GUGGUCACCUGUGCAGCUGGAAUUCUU-3' | (SEQ ID NO: 6822) |
|  | 3'-CACCAGUGGACACGUCGACCUUAAGAA-5' | (SEQ ID NO: 1277) |
| βc-1540 Target: | 5'-GTGGTCACCTGTGCAGCTGGAATTCTT-3' | (SEQ ID NO: 2386) |
|  | 5'-UGGUCACCUGUGCAGCUGGAAUUCUUU-3' | (SEQ ID NO: 6823) |
|  | 3'-ACCAGUGGACACGUCGACCUUAAGAAA-5' | (SEQ ID NO: 1278) |
| βc-1541 Target: | 5'-TGGTCACCTGTGCAGCTGGAATTCTTT-3' | (SEQ ID NO: 2387) |
|  | 5'-GGUCACCUGUGCAGCUGGAAUUCUUUC-3' | (SEQ ID NO: 6824) |
|  | 3'-CCAGUGGACACGUCGACCUUAAGAAAG-5' | (SEQ ID NO: 1279) |
| βc-1542 Target: | 5'-GGTCACCTGTGCAGCTGGAATTCTTTC-3' | (SEQ ID NO: 2388) |
|  | 5'-GUCACCUGUGCAGCUGGAAUUCUUUCU-3' | (SEQ ID NO: 6825) |
|  | 3'-CAGUGGACACGUCGACCUUAAGAAAGA-5' | (SEQ ID NO: 1280) |
| βc-1543 Target: | 5'-GTCACCTGTGCAGCTGGAATTCTTTCT-3' | (SEQ ID NO: 2389) |
|  | 5'-UCACCUGUGCAGCUGGAAUUCUUUCUA-3' | (SEQ ID NO: 6826) |
|  | 3'-AGUGGACACGUCGACCUUAAGAAAGAU-5' | (SEQ ID NO: 1281) |
| βc-1544 Target: | 5'-TCACCTGTGCAGCTGGAATTCTTTCTA-3' | (SEQ ID NO: 2390) |
|  | 5'-CACCUGUGCAGCUGGAAUUCUUUCUAA-3' | (SEQ ID NO: 6827) |
|  | 3'-GUGGACACGUCGACCUUAAGAAAGAUU-5' | (SEQ ID NO: 1282) |
| βc-1545 Target: | 5'-CACCTGTGCAGCTGGAATTCTTTCTAA-3' | (SEQ ID NO: 2391) |
|  | 5'-UUUCUAACCUCACUUGCAAUAAUUAUA-3' | (SEQ ID NO: 6828) |
|  | 3'-AAAGAUUGGAGUGAACGUUAUUAAUAU-5' | (SEQ ID NO: 1283) |
| βc-1565 Target: | 5'-TTTCTAACCTCACTTGCAATAATTATA-3' | (SEQ ID NO: 2392) |
|  | 5'-UUCUAACCUCACUUGCAAUAAUUAUAA-3' | (SEQ ID NO: 6829) |
|  | 3'-AAGAUUGGAGUGAACGUUAUUAAUAUU-5' | (SEQ ID NO: 1284) |
| βc-1566 Target: | 5'-TTCTAACCTCACTTGCAATAATTATAA-3' | (SEQ ID NO: 2393) |
|  | 5'-UCUAACCUCACUUGCAAUAAUUAUAAG-3' | (SEQ ID NO: 6830) |
|  | 3'-AGAUUGGAGUGAACGUUAUUAAUAUUC-5' | (SEQ ID NO: 1285) |
| βc-1567 Target: | 5'-TCTAACCTCACTTGCAATAATTATAAG-3' | (SEQ ID NO: 2394) |

TABLE 8-continued

Selected Anti-β-catenin DsiRNA Agents, Blunt Duplexes

|  |  |  |  |
|---|---|---|---|
|  | 5'-CUAACCUCACUUGCAAUAAUUAUAAGA-3' | (SEQ ID NO: 6831) |
|  | 3'-GAUUGGAGUGAACGUUAUUAAUAUUCU-5' | (SEQ ID NO: 1286) |
| βc-1568 Target: | 5'-CTAACCTCACTTGCAATAATTATAAGA-3' | (SEQ ID NO: 2395) |
|  | 5'-UAACCUCACUUGCAAUAAUUAUAAGAA-3' | (SEQ ID NO: 6832) |
|  | 3'-AUUGGAGUGAACGUUAUUAAUAUUCUU-5' | (SEQ ID NO: 1287) |
| βc-1569 Target: | 5'-TAACCTCACTTGCAATAATTATAAGAA-3' | (SEQ ID NO: 2396) |
|  | 5'-GGGCUGGUGACAGGGAAGACAUCACUG-3' | (SEQ ID NO: 6833) |
|  | 3'-CCCGACCACUGUCCCUUCUGUAGUGAC-5' | (SEQ ID NO: 1288) |
| βc-1652 Target: | 5'-GGGCTGGTGACAGGGAAGACATCACTG-3' | (SEQ ID NO: 2397) |
|  | 5'-GGCUGGUGACAGGGAAGACAUCACUGA-3' | (SEQ ID NO: 6834) |
|  | 3'-CCGACCACUGUCCCUUCUGUAGUGACU-5' | (SEQ ID NO: 1289) |
| βc-1653 Target: | 5'-GGCTGGTGACAGGGAAGACATCACTGA-3' | (SEQ ID NO: 2398) |
|  | 5'-GCUGGUGACAGGGAAGACAUCACUGAG-3' | (SEQ ID NO: 6835) |
|  | 3'-CGACCACUGUCCCUUCUGUAGUGACUC-5' | (SEQ ID NO: 1290) |
| βc-1654 Target: | 5'-GCTGGTGACAGGGAAGACATCACTGAG-3' | (SEQ ID NO: 2399) |
|  | 5'-CUGGUGACAGGGAAGACAUCACUGAGC-3' | (SEQ ID NO: 6836) |
|  | 3'-GACCACUGUCCCUUCUGUAGUGACUCG-5' | (SEQ ID NO: 1291) |
| βc-1655 Target: | 5'-CTGGTGACAGGGAAGACATCACTGAGC-3' | (SEQ ID NO: 2400) |
|  | 5'-UGGUGACAGGGAAGACAUCACUGAGCC-3' | (SEQ ID NO: 6837) |
|  | 3'-ACCACUGUCCCUUCUGUAGUGACUCGG-5' | (SEQ ID NO: 1292) |
| βc-1656 Target: | 5'-TGGTGACAGGGAAGACATCACTGAGCC-3' | (SEQ ID NO: 2401) |
|  | 5'-GGUGACAGGGAAGACAUCACUGAGCCU-3' | (SEQ ID NO: 6838) |
|  | 3'-CCACUGUCCCUUCUGUAGUGACUCGGA-5' | (SEQ ID NO: 1293) |
| βc-1657 Target: | 5'-GGTGACAGGGAAGACATCACTGAGCCT-3' | (SEQ ID NO: 2402) |
|  | 5'-GUGACAGGGAAGACAUCACUGAGCCUG-3' | (SEQ ID NO: 6839) |
|  | 3'-CACUGUCCCUUCUGUAGUGACUCGGAC-5' | (SEQ ID NO: 1294) |
| βc-1658 Target: | 5'-GTGACAGGGAAGACATCACTGAGCCTG-3' | (SEQ ID NO: 2403) |
|  | 5'-UGACAGGGAAGACAUCACUGAGCCUGC-3' | (SEQ ID NO: 6840) |
|  | 3'-ACUGUCCCUUCUGUAGUGACUCGGACG-5' | (SEQ ID NO: 1295) |
| βc-1659 Target: | 5'-TGACAGGGAAGACATCACTGAGCCTGC-3' | (SEQ ID NO: 2404) |
|  | 5'-GACAGGGAAGACAUCACUGAGCCUGCC-3' | (SEQ ID NO: 6841) |
|  | 3'-CUGUCCCUUCUGUAGUGACUCGGACGG-5' | (SEQ ID NO: 1296) |
| βc-1660 Target: | 5'-GACAGGGAAGACATCACTGAGCCTGCC-3' | (SEQ ID NO: 2405) |
|  | 5'-ACAGGGAAGACAUCACUGAGCCUGCCA-3' | (SEQ ID NO: 6842) |
|  | 3'-UGUCCCUUCUGUAGUGACUCGGACGGU-5' | (SEQ ID NO: 1297) |
| βc-1661 Target: | 5'-ACAGGGAAGACATCACTGAGCCTGCCA-3' | (SEQ ID NO: 2406) |
|  | 5'-CAGGGAAGACAUCACUGAGCCUGCCAU-3' | (SEQ ID NO: 6843) |
|  | 3'-GUCCCUUCUGUAGUGACUCGGACGGUA-5' | (SEQ ID NO: 1298) |
| βc-1662 Target: | 5'-CAGGGAAGACATCACTGAGCCTGCC-3' | (SEQ ID NO: 2407) |

TABLE 8-continued

Selected Anti-β-catenin DsiRNA Agents, Blunt Duplexes

|  |  |  |
|---|---|---|
|  | 5'-AGGGAAGACAUCACUGAGCCUGCCAUC-3' | (SEQ ID NO: 6844) |
|  | 3'-UCCCUUCUGUAGUGACUCGGACGGUAG-5' | (SEQ ID NO: 1299) |
| βc-1663 Target: | 5'-AGGGAAGACATCACTGAGCCTGCCATC-3' | (SEQ ID NO: 2408) |
|  | 5'-GGGAAGACAUCACUGAGCCUGCCAUCU-3' | (SEQ ID NO: 6845) |
|  | 3'-CCCUUCUGUAGUGACUCGGACGGUAGA-5' | (SEQ ID NO: 1300) |
| βc-1664 Target: | 5'-GGGAAGACATCACTGAGCCTGCCATCT-3' | (SEQ ID NO: 2409) |
|  | 5'-GGAAGACAUCACUGAGCCUGCCAUCUG-3' | (SEQ ID NO: 6846) |
|  | 3'-CCUUCUGUAGUGACUCGGACGGUAGAC-5' | (SEQ ID NO: 1301) |
| βc-1665 Target: | 5'-GGAAGACATCACTGAGCCTGCCATCTG-3' | (SEQ ID NO: 2410) |
|  | 5'-GAAGACAUCACUGAGCCUGCCAUCUGU-3' | (SEQ ID NO: 6847) |
|  | 3'-CUUCUGUAGUGACUCGGACGGUAGACA-5' | (SEQ ID NO: 1302) |
| βc-1666 Target: | 5'-GAAGACATCACTGAGCCTGCCATCTGT-3' | (SEQ ID NO: 2411) |
|  | 5'-AAGACAUCACUGAGCCUGCCAUCUGUG-3' | (SEQ ID NO: 6848) |
|  | 3'-UUCUGUAGUGACUCGGACGGUAGACAC-5' | (SEQ ID NO: 1303) |
| βc-1667 Target: | 5'-AAGACATCACTGAGCCTGCCATCTGTG-3' | (SEQ ID NO: 2412) |
|  | 5'-AGACAUCACUGAGCCUGCCAUCUGUGC-3' | (SEQ ID NO: 6849) |
|  | 3'-UCUGUAGUGACUCGGACGGUAGACACG-5' | (SEQ ID NO: 1304) |
| βc-1668 Target: | 5'-AGACATCACTGAGCCTGCCATCTGTGC-3' | (SEQ ID NO: 2413) |
|  | 5'-GACAUCACUGAGCCUGCCAUCUGUGCU-3' | (SEQ ID NO: 6850) |
|  | 3'-CUGUAGUGACUCGGACGGUAGACACGA-5' | (SEQ ID NO: 1305) |
| βc-1669 Target: | 5'-GACATCACTGAGCCTGCCATCTGTGCT-3' | (SEQ ID NO: 2414) |
|  | 5'-ACAUCACUGAGCCUGCCAUCUGUGCUC-3' | (SEQ ID NO: 6851) |
|  | 3'-UGUAGUGACUCGGACGGUAGACACGAG-5' | (SEQ ID NO: 1306) |
| βc-1670 Target: | 5'-ACATCACTGAGCCTGCCATCTGTGCTC-3' | (SEQ ID NO: 2415) |
|  | 5'-CAUCACUGAGCCUGCCAUCUGUGCUCU-3' | (SEQ ID NO: 6852) |
|  | 3'-GUAGUGACUCGGACGGUAGACACGAGA-5' | (SEQ ID NO: 1307) |
| βc-1671 Target: | 5'-CATCACTGAGCCTGCCATCTGTGCTCT-3' | (SEQ ID NO: 2416) |
|  | 5'-AUCACUGAGCCUGCCAUCUGUGCUCUU-3' | (SEQ ID NO: 6853) |
|  | 3'-UAGUGACUCGGACGGUAGACACGAGAA-5' | (SEQ ID NO: 1308) |
| βc-1672 Target: | 5'-ATCACTGAGCCTGCCATCTGTGCTCTT-3' | (SEQ ID NO: 2417) |
|  | 5'-UCACUGAGCCUGCCAUCUGUGCUCUUC-3' | (SEQ ID NO: 6854) |
|  | 3'-AGUGACUCGGACGGUAGACACGAGAAG-5' | (SEQ ID NO: 1309) |
| βc-1673 Target: | 5'-TCACTGAGCCTGCCATCTGTGCTCTTC-3' | (SEQ ID NO: 2418) |
|  | 5'-CACUGAGCCUGCCAUCUGUGCUCUUCG-3' | (SEQ ID NO: 6855) |
|  | 3'-GUGACUCGGACGGUAGACACGAGAAGC-5' | (SEQ ID NO: 1310) |
| βc-1674 Target: | 5'-CACTGAGCCTGCCATCTGTGCTCTTCG-3' | (SEQ ID NO: 2419) |
|  | 5'-ACUGAGCCUGCCAUCUGUGCUCUUCGU-3' | (SEQ ID NO: 6856) |
|  | 3'-UGACUCGGACGGUAGACACGAGAAGCA-5' | (SEQ ID NO: 1311) |
| βc-1675 Target: | 5'-ACTGAGCCTGCCATCTGTGCTCTTCGT-3' | (SEQ ID NO: 2420) |

TABLE 8-continued

Selected Anti-β-catenin DsiRNA Agents, Blunt Duplexes

```
                   5'-CUGAGCCUGCCAUCUGUGCUCUUCGUC-3'   (SEQ ID NO: 6857)
                   3'-GACUCGGACGGUAGACACGAGAAGCAG-5'   (SEQ ID NO: 1312)
βc-1676 Target:    5'-CTGAGCCTGCCATCTGTGCTCTTCGTC-3'   (SEQ ID NO: 2421)
                   5'-UGAGCCUGCCAUCUGUGCUCUUCGUCA-3'  (SEQ ID NO: 6858)
                   3'-ACUCGGACGGUAGACACGAGAAGCAGU-5'  (SEQ ID NO: 1313)
βc-1677 Target:    5'-TGAGCCTGCCATCTGTGCTCTTCGTCA-3'   (SEQ ID NO: 2422)
                   5'-GAGCCUGCCAUCUGUGCUCUUCGUCAU-3'  (SEQ ID NO: 6859)
                   3'-CUCGGACGGUAGACACGAGAAGCAGUA-5'  (SEQ ID NO: 1314)
βc-1678 Target:    5'-GAGCCTGCCATCTGTGCTCTTCGTC-3'    (SEQ ID NO: 2423)
                   5'-AGCCUGCCAUCUGUGCUCUUCGUCAUC-3'  (SEQ ID NO: 6860)
                   3'-UCGGACGGUAGACACGAGAAGCAGUAG-5'  (SEQ ID NO: 1315)
βc-1679 Target:    5'-AGCCTGCCATCTGTGCTCTTCGTCATC-3'  (SEQ ID NO: 2424)
                   5'-GCCUGCCAUCUGUGCUCUUCGUCAUCU-3'  (SEQ ID NO: 6861)
                   3'-CGGACGGUAGACACGAGAAGCAGUAGA-5'  (SEQ ID NO: 1316)
βc-1680 Target:    5'-GCCTGCCATCTGTGCTCTTCGTCATCT-3'  (SEQ ID NO: 2425)
                   5'-CCUGCCAUCUGUGCUCUUCGUCAUCUG-3'  (SEQ ID NO: 6862)
                   3'-GGACGGUAGACACGAGAAGCAGUAGAC-5'  (SEQ ID NO: 1317)
βc-1681 Target:    5'-CCTGCCATCTGTGCTCTTCGTCATCTG-3'  (SEQ ID NO: 2426)
                   5'-CUGCCAUCUGUGCUCUUCGUCAUCUGA-3'  (SEQ ID NO: 6863)
                   3'-GACGGUAGACACGAGAAGCAGUAGACU-5'  (SEQ ID NO: 1318)
βc-1682 Target:    5'-CTGCCATCTGTGCTCTTCGTCATCTGA-3'  (SEQ ID NO: 2427)
                   5'-UGCCAUCUGUGCUCUUCGUCAUCUGAC-3'  (SEQ ID NO: 6864)
                   3'-ACGGUAGACACGAGAAGCAGUAGACUG-5'  (SEQ ID NO: 1319)
βc-1683 Target:    5'-TGCCATCTGTGCTCTTCGTCATCTGAC-3'  (SEQ ID NO: 2428)
                   5'-GCCAUCUGUGCUCUUCGUCAUCUGACC-3'  (SEQ ID NO: 6865)
                   3'-CGGUAGACACGAGAAGCAGUAGACUGG-5'  (SEQ ID NO: 1320)
βc-1684 Target:    5'-GCCATCTGTGCTCTTCGTCATCTGACC-3'  (SEQ ID NO: 2429)
                   5'-CCAUCUGUGCUCUUCGUCAUCUGACCA-3'  (SEQ ID NO: 6866)
                   3'-GGUAGACACGAGAAGCAGUAGACUGGU-5'  (SEQ ID NO: 1321)
βc-1685 Target:    5'-CCATCTGTGCTCTTCGTCATCTGACCA-3'  (SEQ ID NO: 2430)
                   5'-CAUCUGUGCUCUUCGUCAUCUGACCAG-3'  (SEQ ID NO: 6867)
                   3'-GUAGACACGAGAAGCAGUAGACUGGUC-5'  (SEQ ID NO: 1322)
βc-1686 Target:    5'-CATCTGTGCTCTTCGTCATCTGACCAG-3'  (SEQ ID NO: 2431)
                   5'-AUCUGUGCUCUUCGUCAUCUGACCAGC-3'  (SEQ ID NO: 6868)
                   3'-UAGACACGAGAAGCAGUAGACUGGUCG-5'  (SEQ ID NO: 1323)
βc-1687 Target:    5'-ATCTGTGCTCTTCGTCATCTGACCAGC-3'  (SEQ ID NO: 2432)
                   5'-UCUGUGCUCUUCGUCAUCUGACCAGCC-3'  (SEQ ID NO: 6869)
                   3'-AGACACGAGAAGCAGUAGACUGGUCGG-5'  (SEQ ID NO: 1324)
βc-1688 Target:    5'-TCTGTGCTCTTCGTCATCTGACCAGCC-3'  (SEQ ID NO: 2433)
```

TABLE 8-continued

Selected Anti-β-catenin DsiRNA Agents, Blunt Duplexes

|  |  |  |
|---|---|---|
|  | 5'-CUGUGCUCUUCGUCAUCUGACCAGCCG-3' | (SEQ ID NO: 6870) |
|  | 3'-GACACGAGAAGCAGUAGACUGGUCGGC-5' | (SEQ ID NO: 1325) |
| βc-1689 Target: | 5'-CTGTGCTCTTCGTCATCTGACCAGCCG-3' | (SEQ ID NO: 2434) |
|  | 5'-UGUGCUCUUCGUCAUCUGACCAGCCGA-3' | (SEQ ID NO: 6871) |
|  | 3'-ACACGAGAAGCAGUAGACUGGUCGGCU-5' | (SEQ ID NO: 1326) |
| βc-1690 Target: | 5'-TGTGCTCTTCGTCATCTGACCAGCCGA-3' | (SEQ ID NO: 2435) |
|  | 5'-GUGCUCUUCGUCAUCUGACCAGCCGAC-3' | (SEQ ID NO: 6872) |
|  | 3'-CACGAGAAGCAGUAGACUGGUCGGCUG-5' | (SEQ ID NO: 1327) |
| βc-1691 Target: | 5'-GTGCTCTTCGTCATCTGACCAGCCGAC-3' | (SEQ ID NO: 2436) |
|  | 5'-UGCUCUUCGUCAUCUGACCAGCCGACA-3' | (SEQ ID NO: 6873) |
|  | 3'-ACGAGAAGCAGUAGACUGGUCGGCUGU-5' | (SEQ ID NO: 1328) |
| βc-1692 Target: | 5'-TGCTCTTCGTCATCTGACCAGCCGACA-3' | (SEQ ID NO: 2437) |
|  | 5'-GCUCUUCGUCAUCUGACCAGCCGACAC-3' | (SEQ ID NO: 6874) |
|  | 3'-CGAGAAGCAGUAGACUGGUCGGCUGUG-5' | (SEQ ID NO: 1329) |
| βc-1693 Target: | 5'-GCTCTTCGTCATCTGACCAGCCGACAC-3' | (SEQ ID NO: 2438) |
|  | 5'-CUCUUCGUCAUCUGACCAGCCGACACC-3' | (SEQ ID NO: 6875) |
|  | 3'-GAGAAGCAGUAGACUGGUCGGCUGUGG-5' | (SEQ ID NO: 1330) |
| βc-1694 Target: | 5'-CTCTTCGTCATCTGACCAGCCGACACC-3' | (SEQ ID NO: 2439) |
|  | 5'-UCUUCGUCAUCUGACCAGCCGACACCA-3' | (SEQ ID NO: 6876) |
|  | 3'-AGAAGCAGUAGACUGGUCGGCUGUGGU-5' | (SEQ ID NO: 1331) |
| βc-1695 Target: | 5'-TCTTCGTCATCTGACCAGCCGACACCA-3' | (SEQ ID NO: 2440) |
|  | 5'-UACACCCACCAUCCCACUGGCCUCUGA-3' | (SEQ ID NO: 6877) |
|  | 3'-AUGUGGGUGGUAGGGUGACCGGAGACU-5' | (SEQ ID NO: 1332) |
| βc-1787 Target: | 5'-TACACCCACCATCCCACTGGCCTCTGA-3' | (SEQ ID NO: 2441) |
|  | 5'-ACACCCACCAUCCCACUGGCCUCUGAU-3' | (SEQ ID NO: 6878) |
|  | 3'-UGUGGGUGGUAGGGUGACCGGAGACUA-5' | (SEQ ID NO: 1333) |
| βc-1788 Target: | 5'-ACACCCACCATCCCACTGGCCTCTGAT-3' | (SEQ ID NO: 2442) |
|  | 5'-CACCCACCAUCCCACUGGCCUCUGAUA-3' | (SEQ ID NO: 6879) |
|  | 3'-GUGGGUGGUAGGGUGACCGGAGACUAU-5' | (SEQ ID NO: 1334) |
| βc-1789 Target: | 5'-CACCCACCATCCCACTGGCCTCTGATA-3' | (SEQ ID NO: 2443) |
|  | 5'-ACCCACCAUCCCACUGGCCUCUGAUAA-3' | (SEQ ID NO: 6880) |
|  | 3'-UGGGUGGUAGGGUGACCGGAGACUAUU-5' | (SEQ ID NO: 1335) |
| βc-1790 Target: | 5'-ACCCACCATCCCACTGGCCTCTGATAA-3' | (SEQ ID NO: 2444) |
|  | 5'-CCCACCAUCCCACUGGCCUCUGAUAAA-3' | (SEQ ID NO: 6881) |
|  | 3'-GGGUGGUAGGGUGACCGGAGACUAUUU-5' | (SEQ ID NO: 1336) |
| βc-1791 Target: | 5'-CCCACCATCCCACTGGCCTCTGATAAA-3' | (SEQ ID NO: 2445) |
|  | 5'-CCACCAUCCCACUGGCCUCUGAUAAAG-3' | (SEQ ID NO: 6882) |
|  | 3'-GGUGGUAGGGUGACCGGAGACUAUUUC-5' | (SEQ ID NO: 1337) |
| βc-1792 Target: | 5'-CCACCATCCCACTGGCCTCTGATAAAG-3' | (SEQ ID NO: 2446) |

TABLE 8-continued

Selected Anti-β-catenin DsiRNA Agents, Blunt Duplexes

|  |  |  |  |
|---|---|---|---|
|  | 5'-CACCAUCCCACUGGCCUCUGAUAAAGG-3' | (SEQ ID NO: 6883) |
|  | 3'-GUGGUAGGGUGACCGGAGACUAUUUCC-5' | (SEQ ID NO: 1338) |
| βc-1793 Target: | 5'-CACCATCCCACTGGCCTCTGATAAAGG-3' | (SEQ ID NO: 2447) |
|  | 5'-ACCAUCCCACUGGCCUCUGAUAAAGGC-3' | (SEQ ID NO: 6884) |
|  | 3'-UGGUAGGGUGACCGGAGACUAUUUCCG-5' | (SEQ ID NO: 1339) |
| βc-1794 Target: | 5'-ACCATCCCACTGGCCTCTGATAAAGGC-3' | (SEQ ID NO: 2448) |
|  | 5'-CCAUCCCACUGGCCUCUGAUAAAGGCU-3' | (SEQ ID NO: 6885) |
|  | 3'-GGUAGGGUGACCGGAGACUAUUUCCGA-5' | (SEQ ID NO: 1340) |
| βc-1795 Target: | 5'-CCATCCCACTGGCCTCTGATAAAGGCT-3' | (SEQ ID NO: 2449) |
|  | 5'-CAUCCCACUGGCCUCUGAUAAAGGCUA-3' | (SEQ ID NO: 6886) |
|  | 3'-GUAGGGUGACCGGAGACUAUUUCCGAU-5' | (SEQ ID NO: 1341) |
| βc-1796 Target: | 5'-CATCCCACTGGCCTCTGATAAAGGCTA-3' | (SEQ ID NO: 2450) |
|  | 5'-AUCCCACUGGCCUCUGAUAAAGGCUAC-3' | (SEQ ID NO: 6887) |
|  | 3'-UAGGGUGACCGGAGACUAUUUCCGAUG-5' | (SEQ ID NO: 1342) |
| βc-1797 Target: | 5'-ATCCCACTGGCCTCTGATAAAGGCTAC-3' | (SEQ ID NO: 2451) |
|  | 5'-UCCCACUGGCCUCUGAUAAAGGCUACU-3' | (SEQ ID NO: 6888) |
|  | 3'-AGGGUGACCGGAGACUAUUUCCGAUGA-5' | (SEQ ID NO: 1343) |
| βc-1798 Target: | 5'-TCCCACTGGCCTCTGATAAAGGCTACT-3' | (SEQ ID NO: 2452) |
|  | 5'-CCCACUGGCCUCUGAUAAAGGCUACUG-3' | (SEQ ID NO: 6889) |
|  | 3'-GGGUGACCGGAGACUAUUUCCGAUGAC-5' | (SEQ ID NO: 1344) |
| βc-1799 Target: | 5'-CCCACTGGCCTCTGATAAAGGCTACTG-3' | (SEQ ID NO: 2453) |
|  | 5'-CCACUGGCCUCUGAUAAAGGCUACUGU-3' | (SEQ ID NO: 6890) |
|  | 3'-GGUGACCGGAGACUAUUUCCGAUGACA-5' | (SEQ ID NO: 1345) |
| βc-1800 Target: | 5'-CCACTGGCCTCTGATAAAGGCTACTGT-3' | (SEQ ID NO: 2454) |
|  | 5'-CUACUGUUGGAUUGAUUCGAAAUCUUG-3' | (SEQ ID NO: 6891) |
|  | 3'-GAUGACAACCUAACUAAGCUUUAGAAC-5' | (SEQ ID NO: 1346) |
| βc-1820 Target: | 5'-CTACTGTTGGATTGATTCGAAATCTTG-3' | (SEQ ID NO: 2455) |
|  | 5'-UACUGUUGGAUUGAUUCGAAAUCUUGC-3' | (SEQ ID NO: 6892) |
|  | 3'-AUGACAACCUAACUAAGCUUUAGAACG-5' | (SEQ ID NO: 1347) |
| βc-1821 Target: | 5'-TACTGTTGGATTGATTCGAAATCTTGC-3' | (SEQ ID NO: 2456) |
|  | 5'-UAAAUACCAUUCCAUUGUUUGUGCAGC-3' | (SEQ ID NO: 6893) |
|  | 3'-AUUUAUGGUAAGGUAACAAACACGUCG-5' | (SEQ ID NO: 1348) |
| βc-2072 Target: | 5'-TAAATACCATTCCATTGTTTGTGCAGC-3' | (SEQ ID NO: 2457) |
|  | 5'-AAAUACCAUUCCAUUGUUUGUGCAGCU-3' | (SEQ ID NO: 6894) |
|  | 3'-UUUAUGGUAAGGUAACAAACACGUCGA-5' | (SEQ ID NO: 1349) |
| βc-2073 Target: | 5'-AAATACCATTCCATTGTTTGTGCAGCT-3' | (SEQ ID NO: 2458) |
|  | 5'-AAUACCAUUCCAUUGUUUGUGCAGCUG-3' | (SEQ ID NO: 6895) |
|  | 3'-UUAUGGUAAGGUAACAAACACGUCGAC-5' | (SEQ ID NO: 1350) |
| βc-2074 Target: | 5'-AATACCATTCCATTGTTTGTGCAGCTG-3' | (SEQ ID NO: 2459) |

TABLE 8-continued

Selected Anti-β-catenin DsiRNA Agents, Blunt Duplexes

|  |  |  |  |
|---|---|---|---|
|  | 5'-AUACCAUUCCAUUGUUUGUGCAGCUGC-3' | (SEQ ID NO: 6896) |
|  | 3'-UAUGGUAAGGUAACAAACACGUCGACG-5' | (SEQ ID NO: 1351) |
| βc-2075 Target: | 5'-ATACCATTCCATTGTTTGTGCAGCTGC-3' | (SEQ ID NO: 2460) |
|  | 5'-UACCAUUCCAUUGUUUGUGCAGCUGCU-3' | (SEQ ID NO: 6897) |
|  | 3'-AUGGUAAGGUAACAAACACGUCGACGA-5' | (SEQ ID NO: 1352) |
| βc-2076 Target: | 5'-TACCATTCCATTGTTTGTGCAGCTGCT-3' | (SEQ ID NO: 2461) |
|  | 5'-ACCAUUCCAUUGUUUGUGCAGCUGCUU-3' | (SEQ ID NO: 6898) |
|  | 3'-UGGUAAGGUAACAAACACGUCGACGAA-5' | (SEQ ID NO: 1353) |
| βc-2077 Target: | 5'-ACCATTCCATTGTTTGTGCAGCTGCTT-3' | (SEQ ID NO: 2462) |
|  | 5'-GCUGCUUUAUUCUCCCAUUGAAAACAU-3' | (SEQ ID NO: 6899) |
|  | 3'-CGACGAAAUAAGAGGGUAACUUUUGUA-5' | (SEQ ID NO: 1354) |
| βc-2097 Target: | 5'-GCTGCTTTATTCTCCCATTGAAAAC-3' | (SEQ ID NO: 2463) |
|  | 5'-CUGCUUUAUUCUCCCAUUGAAAACAUC-3' | (SEQ ID NO: 6900) |
|  | 3'-GACGAAAUAAGAGGGUAACUUUUGUAG-5' | (SEQ ID NO: 1355) |
| βc-2098 Target: | 5'-CTGCTTTATTCTCCCATTGAAAACATC-3' | (SEQ ID NO: 2464) |
|  | 5'-UGCUUUAUUCUCCCAUUGAAAACAUCC-3' | (SEQ ID NO: 6901) |
|  | 3'-ACGAAAUAAGAGGGUAACUUUUGUAGG-5' | (SEQ ID NO: 1356) |
| βc-2099 Target: | 5'-TGCTTTATTCTCCCATTGAAAACATCC-3' | (SEQ ID NO: 2465) |
|  | 5'-GCUUUAUUCUCCCAUUGAAAACAUCCA-3' | (SEQ ID NO: 6902) |
|  | 3'-CGAAAUAAGAGGGUAACUUUUGUAGGU-5' | (SEQ ID NO: 1357) |
| βc-2100 Target: | 5'-GCTTTATTCTCCCATTGAAAACATCCA-3' | (SEQ ID NO: 2466) |
|  | 5'-GGGUCCUCUGUGAACUUGCUCAGGACA-3' | (SEQ ID NO: 6903) |
|  | 3'-CCCAGGAGACACUUGAACGAGUCCUGU-5' | (SEQ ID NO: 1358) |
| βc-2141 Target: | 5'-GGGTCCTCTGTGAACTTGCTCAGGACA-3' | (SEQ ID NO: 2467) |
|  | 5'-GGUCCUCUGUGAACUUGCUCAGGACAA-3' | (SEQ ID NO: 6904) |
|  | 3'-CCAGGAGACACUUGAACGAGUCCUGUU-5' | (SEQ ID NO: 1359) |
| βc-2142 Target: | 5'-GGTCCTCTGTGAACTTGCTCAGGACAA-3' | (SEQ ID NO: 2468) |
|  | 5'-GUCCUCUGUGAACUUGCUCAGGACAAG-3' | (SEQ ID NO: 6905) |
|  | 3'-CAGGAGACACUUGAACGAGUCCUGUUC-5' | (SEQ ID NO: 1360) |
| βc-2143 Target: | 5'-GTCCTCTGTGAACTTGCTCAGGACAAG-3' | (SEQ ID NO: 2469) |
|  | 5'-UCCUCUGUGAACUUGCUCAGGACAAGG-3' | (SEQ ID NO: 6906) |
|  | 3'-AGGAGACACUUGAACGAGUCCUGUUCC-5' | (SEQ ID NO: 1361) |
| βc-2144 Target: | 5'-TCCTCTGTGAACTTGCTCAGGACAAGG-3' | (SEQ ID NO: 2470) |
|  | 5'-CCUCUGUGAACUUGCUCAGGACAAGGA-3' | (SEQ ID NO: 6907) |
|  | 3'-GGAGACACUUGAACGAGUCCUGUUCCU-5' | (SEQ ID NO: 1362) |
| βc-2145 Target: | 5'-CCTCTGTGAACTTGCTCAGGACAAGGA-3' | (SEQ ID NO: 2471) |
|  | 5'-CUCUGUGAACUUGCUCAGGACAAGGAA-3' | (SEQ ID NO: 6908) |
|  | 3'-GAGACACUUGAACGAGUCCUGUUCCUU-5' | (SEQ ID NO: 1363) |
| βc-2146 Target: | 5'-CTCTGTGAACTTGCTCAGGACAAGGAA-3' | (SEQ ID NO: 2472) |

TABLE 8-continued

Selected Anti-β-catenin DsiRNA Agents, Blunt Duplexes

|  |  |  |  |
|---|---|---|---|
|  | 5'-UCUGUGAACUUGCUCAGGACAAGGAAG-3' | (SEQ ID NO: 6909) |
|  | 3'-AGACACUUGAACGAGUCCUGUUCCUUC-5' | (SEQ ID NO: 1364) |
| βc-2147 Target: | 5'-TCTGTGAACTTGCTCAGGACAAGGAAG-3' | (SEQ ID NO: 2473) |
|  | 5'-CUGUGAACUUGCUCAGGACAAGGAAGC-3' | (SEQ ID NO: 6910) |
|  | 3'-GACACUUGAACGAGUCCUGUUCCUUCG-5' | (SEQ ID NO: 1365) |
| βc-2148 Target: | 5'-CTGTGAACTTGCTCAGGACAAGGAAGC-3' | (SEQ ID NO: 2474) |
|  | 5'-UGUGAACUUGCUCAGGACAAGGAAGCU-3' | (SEQ ID NO: 6911) |
|  | 3'-ACACUUGAACGAGUCCUGUUCCUUCGA-5' | (SEQ ID NO: 1366) |
| βc-2149 Target: | 5'-TGTGAACTTGCTCAGGACAAGGAAGCT-3' | (SEQ ID NO: 2475) |
|  | 5'-GUGAACUUGCUCAGGACAAGGAAGCUG-3' | (SEQ ID NO: 6912) |
|  | 3'-CACUUGAACGAGUCCUGUUCCUUCGAC-5' | (SEQ ID NO: 1367) |
| βc-2150 Target: | 5'-GTGAACTTGCTCAGGACAAGGAAGCTG-3' | (SEQ ID NO: 2476) |
|  | 5'-UGAACUUGCUCAGGACAAGGAAGCUGC-3' | (SEQ ID NO: 6913) |
|  | 3'-ACUUGAACGAGUCCUGUUCCUUCGACG-5' | (SEQ ID NO: 1368) |
| βc-2151 Target: | 5'-TGAACTTGCTCAGGACAAGGAAGCTGC-3' | (SEQ ID NO: 2477) |
|  | 5'-CUAUUGAAGCUGAGGGAGCCACAGCUC-3' | (SEQ ID NO: 6914) |
|  | 3'-GAUAACUUCGACUCCCUCGGUGUCGAG-5' | (SEQ ID NO: 1369) |
| βc-2183 Target: | 5'-CTATTGAAGCTGAGGGAGCCACAGCTC-3' | (SEQ ID NO: 2478) |
|  | 5'-UAUUGAAGCUGAGGGAGCCACAGCUCC-3' | (SEQ ID NO: 6915) |
|  | 3'-AUAACUUCGACUCCCUCGGUGUCGAGG-5' | (SEQ ID NO: 1370) |
| βc-2184 Target: | 5'-TATTGAAGCTGAGGGAGCCACAGCTCC-3' | (SEQ ID NO: 2479) |
|  | 5'-AUUGAAGCUGAGGGAGCCACAGCUCCU-3' | (SEQ ID NO: 6916) |
|  | 3'-UAACUUCGACUCCCUCGGUGUCGAGGA-5' | (SEQ ID NO: 1371) |
| βc-2185 Target: | 5'-ATTGAAGCTGAGGGAGCCACAGCTCCT-3' | (SEQ ID NO: 2480) |
|  | 5'-UGUUCCGAAUGUCUGAGGACAAGCCAC-3' | (SEQ ID NO: 6917) |
|  | 3'-ACAAGGCUUACAGACUCCUGUUCGGUG-5' | (SEQ ID NO: 1372) |
| βc-2270 Target: | 5'-TGTTCCGAATGTCTGAGGACAAGCCAC-3' | (SEQ ID NO: 2481) |
|  | 5'-GUUCCGAAUGUCUGAGGACAAGCCACA-3' | (SEQ ID NO: 6918) |
|  | 3'-CAAGGCUUACAGACUCCUGUUCGGUGU-5' | (SEQ ID NO: 1373) |
| βc-2271 Target: | 5'-GTTCCGAATGTCTGAGGACAAGCCACA-3' | (SEQ ID NO: 2482) |
|  | 5'-UUCCGAAUGUCUGAGGACAAGCCACAA-3' | (SEQ ID NO: 6919) |
|  | 3'-AAGGCUUACAGACUCCUGUUCGGUGUU-5' | (SEQ ID NO: 1374) |
| βc-2272 Target: | 5'-TTCCGAATGTCTGAGGACAAGCCACAA-3' | (SEQ ID NO: 2483) |
|  | 5'-UCCGAAUGUCUGAGGACAAGCCACAAG-3' | (SEQ ID NO: 6920) |
|  | 3'-AGGCUUACAGACUCCUGUUCGGUGUUC-5' | (SEQ ID NO: 1375) |
| βc-2273 Target: | 5'-TCCGAATGTCTGAGGACAAGCCACAAG-3' | (SEQ ID NO: 2484) |
|  | 5'-CCGAAUGUCUGAGGACAAGCCACAAGA-3' | (SEQ ID NO: 6921) |
|  | 3'-GGCUUACAGACUCCUGUUCGGUGUUCU-5' | (SEQ ID NO: 1376) |
| βc-2274 Target: | 5'-CCGAATGTCTGAGGACAAGCCACAAGA-3' | (SEQ ID NO: 2485) |

TABLE 8-continued

Selected Anti-β-catenin DsiRNA Agents, Blunt Duplexes

```
                   5'-CGAAUGUCUGAGGACAAGCCACAAGAU-3'   (SEQ ID NO: 6922)
                   3'-GCUUACAGACUCCUGUUCGGUGUUCUA-5'   (SEQ ID NO: 1377)
βc-2275 Target:    5'-CGAATGTCTGAGGACAAGCCACAAGAT-3'   (SEQ ID NO: 2486)
                   5'-GAAUGUCUGAGGACAAGCCACAAGAUU-3'   (SEQ ID NO: 6923)
                   3'-CUUACAGACUCCUGUUCGGUGUUCUAA-5'   (SEQ ID NO: 1378)
βc-2276 Target:    5'-GAATGTCTGAGGACAAGCCACAAGATT-3'   (SEQ ID NO: 2487)
                   5'-AAUGUCUGAGGACAAGCCACAAGAUUA-3'   (SEQ ID NO: 6924)
                   3'-UUACAGACUCCUGUUCGGUGUUCUAAU-5'   (SEQ ID NO: 1379)
βc-2277 Target:    5'-AATGTCTGAGGACAAGCCACAAGATTA-3'   (SEQ ID NO: 2488)
                   5'-GAACAGAGCCAAUGGCUUGGAAUGAGA-3'   (SEQ ID NO: 6925)
                   3'-CUUGUCUCGGUUACCGAACCUUACUCU-5'   (SEQ ID NO: 1380)
βc-2345 Target:    5'-GAACAGAGCCAATGGCTTGGAATGAGA-3'   (SEQ ID NO: 2489)
                   5'-AACAGAGCCAAUGGCUUGGAAUGAGAC-3'   (SEQ ID NO: 6926)
                   3'-UUGUCUCGGUUACCGAACCUUACUCUG-5'   (SEQ ID NO: 1381)
βc-2346 Target:    5'-AACAGAGCCAATGGCTTGGAATGAGAC-3'   (SEQ ID NO: 2490)
                   5'-ACAGAGCCAAUGGCUUGGAAUGAGACU-3'   (SEQ ID NO: 6927)
                   3'-UGUCUCGGUUACCGAACCUUACUCUGA-5'   (SEQ ID NO: 1382)
βc-2347 Target:    5'-ACAGAGCCAATGGCTTGGAATGAGACT-3'   (SEQ ID NO: 2491)
                   5'-CAGAGCCAAUGGCUUGGAAUGAGACUG-3'   (SEQ ID NO: 6928)
                   3'-GUCUCGGUUACCGAACCUUACUCUGAC-5'   (SEQ ID NO: 1383)
βc-2348 Target:    5'-CAGAGCCAATGGCTTGGAATGAGACTG-3'   (SEQ ID NO: 2492)
                   5'-AGAGCCAAUGGCUUGGAAUGAGACUGC-3'   (SEQ ID NO: 6929)
                   3'-UCUCGGUUACCGAACCUUACUCUGACG-5'   (SEQ ID NO: 1384)
βc-2349 Target:    5'-AGAGCCAATGGCTTGGAATGAGACTGC-3'   (SEQ ID NO: 2493)
                   5'-GAGCCAAUGGCUUGGAAUGAGACUGCU-3'   (SEQ ID NO: 6930)
                   3'-CUCGGUUACCGAACCUUACUCUGACGA-5'   (SEQ ID NO: 1385)
βc-2350 Target:    5'-GAGCCAATGGCTTGGAATGAGACTGCT-3'   (SEQ ID NO: 2494)
                   5'-AGCCAAUGGCUUGGAAUGAGACUGCUG-3'   (SEQ ID NO: 6931)
                   3'-UCGGUUACCGAACCUUACUCUGACGAC-5'   (SEQ ID NO: 1386)
βc-2351 Target:    5'-AGCCAATGGCTTGGAATGAGACTGCTG-3'   (SEQ ID NO: 2495)
                   5'-GCCAAUGGCUUGGAAUGAGACUGCUGA-3'   (SEQ ID NO: 6932)
                   3'-CGGUUACCGAACCUUACUCUGACGACU-5'   (SEQ ID NO: 1387)
βc-2352 Target:    5'-GCCAATGGCTTGGAATGAGACTGCTGA-3'   (SEQ ID NO: 2496)
                   5'-CCAAUGGCUUGGAAUGAGACUGCUGAU-3'   (SEQ ID NO: 6933)
                   3'-GGUUACCGAACCUUACUCUGACGACUA-5'   (SEQ ID NO: 1388)
βc-2353 Target:    5'-CCAATGGCTTGGAATGAGACTGCTGAT-3'   (SEQ ID NO: 2497)
                   5'-CAAUGGCUUGGAAUGAGACUGCUGAUC-3'   (SEQ ID NO: 6934)
                   3'-GUUACCGAACCUUACUCUGACGACUAG-5'   (SEQ ID NO: 1389)
βc-2354 Target:    5'-CAATGGCTTGGAATGAGACTGCTGATC-3'   (SEQ ID NO: 2498)
```

TABLE 8-continued

Selected Anti-β-catenin DsiRNA Agents, Blunt Duplexes

|  |  |  |  |
|---|---|---|---|
|  | 5'-AAUGGCUUGGAAUGAGACUGCUGAUCU-3' | (SEQ ID NO: 6935) |
|  | 3'-UUACCGAACCUUACUCUGACGACUAGA-5' | (SEQ ID NO: 1390) |
| βc-2355 Target: | 5'-AATGGCTTGGAATGAGACTGCTGATCT-3' | (SEQ ID NO: 2499) |
|  | 5'-CCCUUGGAUAUCGCCAGGAUGAUCCUA-3' | (SEQ ID NO: 6936) |
|  | 3'-GGGAACCUAUAGCGGUCCUACUAGGAU-5' | (SEQ ID NO: 1391) |
| βc-2411 Target: | 5'-CCCTTGGATATCGCCAGGATGATCCTA-3' | (SEQ ID NO: 2500) |
|  | 5'-CCUUGGAUAUCGCCAGGAUGAUCCUAG-3' | (SEQ ID NO: 6937) |
|  | 3'-GGAACCUAUAGCGGUCCUACUAGGAUC-5' | (SEQ ID NO: 1392) |
| βc-2412 Target: | 5'-CCTTGGATATCGCCAGGATGATCCTAG-3' | (SEQ ID NO: 2501) |
|  | 5'-CUUGGAUAUCGCCAGGAUGAUCCUAGC-3' | (SEQ ID NO: 6938) |
|  | 3'-GAACCUAUAGCGGUCCUACUAGGAUCG-5' | (SEQ ID NO: 1393) |
| βc-2413 Target: | 5'-CTTGGATATCGCCAGGATGATCCTAGC-3' | (SEQ ID NO: 2502) |
|  | 5'-UUGGAUAUCGCCAGGAUGAUCCUAGCU-3' | (SEQ ID NO: 6939) |
|  | 3'-AACCUAUAGCGGUCCUACUAGGAUCGA-5' | (SEQ ID NO: 1394) |
| βc-2414 Target: | 5'-TTGGATATCGCCAGGATGATCCTAGCT-3' | (SEQ ID NO: 2503) |
|  | 5'-UGGAUAUCGCCAGGAUGAUCCUAGCUA-3' | (SEQ ID NO: 6940) |
|  | 3'-ACCUAUAGCGGUCCUACUAGGAUCGAU-5' | (SEQ ID NO: 1395) |
| βc-2415 Target: | 5'-TGGATATCGCCAGGATGATCCTAGCTA-3' | (SEQ ID NO: 2504) |
|  | 5'-AUCGUUCUUUUCACUCUGGUGGAUAUG-3' | (SEQ ID NO: 6941) |
|  | 3'-UAGCAAGAAAAGUGAGACCACCUAUAC-5' | (SEQ ID NO: 1396) |
| βc-2441 Target: | 5'-ATCGTTCTTTTCACTCTGGTGGATATG-3' | (SEQ ID NO: 2505) |
|  | 5'-UCGUUCUUUUCACUCUGGUGGAUAUGG-3' | (SEQ ID NO: 6942) |
|  | 3'-AGCAAGAAAAGUGAGACCACCUAUACC-5' | (SEQ ID NO: 1397) |
| βc-2442 Target: | 5'-TCGTTCTTTTCACTCTGGTGGATATGG-3' | (SEQ ID NO: 2506) |
|  | 5'-CGUUCUUUUCACUCUGGUGGAUAUGGC-3' | (SEQ ID NO: 6943) |
|  | 3'-GCAAGAAAAGUGAGACCACCUAUACCG-5' | (SEQ ID NO: 1398) |
| βc-2443 Target: | 5'-CGTTCTTTTCACTCTGGTGGATATGGC-3' | (SEQ ID NO: 2507) |
|  | 5'-GUUCUUUUCACUCUGGUGGAUAUGGCC-3' | (SEQ ID NO: 6944) |
|  | 3'-CAAGAAAAGUGAGACCACCUAUACCGG-5' | (SEQ ID NO: 1399) |
| βc-2444 Target: | 5'-GTTCTTTTCACTCTGGTGGATATGGCC-3' | (SEQ ID NO: 2508) |
|  | 5'-UUCUUUUCACUCUGGUGGAUAUGGCCA-3' | (SEQ ID NO: 6945) |
|  | 3'-AAGAAAAGUGAGACCACCUAUACCGGU-5' | (SEQ ID NO: 1400) |
| βc-2445 Target: | 5'-TTCTTTTCACTCTGGTGGATATGGCCA-3' | (SEQ ID NO: 2509) |
|  | 5'-AACAUGAGAUGGGUGGCCACCACCCUG-3' | (SEQ ID NO: 6946) |
|  | 3'-UUGUACUCUACCCACCGGUGGUGGGAC-5' | (SEQ ID NO: 1401) |
| βc-2501 Target: | 5'-AACATGAGATGGGTGGCCACCACCCTG-3' | (SEQ ID NO: 2510) |
|  | 5'-ACAUGAGAUGGGUGGCCACCACCCUGG-3' | (SEQ ID NO: 6947) |
|  | 3'-UGUACUCUACCCACCGGUGGUGGGACC-5' | (SEQ ID NO: 1402) |
| βc-2502 Target: | 5'-ACATGAGATGGGTGGCCACCACCCTGG-3' | (SEQ ID NO: 2511) |

TABLE 8-continued

Selected Anti-β-catenin DsiRNA Agents, Blunt Duplexes

|  |  |  |  |
|---|---|---|---|
|  | 5'-CAUGAGAUGGGUGGCCACCACCCUGGU-3' | (SEQ ID NO: 6948) |  |
|  | 3'-GUACUCUACCCACCGGUGGUGGGACCA-5' | (SEQ ID NO: 1403) |  |
| βc-2503 Target: | 5'-CATGAGATGGGTGGCCACCACCCTGGT-3' | (SEQ ID NO: 2512) |  |
|  | 5'-AUGAGAUGGGUGGCCACCACCCUGGUG-3' | (SEQ ID NO: 6949) |  |
|  | 3'-UACUCUACCCACCGGUGGUGGGACCAC-5' | (SEQ ID NO: 1404) |  |
| βc-2504 Target: | 5'-ATGAGATGGGTGGCCACCACCCTGGTG-3' | (SEQ ID NO: 2513) |  |
|  | 5'-UGAGAUGGGUGGCCACCACCCUGGUGC-3' | (SEQ ID NO: 6950) |  |
|  | 3'-ACUCUACCCACCGGUGGUGGGACCACG-5' | (SEQ ID NO: 1405) |  |
| βc-2505 Target: | 5'-TGAGATGGGTGGCCACCACCCTGGTGC-3' | (SEQ ID NO: 2514) |  |
|  | 5'-GAGAUGGGUGGCCACCACCCUGGUGCU-3' | (SEQ ID NO: 6951) |  |
|  | 3'-CUCUACCCACCGGUGGUGGGACCACGA-5' | (SEQ ID NO: 1406) |  |
| βc-2506 Target: | 5'-GAGATGGGTGGCCACCACCCTGGTGCT-3' | (SEQ ID NO: 2515) |  |
|  | 5'-AGAUGGGUGGCCACCACCCUGGUGCUG-3' | (SEQ ID NO: 6952) |  |
|  | 3'-UCUACCCACCGGUGGUGGGACCACGAC-5' | (SEQ ID NO: 1407) |  |
| βc-2507 Target: | 5'-AGATGGGTGGCCACCACCCTGGTGCTG-3' | (SEQ ID NO: 2516) |  |
|  | 5'-GAUGGGUGGCCACCACCCUGGUGCUGA-3' | (SEQ ID NO: 6953) |  |
|  | 3'-CUACCCACCGGUGGUGGGACCACGACU-5' | (SEQ ID NO: 1408) |  |
| βc-2508 Target: | 5'-GATGGGTGGCCACCACCCTGGTGCTGA-3' | (SEQ ID NO: 2517) |  |
|  | 5'-AUGGGUGGCCACCACCCUGGUGCUGAC-3' | (SEQ ID NO: 6954) |  |
|  | 3'-UACCCACCGGUGGUGGGACCACGACUG-5' | (SEQ ID NO: 1409) |  |
| βc-2509 Target: | 5'-ATGGGTGGCCACCACCCTGGTGCTGAC-3' | (SEQ ID NO: 2518) |  |
|  | 5'-UGGGUGGCCACCACCCUGGUGCUGACU-3' | (SEQ ID NO: 6955) |  |
|  | 3'-ACCCACCGGUGGUGGGACCACGACUGA-5' | (SEQ ID NO: 1410) |  |
| βc-2510 Target: | 5'-TGGGTGGCCACCACCCTGGTGCTGACT-3' | (SEQ ID NO: 2519) |  |
|  | 5'-GGGUGGCCACCACCCUGGUGCUGACUA-3' | (SEQ ID NO: 6956) |  |
|  | 3'-CCCACCGGUGGUGGGACCACGACUGAU-5' | (SEQ ID NO: 1411) |  |
| βc-2511 Target: | 5'-GGGTGGCCACCACCCTGGTGCTGACTA-3' | (SEQ ID NO: 2520) |  |
|  | 5'-GGUGGCCACCACCCUGGUGCUGACUAU-3' | (SEQ ID NO: 6957) |  |
|  | 3'-CCACCGGUGGUGGGACCACGACUGAUA-5' | (SEQ ID NO: 1412) |  |
| βc-2512 Target: | 5'-GGTGGCCACCACCCTGGTGCTGACTAT-3' | (SEQ ID NO: 2521) |  |
|  | 5'-GUGGCCACCACCCUGGUGCUGACUAUC-3' | (SEQ ID NO: 6958) |  |
|  | 3'-CACCGGUGGUGGGACCACGACUGAUAG-5' | (SEQ ID NO: 1413) |  |
| βc-2513 Target: | 5'-GTGGCCACCACCCTGGTGCTGACTATC-3' | (SEQ ID NO: 2522) |  |
|  | 5'-UGGCCACCACCCUGGUGCUGACUAUCC-3' | (SEQ ID NO: 6959) |  |
|  | 3'-ACCGGUGGUGGGACCACGACUGAUAGG-5' | (SEQ ID NO: 1414) |  |
| βc-2514 Target: | 5'-TGGCCACCACCCTGGTGCTGACTATCC-3' | (SEQ ID NO: 2523) |  |
|  | 5'-GGCCACCACCCUGGUGCUGACUAUCCA-3' | (SEQ ID NO: 6960) |  |
|  | 3'-CCGGUGGUGGGACCACGACUGAUAGGU-5' | (SEQ ID NO: 1415) |  |
| βc-2515 Target: | 5'-GGCCACCACCCTGGTGCTGACTATCCA-3' | (SEQ ID NO: 2524) |  |

TABLE 8-continued

Selected Anti-β-catenin DsiRNA Agents, Blunt Duplexes

```
                   5'-GCCACCACCCUGGUGCUGACUAUCCAG-3'   (SEQ ID NO: 6961)
                   3'-CGGUGGUGGGACCACGACUGAUAGGUC-5'   (SEQ ID NO: 1416)
βc-2516 Target:    5'-GCCACCACCCTGGTGCTGACTATCCAG-3'   (SEQ ID NO: 2525)
                   5'-CCACCACCCUGGUGCUGACUAUCCAGU-3'   (SEQ ID NO: 6962)
                   3'-GGUGGUGGGACCACGACUGAUAGGUCA-5'   (SEQ ID NO: 1417)
βc-2517 Target:    5'-CCACCACCCTGGTGCTGACTATCCAGT-3'   (SEQ ID NO: 2526)
                   5'-CACCACCCUGGUGCUGACUAUCCAGUU-3'   (SEQ ID NO: 6963)
                   3'-GUGGUGGGACCACGACUGAUAGGUCAA-5'   (SEQ ID NO: 1418)
βc-2518 Target:    5'-CACCACCCTGGTGCTGACTATCCAGTT-3'   (SEQ ID NO: 2527)
                   5'-ACCACCCUGGUGCUGACUAUCCAGUUG-3'   (SEQ ID NO: 6964)
                   3'-UGGUGGGACCACGACUGAUAGGUCAAC-5'   (SEQ ID NO: 1419)
βc-2519 Target:    5'-ACCACCCTGGTGCTGACTATCCAGTTG-3'   (SEQ ID NO: 2528)
                   5'-CCACCCUGGUGCUGACUAUCCAGUUGA-3'   (SEQ ID NO: 6965)
                   3'-GGUGGGACCACGACUGAUAGGUCAACU-5'   (SEQ ID NO: 1420)
βc-2520 Target:    5'-CCACCCTGGTGCTGACTATCCAGTTGA-3'   (SEQ ID NO: 2529)
                   5'-CACCCUGGUGCUGACUAUCCAGUUGAU-3'   (SEQ ID NO: 6966)
                   3'-GUGGGACCACGACUGAUAGGUCAACUA-5'   (SEQ ID NO: 1421)
βc-2521 Target:    5'-CACCCTGGTGCTGACTATCCAGTTGAT-3'   (SEQ ID NO: 2530)
                   5'-ACCCUGGUGCUGACUAUCCAGUUGAUG-3'   (SEQ ID NO: 6967)
                   3'-UGGGACCACGACUGAUAGGUCAACUAC-5'   (SEQ ID NO: 1422)
βc-2522 Target:    5'-ACCCTGGTGCTGACTATCCAGTTGATG-3'   (SEQ ID NO: 2531)
                   5'-CCCUGGUGCUGACUAUCCAGUUGAUGG-3'   (SEQ ID NO: 6968)
                   3'-GGGACCACGACUGAUAGGUCAACUACC-5'   (SEQ ID NO: 1423)
βc-2523 Target:    5'-CCCTGGTGCTGACTATCCAGTTGATGG-3'   (SEQ ID NO: 2532)
                   5'-CCUGGUGCUGACUAUCCAGUUGAUGGG-3'   (SEQ ID NO: 6969)
                   3'-GGACCACGACUGAUAGGUCAACUACCC-5'   (SEQ ID NO: 1424)
βc-2524 Target:    5'-CCTGGTGCTGACTATCCAGTTGATGGG-3'   (SEQ ID NO: 2533)
                   5'-CUGGUGCUGACUAUCCAGUUGAUGGGC-3'   (SEQ ID NO: 6970)
                   3'-GACCACGACUGAUAGGUCAACUACCCG-5'   (SEQ ID NO: 1425)
βc-2525 Target:    5'-CTGGTGCTGACTATCCAGTTGATGGGC-3'   (SEQ ID NO: 2534)
                   5'-UGGUGCUGACUAUCCAGUUGAUGGGCU-3'   (SEQ ID NO: 6971)
                   3'-ACCACGACUGAUAGGUCAACUACCCGA-5'   (SEQ ID NO: 1426)
βc-2526 Target:    5'-TGGTGCTGACTATCCAGTTGATGGGCT-3'   (SEQ ID NO: 2535)
                   5'-GGUGCUGACUAUCCAGUUGAUGGGCUG-3'   (SEQ ID NO: 6972)
                   3'-CCACGACUGAUAGGUCAACUACCCGAC-5'   (SEQ ID NO: 1427)
βc-2527 Target:    5'-GGTGCTGACTATCCAGTTGATGGGCTG-3'   (SEQ ID NO: 2536)
                   5'-GUGCUGACUAUCCAGUUGAUGGGCUGC-3'   (SEQ ID NO: 6973)
                   3'-CACGACUGAUAGGUCAACUACCCGACG-5'   (SEQ ID NO: 1428)
βc-2528 Target:    5'-GTGCTGACTATCCAGTTGATGGGCTGC-3'   (SEQ ID NO: 2537)
```

TABLE 8-continued

Selected Anti-β-catenin DsiRNA Agents, Blunt Duplexes

|  |  |  |  |
|---|---|---|---|
|  | 5'-UGCUGACUAUCCAGUUGAUGGGCUGCC-3' | (SEQ ID NO: 6974) |
|  | 3'-ACGACUGAUAGGUCAACUACCCGACGG-5' | (SEQ ID NO: 1429) |
| βc-2529 Target: | 5'-TGCTGACTATCCAGTTGATGGGCTGCC-3' | (SEQ ID NO: 2538) |
|  | 5'-GCUGACUAUCCAGUUGAUGGGCUGCCA-3' | (SEQ ID NO: 6975) |
|  | 3'-CGACUGAUAGGUCAACUACCCGACGGU-5' | (SEQ ID NO: 1430) |
| βc-2530 Target: | 5'-GCTGACTATCCAGTTGATGGGCTGCCA-3' | (SEQ ID NO: 2539) |
|  | 5'-CUGACUAUCCAGUUGAUGGGCUGCCAG-3' | (SEQ ID NO: 6976) |
|  | 3'-GACUGAUAGGUCAACUACCCGACGGUC-5' | (SEQ ID NO: 1431) |
| βc-2531 Target: | 5'-CTGACTATCCAGTTGATGGGCTGCCAG-3' | (SEQ ID NO: 2540) |
|  | 5'-UGACUAUCCAGUUGAUGGGCUGCCAGA-3' | (SEQ ID NO: 6977) |
|  | 3'-ACUGAUAGGUCAACUACCCGACGGUCU-5' | (SEQ ID NO: 1432) |
| βc-2532 Target: | 5'-TGACTATCCAGTTGATGGGCTGCCAGA-3' | (SEQ ID NO: 2541) |
|  | 5'-GACUAUCCAGUUGAUGGGCUGCCAGAU-3' | (SEQ ID NO: 6978) |
|  | 3'-CUGAUAGGUCAACUACCCGACGGUCUA-5' | (SEQ ID NO: 1433) |
| βc-2533 Target: | 5'-GACTATCCAGTTGATGGGCTGCCAGAT-3' | (SEQ ID NO: 2542) |
|  | 5'-ACUAUCCAGUUGAUGGGCUGCCAGAUC-3' | (SEQ ID NO: 6979) |
|  | 3'-UGAUAGGUCAACUACCCGACGGUCUAG-5' | (SEQ ID NO: 1434) |
| βc-2534 Target: | 5'-ACTATCCAGTTGATGGGCTGCCAGATC-3' | (SEQ ID NO: 2543) |
|  | 5'-CUAUCCAGUUGAUGGGCUGCCAGAUCU-3' | (SEQ ID NO: 6980) |
|  | 3'-GAUAGGUCAACUACCCGACGGUCUAGA-5' | (SEQ ID NO: 1435) |
| βc-2535 Target: | 5'-CTATCCAGTTGATGGGCTGCCAGATCT-3' | (SEQ ID NO: 2544) |
|  | 5'-AUGCCCAGGACCUCAUGGAUGGGCUGC-3' | (SEQ ID NO: 6981) |
|  | 3'-UACGGGUCCUGGAGUACCUACCCGACG-5' | (SEQ ID NO: 1436) |
| βc-2567 Target: | 5'-ATGCCCAGGACCTCATGGATGGGCTGC-3' | (SEQ ID NO: 2545) |
|  | 5'-UGCCCAGGACCUCAUGGAUGGGCUGCC-3' | (SEQ ID NO: 6982) |
|  | 3'-ACGGGUCCUGGAGUACCUACCCGACGG-5' | (SEQ ID NO: 1437) |
| βc-2568 Target: | 5'-TGCCCAGGACCTCATGGATGGGCTGCC-3' | (SEQ ID NO: 2546) |
|  | 5'-GCCCAGGACCUCAUGGAUGGGCUGCCU-3' | (SEQ ID NO: 6983) |
|  | 3'-CGGGUCCUGGAGUACCUACCCGACGGA-5' | (SEQ ID NO: 1438) |
| βc-2569 Target: | 5'-GCCCAGGACCTCATGGATGGGCTGCCT-3' | (SEQ ID NO: 2547) |
|  | 5'-ACAGCAAUCAGCUGGCCUGGUUUGAUA-3' | (SEQ ID NO: 6984) |
|  | 3'-UGUCGUUAGUCGACCGGACCAAACUAU-5' | (SEQ ID NO: 1439) |
| βc-2603 Target: | 5'-ACAGCAATCAGCTGGCCTGGTTTGATA-3' | (SEQ ID NO: 2548) |
|  | 5'-CAGCAAUCAGCUGGCCUGGUUUGAUAC-3' | (SEQ ID NO: 6985) |
|  | 3'-GUCGUUAGUCGACCGGACCAAACUAUG-5' | (SEQ ID NO: 1440) |
| βc-2604 Target: | 5'-CAGCAATCAGCTGGCCTGGTTTGATAC-3' | (SEQ ID NO: 2549) |
|  | 5'-AGCAAUCAGCUGGCCUGGUUUGAUACU-3' | (SEQ ID NO: 6986) |
|  | 3'-UCGUUAGUCGACCGGACCAAACUAUGA-5' | (SEQ ID NO: 1441) |
| βc-2605 Target: | 5'-AGCAATCAGCTGGCCTGGTTTGATACT-3' | (SEQ ID NO: 2550) |

TABLE 8-continued

Selected Anti-β-catenin DsiRNA Agents, Blunt Duplexes

|  |  |  |  |
|---|---|---|---|
|  | 5'-GCAAUCAGCUGGCCUGGUUUGAUACUG-3' | (SEQ ID NO: 6987) |  |
|  | 3'-CGUUAGUCGACCGGACCAAACUAUGAC-5' | (SEQ ID NO: 1442) |  |
| βc-2606 Target: | 5'-GCAATCAGCTGGCCTGGTTTGATACTG-3' | (SEQ ID NO: 2551) |  |
|  | 5'-CAAUCAGCUGGCCUGGUUUGAUACUGA-3' | (SEQ ID NO: 6988) |  |
|  | 3'-GUUAGUCGACCGGACCAAACUAUGACU-5' | (SEQ ID NO: 1443) |  |
| βc-2607 Target: | 5'-CAATCAGCTGGCCTGGTTTGATACTGA-3' | (SEQ ID NO: 2552) |  |
|  | 5'-AAUCAGCUGGCCUGGUUUGAUACUGAC-3' | (SEQ ID NO: 6989) |  |
|  | 3'-UUAGUCGACCGGACCAAACUAUGACUG-5' | (SEQ ID NO: 1444) |  |
| βc-2608 Target: | 5'-AATCAGCTGGCCTGGTTTGATACTGAC-3' | (SEQ ID NO: 2553) |  |
|  | 5'-AUCAGCUGGCCUGGUUUGAUACUGACC-3' | (SEQ ID NO: 6990) |  |
|  | 3'-UAGUCGACCGGACCAAACUAUGACUGG-5' | (SEQ ID NO: 1445) |  |
| βc-2609 Target: | 5'-ATCAGCTGGCCTGGTTTGATACTGACC-3' | (SEQ ID NO: 2554) |  |
|  | 5'-UCAGCUGGCCUGGUUUGAUACUGACCU-3' | (SEQ ID NO: 6991) |  |
|  | 3'-AGUCGACCGGACCAAACUAUGACUGGA-5' | (SEQ ID NO: 1446) |  |
| βc-2610 Target: | 5'-TCAGCTGGCCTGGTTTGATACTGACCT-3' | (SEQ ID NO: 2555) |  |
|  | 5'-CAGCUGGCCUGGUUUGAUACUGACCUG-3' | (SEQ ID NO: 6992) |  |
|  | 3'-GUCGACCGGACCAAACUAUGACUGGAC-5' | (SEQ ID NO: 1447) |  |
| βc-2611 Target: | 5'-CAGCTGGCCTGGTTTGATACTGACCTG-3' | (SEQ ID NO: 2556) |  |
|  | 5'-AGCUGGCCUGGUUUGAUACUGACCUGU-3' | (SEQ ID NO: 6993) |  |
|  | 3'-UCGACCGGACCAAACUAUGACUGGACA-5' | (SEQ ID NO: 1448) |  |
| βc-2612 Target: | 5'-AGCTGGCCTGGTTTGATACTGACCTGT-3' | (SEQ ID NO: 2557) |  |
|  | 5'-GCUGGCCUGGUUUGAUACUGACCUGUA-3' | (SEQ ID NO: 6994) |  |
|  | 3'-CGACCGGACCAAACUAUGACUGGACAU-5' | (SEQ ID NO: 1449) |  |
| βc-2613 Target: | 5'-GCTGGCCTGGTTTGATACTGACCTGTA-3' | (SEQ ID NO: 2558) |  |
|  | 5'-CUGGCCUGGUUUGAUACUGACCUGUAA-3' | (SEQ ID NO: 6995) |  |
|  | 3'-GACCGGACCAAACUAUGACUGGACAUU-5' | (SEQ ID NO: 1450) |  |
| βc-2614 Target: | 5'-CTGGCCTGGTTTGATACTGACCTGTAA-3' | (SEQ ID NO: 2559) |  |
|  | 5'-UGGCCUGGUUUGAUACUGACCUGUAAA-3' | (SEQ ID NO: 6996) |  |
|  | 3'-ACCGGACCAAACUAUGACUGGACAUUU-5' | (SEQ ID NO: 1451) |  |
| βc-2615 Target: | 5'-TGGCCTGGTTTGATACTGACCTGTAAA-3' | (SEQ ID NO: 2560) |  |
|  | 5'-GGCCUGGUUUGAUACUGACCUGUAAAU-3' | (SEQ ID NO: 6997) |  |
|  | 3'-CCGGACCAAACUAUGACUGGACAUUUA-5' | (SEQ ID NO: 1452) |  |
| βc-2616 Target: | 5'-GGCCTGGTTTGATACTGACCTGTAAAT-3' | (SEQ ID NO: 2561) |  |
|  | 5'-GCCUGGUUUGAUACUGACCUGUAAAUC-3' | (SEQ ID NO: 6998) |  |
|  | 3'-CGGACCAAACUAUGACUGGACAUUUAG-5' | (SEQ ID NO: 1453) |  |
| βc-2617 Target: | 5'-GCCTGGTTTGATACTGACCTGTAAATC-3' | (SEQ ID NO: 2562) |  |
|  | 5'-CCUGGUUUGAUACUGACCUGUAAAUCA-3' | (SEQ ID NO: 6999) |  |
|  | 3'-GGACCAAACUAUGACUGGACAUUUAGU-5' | (SEQ ID NO: 1454) |  |
| βc-2618 Target: | 5'-CCTGGTTTGATACTGACCTGTAAATCA-3' | (SEQ ID NO: 2563) |  |

TABLE 8-continued

Selected Anti-β-catenin DsiRNA Agents, Blunt Duplexes

|  |  |  |
|---|---|---|
|  | 5'-CUGGUUUGAUACUGACCUGUAAAUCAU-3' | (SEQ ID NO: 7000) |
|  | 3'-GACCAAACUAUGACUGGACAUUUAGUA-5' | (SEQ ID NO: 1455) |
| βc-2619 Target: | 5'-CTGGTTTGATACTGACCTGTAAATC-3' | (SEQ ID NO: 2564) |
|  | 5'-UGGUUUGAUACUGACCUGUAAAUCAUC-3' | (SEQ ID NO: 7001) |
|  | 3'-ACCAAACUAUGACUGGACAUUUAGUAG-5' | (SEQ ID NO: 1456) |
| βc-2620 Target: | 5'-TGGTTTGATACTGACCTGTAAATCATC-3' | (SEQ ID NO: 2565) |
|  | 5'-GGUUUGAUACUGACCUGUAAAUCAUCC-3' | (SEQ ID NO: 7002) |
|  | 3'-CCAAACUAUGACUGGACAUUUAGUAGG-5' | (SEQ ID NO: 1457) |
| βc-2621 Target: | 5'-GGTTTGATACTGACCTGTAAATCATCC-3' | (SEQ ID NO: 2566) |
|  | 5'-GUUUGAUACUGACCUGUAAAUCAUCCU-3' | (SEQ ID NO: 7003) |
|  | 3'-CAAACUAUGACUGGACAUUUAGUAGGA-5' | (SEQ ID NO: 1458) |
| βc-2622 Target: | 5'-GTTTGATACTGACCTGTAAATCATCCT-3' | (SEQ ID NO: 2567) |
|  | 5'-UUUGAUACUGACCUGUAAAUCAUCCUU-3' | (SEQ ID NO: 7004) |
|  | 3'-AAACUAUGACUGGACAUUUAGUAGGAA-5' | (SEQ ID NO: 1459) |
| βc-2623 Target: | 5'-TTTGATACTGACCTGTAAATCATCCTT-3' | (SEQ ID NO: 2568) |
|  | 5'-UUUUUUGCCACAGCUUUUGCAACUUAA-3' | (SEQ ID NO: 7005) |
|  | 3'-AAAAAACGGUGUCGAAAACGUUGAAUU-5' | (SEQ ID NO: 1460) |
| βc-2869 Target: | 5'-TTTTTTGCCACAGCTTTTGCAACTTAA-3' | (SEQ ID NO: 2569) |
|  | 5'-AAUGAGUAACAUUUGCUGUUUUAAACA-3' | (SEQ ID NO: 7006) |
|  | 3'-UUACUCAUUGUAAACGACAAAAUUUGU-5' | (SEQ ID NO: 1461) |
| βc-2902 Target: | 5'-AATGAGTAACATTTGCTGTTTTAAACA-3' | (SEQ ID NO: 2570) |
|  | 5'-UAAACAUUAAUAGCAGCCUUUCUCUCU-3' | (SEQ ID NO: 7007) |
|  | 3'-AUUUGUAAUUAUCGUCGGAAAGAGAGA-5' | (SEQ ID NO: 1462) |
| βc-2923 Target: | 5'-TAAACATTAATAGCAGCCTTTCTCTCT-3' | (SEQ ID NO: 2571) |
|  | 5'-AACAUUAAUAGCAGCCUUUCUCUCUUU-3' | (SEQ ID NO: 7008) |
|  | 3'-UUGUAAUUAUCGUCGGAAAGAGAGAAA-5' | (SEQ ID NO: 1463) |
| βc-2925 Target: | 5'-AACATTAATAGCAGCCTTTCTCTCTTT-3' | (SEQ ID NO: 2572) |
|  | 5'-CAUUAAUAGCAGCCUUUCUCUCUUUAU-3' | (SEQ ID NO: 7009) |
|  | 3'-GUAAUUAUCGUCGGAAAGAGAGAAAUA-5' | (SEQ ID NO: 1464) |
| βc-2927 Target: | 5'-CATTAATAGCAGCCTTTCTCTCTTTAT-3' | (SEQ ID NO: 2573) |
|  | 5'-UUAAUAGCAGCCUUUCUCUCUUUAUAC-3' | (SEQ ID NO: 7010) |
|  | 3'-AAUUAUCGUCGGAAAGAGAGAAAUAUG-5' | (SEQ ID NO: 1465) |
| βc-2929 Target: | 5'-TTAATAGCAGCCTTTCTCTCTTTATAC-3' | (SEQ ID NO: 2574) |
|  | 5'-UUGCAUUGUGAUUGGCCUGUAGAGUUG-3' | (SEQ ID NO: 7011) |
|  | 3'-AACGUAACACUAACCGGACAUCUCAAC-5' | (SEQ ID NO: 1466) |
| βc-2973 Target: | 5'-TTGCATTGTGATTGGCCTGTAGAGTTG-3' | (SEQ ID NO: 2575) |
|  | 5'-GCAUUGUGAUUGGCCUGUAGAGUUGCU-3' | (SEQ ID NO: 7012) |
|  | 3'-CGUAACACUAACCGGACAUCUCAACGA-5' | (SEQ ID NO: 1467) |
| βc-2975 Target: | 5'-GCATTGTGATTGGCCTGTAGAGTTGCT-3' | (SEQ ID NO: 2576) |

TABLE 8-continued

Selected Anti-β-catenin DsiRNA Agents, Blunt Duplexes

|  |  |  |  |
|---|---|---|---|
|  | 5'-AUUGUGAUUGGCCUGUAGAGUUGCUGA-3' | (SEQ ID NO: 7013) |  |
|  | 3'-UAACACUAACCGGACAUCUCAACGACU-5' | (SEQ ID NO: 1468) |  |
| βc-2977 Target: | 5'-ATTGTGATTGGCCTGTAGAGTTGCTGA-3' | (SEQ ID NO: 2577) |  |
|  | 5'-UGUGAUUGGCCUGUAGAGUUGCUGAGA-3' | (SEQ ID NO: 7014) |  |
|  | 3'-ACACUAACCGGACAUCUCAACGACUCU-5' | (SEQ ID NO: 1469) |  |
| βc-2979 Target: | 5'-TGTGATTGGCCTGTAGAGTTGCTGAGA-3' | (SEQ ID NO: 2578) |  |
|  | 5'-UGAUUGGCCUGUAGAGUUGCUGAGAGG-3' | (SEQ ID NO: 7015) |  |
|  | 3'-ACUAACCGGACAUCUCAACGACUCUCC-5' | (SEQ ID NO: 1470) |  |
| βc-2981 Target: | 5'-TGATTGGCCTGTAGAGTTGCTGAGAGG-3' | (SEQ ID NO: 2579) |  |
|  | 5'-AUUGGCCUGUAGAGUUGCUGAGAGGGC-3' | (SEQ ID NO: 7016) |  |
|  | 3'-UAACCGGACAUCUCAACGACUCUCCCG-5' | (SEQ ID NO: 1471) |  |
| βc-2983 Target: | 5'-ATTGGCCTGTAGAGTTGCTGAGAGGGC-3' | (SEQ ID NO: 2580) |  |
|  | 5'-UGGCCUGUAGAGUUGCUGAGAGGGCUC-3' | (SEQ ID NO: 7017) |  |
|  | 3'-ACCGGACAUCUCAACGACUCUCCCGAG-5' | (SEQ ID NO: 1472) |  |
| βc-2985 Target: | 5'-TGGCCTGTAGAGTTGCTGAGAGGGCTC-3' | (SEQ ID NO: 2581) |  |
|  | 5'-GCCUGUAGAGUUGCUGAGAGGGCUCGA-3' | (SEQ ID NO: 7018) |  |
|  | 3'-CGGACAUCUCAACGACUCUCCCGAGCU-5' | (SEQ ID NO: 1473) |  |
| βc-2987 Target: | 5'-GCCTGTAGAGTTGCTGAGAGGGCTCGA-3' | (SEQ ID NO: 2582) |  |
|  | 5'-CUGUAGAGUUGCUGAGAGGGCUCGAGG-3' | (SEQ ID NO: 7019) |  |
|  | 3'-GACAUCUCAACGACUCUCCCGAGCUCC-5' | (SEQ ID NO: 1474) |  |
| βc-2989 Target: | 5'-CTGTAGAGTTGCTGAGAGGGCTCGAGG-3' | (SEQ ID NO: 2583) |  |
|  | 5'-GGGUGGGCUGGUAUCUCAGAAAGUGCC-3' | (SEQ ID NO: 7020) |  |
|  | 3'-CCCACCCGACCAUAGAGUCUUUCACGG-5' | (SEQ ID NO: 1475) |  |
| βc-3015 Target: | 5'-GGGTGGGCTGGTATCTCAGAAAGTGCC-3' | (SEQ ID NO: 2584) |  |
|  | 5'-GUGGGCUGGUAUCUCAGAAAGUGCCUG-3' | (SEQ ID NO: 7021) |  |
|  | 3'-CACCCGACCAUAGAGUCUUUCACGGAC-5' | (SEQ ID NO: 1476) |  |
| βc-3017 Target: | 5'-GTGGGCTGGTATCTCAGAAAGTGCCTG-3' | (SEQ ID NO: 2585) |  |
|  | 5'-GGGCUGGUAUCUCAGAAAGUGCCUGAC-3' | (SEQ ID NO: 7022) |  |
|  | 3'-CCCGACCAUAGAGUCUUUCACGGACUG-5' | (SEQ ID NO: 1477) |  |
| βc-3019 Target: | 5'-GGGCTGGTATCTCAGAAAGTGCCTGAC-3' | (SEQ ID NO: 2586) |  |
|  | 5'-GCUGGUAUCUCAGAAAGUGCCUGACAC-3' | (SEQ ID NO: 7023) |  |
|  | 3'-CGACCAUAGAGUCUUUCACGGACUGUG-5' | (SEQ ID NO: 1478) |  |
| βc-3021 Target: | 5'-GCTGGTATCTCAGAAAGTGCCTGACAC-3' | (SEQ ID NO: 2587) |  |
|  | 5'-ACACUAACCAAGCUGAGUUUCCUAUGG-3' | (SEQ ID NO: 7024) |  |
|  | 3'-UGUGAUUGGUUCGACUCAAAGGAUACC-5' | (SEQ ID NO: 1479) |  |
| βc-3046 Target: | 5'-ACACTAACCAAGCTGAGTTTCCTATGG-3' | (SEQ ID NO: 2588) |  |
|  | 5'-ACUAACCAAGCUGAGUUUCCUAUGGGA-3' | (SEQ ID NO: 7025) |  |
|  | 3'-UGAUUGGUUCGACUCAAAGGAUACCCU-5' | (SEQ ID NO: 1480) |  |
| βc-3048 Target: | 5'-ACTAACCAAGCTGAGTTTCCTATGGGA-3' | (SEQ ID NO: 2589) |  |

TABLE 8-continued

Selected Anti-β-catenin DsiRNA Agents, Blunt Duplexes

|  |  |  |
|---|---|---|
|  | 5'-UAACCAAGCUGAGUUUCCUAUGGGAAC-3' | (SEQ ID NO: 7026) |
|  | 3'-AUUGGUUCGACUCAAAGGAUACCCUUG-5' | (SEQ ID NO: 1481) |
| βc-3050 Target: | 5'-TAACCAAGCTGAGTTTCCTATGGGAAC-3' | (SEQ ID NO: 2590) |
|  | 5'-ACCAAGCUGAGUUUCCUAUGGGAACAA-3' | (SEQ ID NO: 7027) |
|  | 3'-UGGUUCGACUCAAAGGAUACCCUUGUU-5' | (SEQ ID NO: 1482) |
| βc-3052 Target: | 5'-ACCAAGCTGAGTTTCCTATGGGAACAA-3' | (SEQ ID NO: 2591) |
|  | 5'-CAAGCUGAGUUUCCUAUGGGAACAAUU-3' | (SEQ ID NO: 7028) |
|  | 3'-GUUCGACUCAAAGGAUACCCUUGUUAA-5' | (SEQ ID NO: 1483) |
| βc-3054 Target: | 5'-CAAGCTGAGTTTCCTATGGGAACAATT-3' | (SEQ ID NO: 2592) |
|  | 5'-AGCUGAGUUUCCUAUGGGAACAAUUGA-3' | (SEQ ID NO: 7029) |
|  | 3'-UCGACUCAAAGGAUACCCUUGUUAACU-5' | (SEQ ID NO: 1484) |
| βc-3056 Target: | 5'-AGCTGAGTTTCCTATGGGAACAATTGA-3' | (SEQ ID NO: 2593) |
|  | 5'-AACUUUUUGUUCUGGUCCUUUUUGGUC-3' | (SEQ ID NO: 7030) |
|  | 3'-UUGAAAAACAAGACCAGGAAAAACCAG-5' | (SEQ ID NO: 1485) |
| βc-3087 Target: | 5'-AACTTTTTGTTCTGGTCCTTTTTGGTC-3' | (SEQ ID NO: 2594) |
|  | 5'-CUUUUUGUUCUGGUCCUUUUUGGUCGA-3' | (SEQ ID NO: 7031) |
|  | 3'-GAAAAACAAGACCAGGAAAAACCAGCU-5' | (SEQ ID NO: 1486) |
| βc-3089 Target: | 5'-CTTTTTGTTCTGGTCCTTTTTGGTCGA-3' | (SEQ ID NO: 2595) |
|  | 5'-UUUUGUUCUGGUCCUUUUUGGUCGAGG-3' | (SEQ ID NO: 7032) |
|  | 3'-AAAACAAGACCAGGAAAAACCAGCUCC-5' | (SEQ ID NO: 1487) |
| βc-3091 Target: | 5'-TTTTGTTCTGGTCCTTTTTGGTCGAGG-3' | (SEQ ID NO: 2596) |
|  | 5'-UUGUUCUGGUCCUUUUUGGUCGAGGAG-3' | (SEQ ID NO: 7033) |
|  | 3'-AACAAGACCAGGAAAAACCAGCUCCUC-5' | (SEQ ID NO: 1488) |
| βc-3093 Target: | 5'-TTGTTCTGGTCCTTTTTGGTCGAGGAG-3' | (SEQ ID NO: 2597) |
|  | 5'-GUUCUGGUCCUUUUUGGUCGAGGAGUA-3' | (SEQ ID NO: 7034) |
|  | 3'-CAAGACCAGGAAAAACCAGCUCCUCAU-5' | (SEQ ID NO: 1489) |
| βc-3095 Target: | 5'-GTTCTGGTCCTTTTTGGTCGAGGAGTA-3' | (SEQ ID NO: 2598) |
|  | 5'-UCUGGUCCUUUUUGGUCGAGGAGUAAC-3' | (SEQ ID NO: 7035) |
|  | 3'-AGACCAGGAAAAACCAGCUCCUCAUUG-5' | (SEQ ID NO: 1490) |
| βc-3097 Target: | 5'-TCTGGTCCTTTTTGGTCGAGGAGTAAC-3' | (SEQ ID NO: 2599) |
|  | 5'-UGGUCCUUUUUGGUCGAGGAGUAACAA-3' | (SEQ ID NO: 7036) |
|  | 3'-ACCAGGAAAAACCAGCUCCUCAUUGUU-5' | (SEQ ID NO: 1491) |
| βc-3099 Target: | 5'-TGGTCCTTTTTGGTCGAGGAGTAACAA-3' | (SEQ ID NO: 2600) |
|  | 5'-GUCCUUUUUGGUCGAGGAGUAACAAUA-3' | (SEQ ID NO: 7037) |
|  | 3'-CAGGAAAAACCAGCUCCUCAUUGUUAU-5' | (SEQ ID NO: 1492) |
| βc-3101 Target: | 5'-GTCCTTTTTGGTCGAGGAGTAACAATA-3' | (SEQ ID NO: 2601) |
|  | 5'-CCUUUUUGGUCGAGGAGUAACAAUACA-3' | (SEQ ID NO: 7038) |
|  | 3'-GGAAAAACCAGCUCCUCAUUGUUAUGU-5' | (SEQ ID NO: 1493) |
| βc-3103 Target: | 5'-CCTTTTTGGTCGAGGAGTAACAATACA-3' | (SEQ ID NO: 2602) |

TABLE 8-continued

Selected Anti-β-catenin DsiRNA Agents, Blunt Duplexes

|  |  |  |
|---|---|---|
|  | 5'-UUUUUGGUCGAGGAGUAACAAUACAAA-3' | (SEQ ID NO: 7039) |
|  | 3'-AAAAACCAGCUCCUCAUUGUUAUGUUU-5' | (SEQ ID NO: 1494) |
| βc-3105 Target: | 5'-TTTTTGGTCGAGGAGTAACAATACAAA-3' | (SEQ ID NO: 2603) |
|  | 5'-UUUGGUCGAGGAGUAACAAUACAAAUG-3' | (SEQ ID NO: 7040) |
|  | 3'-AAACCAGCUCCUCAUUGUUAUGUUUAC-5' | (SEQ ID NO: 1495) |
| βc-3107 Target: | 5'-TTTGGTCGAGGAGTAACAATACAAATG-3' | (SEQ ID NO: 2604) |
|  | 5'-UGGUCGAGGAGUAACAAUACAAAUGGA-3' | (SEQ ID NO: 7041) |
|  | 3'-ACCAGCUCCUCAUUGUUAUGUUUACCU-5' | (SEQ ID NO: 1496) |
| βc-3109 Target: | 5'-TGGTCGAGGAGTAACAATACAAATGGA-3' | (SEQ ID NO: 2605) |
|  | 5'-GUCGAGGAGUAACAAUACAAAUGGAUU-3' | (SEQ ID NO: 7042) |
|  | 3'-CAGCUCCUCAUUGUUAUGUUUACCUAA-5' | (SEQ ID NO: 1497) |
| βc-3111 Target: | 5'-GTCGAGGAGTAACAATACAAATGGATT-3' | (SEQ ID NO: 2606) |
|  | 5'-CGAGGAGUAACAAUACAAAUGGAUUUU-3' | (SEQ ID NO: 7043) |
|  | 3'-GCUCCUCAUUGUUAUGUUUACCUAAAA-5' | (SEQ ID NO: 1498) |
| βc-3113 Target: | 5'-CGAGGAGTAACAATACAAATGGATTTT-3' | (SEQ ID NO: 2607) |
|  | 5'-AGGAGUAACAAUACAAAUGGAUUUUGG-3' | (SEQ ID NO: 7044) |
|  | 3'-UCCUCAUUGUUAUGUUUACCUAAAACC-5' | (SEQ ID NO: 1499) |
| βc-3115 Target: | 5'-AGGAGTAACAATACAAATGGATTTTGG-3' | (SEQ ID NO: 2608) |
|  | 5'-UUUAUCAAACCCUAGCCUUGCUUGUUA-3' | (SEQ ID NO: 7045) |
|  | 3'-AAAUAGUUUGGGAUCGGAACGAACAAU-5' | (SEQ ID NO: 1500) |
| βc-3191 Target: | 5'-TTTATCAAACCCTAGCCTTGCTTGTTA-3' | (SEQ ID NO: 2609) |
|  | 5'-UAUCAAACCCUAGCCUUGCUUGUUAAA-3' | (SEQ ID NO: 7046) |
|  | 3'-AUAGUUUGGGAUCGGAACGAACAAUUU-5' | (SEQ ID NO: 1501) |
| βc-3193 Target: | 5'-TATCAAACCCTAGCCTTGCTTGTTAAA-3' | (SEQ ID NO: 2610) |
|  | 5'-UCAAACCCUAGCCUUGCUUGUUAAAUU-3' | (SEQ ID NO: 7047) |
|  | 3'-AGUUUGGGAUCGGAACGAACAAUUUAA-5' | (SEQ ID NO: 1502) |
| βc-3195 Target: | 5'-TCAAACCCTAGCCTTGCTTGTTAAATT-3' | (SEQ ID NO: 2611) |
|  | 5'-UUGAGUAAUGGUGUAGAACACUAAUUC-3' | (SEQ ID NO: 7048) |
|  | 3'-AACUCAUUACCACAUCUUGUGAUUAAG-5' | (SEQ ID NO: 1503) |
| βc-3387 Target: | 5'-TTGAGTAATGGTGTAGAACACTAATTC-3' | (SEQ ID NO: 2612) |
|  | 5'-GAGUAAUGGUGUAGAACACUAAUUCAU-3' | (SEQ ID NO: 7049) |
|  | 3'-CUCAUUACCACAUCUUGUGAUUAAGUA-5' | (SEQ ID NO: 1504) |
| βc-3389 Target: | 5'-GAGTAATGGTGTAGAACACTAATTC-3' | (SEQ ID NO: 2613) |
|  | 5'-GUAAUGGUGUAGAACACUAAUUCAUAA-3' | (SEQ ID NO: 7050) |
|  | 3'-CAUUACCACAUCUUGUGAUUAAGUAUU-5' | (SEQ ID NO: 1505) |
| βc-3391 Target: | 5'-GTAATGGTGTAGAACACTAATTCATAA-3' | (SEQ ID NO: 2614) |
|  | 5'-AAUGGUGUAGAACACUAAUUCAUAAUC-3' | (SEQ ID NO: 7051) |
|  | 3'-UUACCACAUCUUGUGAUUAAGUAUUAG-5' | (SEQ ID NO: 1506) |
| βc-3393 Target: | 5'-AATGGTGTAGAACACTAATTCATAATC-3' | (SEQ ID NO: 2615) |

TABLE 8-continued

Selected Anti-β-catenin DsiRNA Agents, Blunt Duplexes

|  |  |  |
|---|---|---|
|  | 5'-UGGUGUAGAACACUAAUUCAUAAUCAC-3' | (SEQ ID NO: 7052) |
|  | 3'-ACCACAUCUUGUGAUUAAGUAUUAGUG-5' | (SEQ ID NO: 1507) |
| βc-3395 Target: | 5'-TGGTGTAGAACACTAATTCATAATCAC-3' | (SEQ ID NO: 2616) |
|  | 5'-GUGUAGAACACUAAUUCAUAAUCACUC-3' | (SEQ ID NO: 7053) |
|  | 3'-CACAUCUUGUGAUUAAGUAUUAGUGAG-5' | (SEQ ID NO: 1508) |
| βc-3397 Target: | 5'-GTGTAGAACACTAATTCATAATCACTC-3' | (SEQ ID NO: 2617) |
|  | 5'-GUAGAACACUAAUUCAUAAUCACUCUA-3' | (SEQ ID NO: 7054) |
|  | 3'-CAUCUUGUGAUUAAGUAUUAGUGAGAU-5' | (SEQ ID NO: 1509) |
| βc-3399 Target: | 5'-GTAGAACACTAATTCATAATCACTCTA-3' | (SEQ ID NO: 2618) |
|  | 5'-AGAACACUAAUUCAUAAUCACUCUAAU-3' | (SEQ ID NO: 7055) |
|  | 3'-UCUUGUGAUUAAGUAUUAGUGAGAUUA-5' | (SEQ ID NO: 1510) |
| βc-3401 Target: | 5'-AGAACACTAATTCATAATCACTCTAAT-3' | (SEQ ID NO: 2619) |
|  | 5'-AAUUAGUUUCCUUUUUAAUAUGCUUAA-3' | (SEQ ID NO: 7056) |
|  | 3'-UUAAUCAAAGGAAAAAUUAUACGAAUU-5' | (SEQ ID NO: 1511) |
| βc-3500 Target: | 5'-AATTAGTTTCCTTTTTAATATGCTTAA-3' | (SEQ ID NO: 2620) |
|  | 5'-UUAGUUUCCUUUUUAAUAUGCUUAAAA-3' | (SEQ ID NO: 7057) |
|  | 3'-AAUCAAAGGAAAAAUUAUACGAAUUUU-5' | (SEQ ID NO: 1512) |
| βc-3502 Target: | 5'-TTAGTTTCCTTTTTAATATGCTTAAAA-3' | (SEQ ID NO: 2621) |
|  | 5'-AGUUUCCUUUUUAAUAUGCUUAAAAUA-3' | (SEQ ID NO: 7058) |
|  | 3'-UCAAAGGAAAAAUUAUACGAAUUUUAU-5' | (SEQ ID NO: 1513) |
| βc-3504 Target: | 5'-AGTTTCCTTTTTAATATGCTTAAAATA-3' | (SEQ ID NO: 2622) |
|  | 5'-UUUCCUUUUUAAUAUGCUUAAAAUAAG-3' | (SEQ ID NO: 7059) |
|  | 3'-AAAGGAAAAAUUAUACGAAUUUUAUUC-5' | (SEQ ID NO: 1514) |
| βc-3506 Target: | 5'-TTTCCTTTTTAATATGCTTAAAATAAG-3' | (SEQ ID NO: 2623) |
|  | 5'-UCCUUUUUAAUAUGCUUAAAAUAAGCA-3' | (SEQ ID NO: 7060) |
|  | 3'-AGGAAAAAUUAUACGAAUUUUAUUCGU-5' | (SEQ ID NO: 1515) |
| βc-3508 Target: | 5'-TCCTTTTTAATATGCTTAAAATAAGCA-3' | (SEQ ID NO: 2624) |
|  | 5'-CCUUUUUAAUAUGCUUAAAAUAAGCAG-3' | (SEQ ID NO: 7061) |
|  | 3'-GGAAAAAUUAUACGAAUUUUAUUCGUC-5' | (SEQ ID NO: 1516) |
| βc-3509 Target: | 5'-CCTTTTTAATATGCTTAAAATAAGCAG-3' | (SEQ ID NO: 2625) |
|  | 5'-CUUUUUAAUAUGCUUAAAAUAAGCAGG-3' | (SEQ ID NO: 7062) |
|  | 3'-GAAAAAUUAUACGAAUUUUAUUCGUCC-5' | (SEQ ID NO: 1517) |
| βc-3510 Target: | 5'-CTTTTTAATATGCTTAAAATAAGCAGG-3' | (SEQ ID NO: 2626) |
|  | 5'-UUUUUAAUAUGCUUAAAAUAAGCAGGUG-3' | (SEQ ID NO: 7063) |
|  | 3'-AAAAUUAUACGAAUUUUAUUCGUCCAC-5' | (SEQ ID NO: 1518) |
| βc-3512 Target: | 5'-TTTTTAATATGCTTAAAATAAGCAGGTG-3' | (SEQ ID NO: 2627) |
|  | 5'-UUAAUAUGCUUAAAAUAAGCAGGUGGA-3' | (SEQ ID NO: 7064) |
|  | 3'-AAUUAUACGAAUUUUAUUCGUCCACCU-5' | (SEQ ID NO: 1519) |
| βc-3514 Target: | 5'-TTAATATGCTTAAAATAAGCAGGTGGA-3' | (SEQ ID NO: 2628) |

TABLE 8-continued

Selected Anti-β-catenin DsiRNA Agents, Blunt Duplexes

|  |  |  |  |
|---|---|---|---|
|  | 5'-AAUAUGCUUAAAAUAAGCAGGUGGAUC-3' | (SEQ ID NO: 7065) |
|  | 3'-UUAUACGAAUUUUAUUCGUCCACCUAG-5' | (SEQ ID NO: 1520) |
| βc-3516 Target: | 5'-AATATGCTTAAAATAAGCAGGTGGATC-3' | (SEQ ID NO: 2629) |
|  | 5'-UAUGCUUAAAAUAAGCAGGUGGAUCUA-3' | (SEQ ID NO: 7066) |
|  | 3'-AUACGAAUUUUAUUCGUCCACCUAGAU-5' | (SEQ ID NO: 1521) |
| βc-3518 Target: | 5'-TATGCTTAAAATAAGCAGGTGGATCTA-3' | (SEQ ID NO: 2630) |
|  | 5'-UGCUUAAAAUAAGCAGGUGGAUCUAUU-3' | (SEQ ID NO: 7067) |
|  | 3'-ACGAAUUUUAUUCGUCCACCUAGAUAA-5' | (SEQ ID NO: 1522) |
| βc-3520 Target: | 5'-TGCTTAAAATAAGCAGGTGGATCTATT-3' | (SEQ ID NO: 2631) |
|  | 5'-CUUAAAAUAAGCAGGUGGAUCUAUUUC-3' | (SEQ ID NO: 7068) |
|  | 3'-GAAUUUUAUUCGUCCACCUAGAUAAAG-5' | (SEQ ID NO: 1523) |
| βc-3522 Target: | 5'-CTTAAAATAAGCAGGTGGATCTATTTC-3' | (SEQ ID NO: 2632) |
|  | 5'-UAAAAUAAGCAGGUGGAUCUAUUUCAU-3' | (SEQ ID NO: 7069) |
|  | 3'-AUUUUAUUCGUCCACCUAGAUAAAGUA-5' | (SEQ ID NO: 1524) |
| βc-3524 Target: | 5'-TAAAATAAGCAGGTGGATCTATTTC-3' | (SEQ ID NO: 2633) |
|  | 5'-AAAUAAGCAGGUGGAUCUAUUUCAUGU-3' | (SEQ ID NO: 7070) |
|  | 3'-UUUAUUCGUCCACCUAGAUAAAGUACA-5' | (SEQ ID NO: 1525) |
| βc-3526 Target: | 5'-AAATAAGCAGGTGGATCTATTTCATGT-3' | (SEQ ID NO: 2634) |
|  | 5'-AUAAGCAGGUGGAUCUAUUUCAUGUUU-3' | (SEQ ID NO: 7071) |
|  | 3'-UAUUCGUCCACCUAGAUAAAGUACAAA-5' | (SEQ ID NO: 1526) |
| βc-3528 Target: | 5'-ATAAGCAGGTGGATCTATTTCATGTTT-3' | (SEQ ID NO: 2635) |
|  | 5'-AAGCAGGUGGAUCUAUUUCAUGUUUUU-3' | (SEQ ID NO: 7072) |
|  | 3'-UUCGUCCACCUAGAUAAAGUACAAAAA-5' | (SEQ ID NO: 1527) |
| βc-3530 Target: | 5'-AAGCAGGTGGATCTATTTCATGTTTTT-3' | (SEQ ID NO: 2636) |
|  | 5'-GCAGGUGGAUCUAUUUCAUGUUUUUGA-3' | (SEQ ID NO: 7073) |
|  | 3'-CGUCCACCUAGAUAAAGUACAAAAACU-5' | (SEQ ID NO: 1528) |
| βc-3532 Target: | 5'-GCAGGTGGATCTATTTCATGTTTTTGA-3' | (SEQ ID NO: 2637) |
|  | 5'-AGGUGGAUCUAUUUCAUGUUUUUGAUC-3' | (SEQ ID NO: 7074) |
|  | 3'-UCCACCUAGAUAAAGUACAAAAACUAG-5' | (SEQ ID NO: 1529) |
| βc-3534 Target: | 5'-AGGTGGATCTATTTCATGTTTTTGATC-3' | (SEQ ID NO: 2638) |
|  | 5'-GUGGAUCUAUUUCAUGUUUUUGAUCAA-3' | (SEQ ID NO: 7075) |
|  | 3'-CACCUAGAUAAAGUACAAAAACUAGUU-5' | (SEQ ID NO: 1530) |
| βc-3536 Target: | 5'-GTGGATCTATTTCATGTTTTTGATCAA-3' | (SEQ ID NO: 2639) |
|  | 5'-GGAUCUAUUUCAUGUUUUUGAUCAAAA-3' | (SEQ ID NO: 7076) |
|  | 3'-CCUAGAUAAAGUACAAAAACUAGUUUU-5' | (SEQ ID NO: 1531) |
| βc-3538 Target: | 5'-GGATCTATTTCATGTTTTTGATCAAAA-3' | (SEQ ID NO: 2640) |
|  | 5'-GGGUAGGGUAAAUCAGUAAGAGGUGUU-3' | (SEQ ID NO: 7077) |
|  | 3'-CCCAUCCCAUUUAGUCAUUCUCCACAA-5' | (SEQ ID NO: 1532) |
| βc-3583 Target: | 5'-GGGTAGGGTAAATCAGTAAGAGGTGTT-3' | (SEQ ID NO: 2641) |

TABLE 8-continued

Selected Anti-β-catenin DsiRNA Agents, Blunt Duplexes

|  |  |  |
|---|---|---|
| | 5'-GUAGGGUAAAUCAGUAAGAGGUGUUAU-3' | (SEQ ID NO: 7078) |
| | 3'-CAUCCCAUUUAGUCAUUCUCCACAAUA-5' | (SEQ ID NO: 1533) |
| βc-3585 Target: | 5'-GTAGGGTAAATCAGTAAGAGGTGTTAT-3' | (SEQ ID NO: 2642) |
| | 5'-AGGGUAAAUCAGUAAGAGGUGUUAUUU-3' | (SEQ ID NO: 7079) |
| | 3'-UCCCAUUUAGUCAUUCUCCACAAUAAA-5' | (SEQ ID NO: 1534) |
| βc-3587 Target: | 5'-AGGGTAAATCAGTAAGAGGTGTTATTT-3' | (SEQ ID NO: 2643) |
| | 5'-GGUAAAUCAGUAAGAGGUGUUAUUUGG-3' | (SEQ ID NO: 7080) |
| | 3'-CCAUUUAGUCAUUCUCCACAAUAAACC-5' | (SEQ ID NO: 1535) |
| βc-3589 Target: | 5'-GGTAAATCAGTAAGAGGTGTTATTTGG-3' | (SEQ ID NO: 2644) |
| | 5'-UAAAUCAGUAAGAGGUGUUAUUUGGAA-3' | (SEQ ID NO: 7081) |
| | 3'-AUUUAGUCAUUCUCCACAAUAAACCUU-5' | (SEQ ID NO: 1536) |
| βc-3591 Target: | 5'-TAAATCAGTAAGAGGTGTTATTTGGAA-3' | (SEQ ID NO: 2645) |
| | 5'-AAUCAGUAAGAGGUGUUAUUUGGAACC-3' | (SEQ ID NO: 7082) |
| | 3'-UUAGUCAUUCUCCACAAUAAACCUUGG-5' | (SEQ ID NO: 1537) |
| βc-3593 Target: | 5'-AATCAGTAAGAGGTGTTATTTGGAACC-3' | (SEQ ID NO: 2646) |
| | 5'-UUUACCAGUUGCCUUUUAUCCCAAAGU-3' | (SEQ ID NO: 7083) |
| | 3'-AAAUGGUCAACGGAAAAUAGGGUUUCA-5' | (SEQ ID NO: 1538) |
| βc-3633 Target: | 5'-TTTACCAGTTGCCTTTTATCCCAAAGT-3' | (SEQ ID NO: 2647) |
| | 5'-UACCAGUUGCCUUUUAUCCCAAAGUUG-3' | (SEQ ID NO: 7084) |
| | 3'-AUGGUCAACGGAAAAUAGGGUUUCAAC-5' | (SEQ ID NO: 1539) |
| βc-3635 Target: | 5'-TACCAGTTGCCTTTTATCCCAAAGTTG-3' | (SEQ ID NO: 2648) |
| | 5'-CCAGUUGCCUUUUAUCCCAAAGUUGUU-3' | (SEQ ID NO: 7085) |
| | 3'-GGUCAACGGAAAAUAGGGUUUCAACAA-5' | (SEQ ID NO: 1540) |
| βc-3637 Target: | 5'-CCAGTTGCCTTTTATCCCAAAGTTGTT-3' | (SEQ ID NO: 2649) |
| | 5'-AGUUGCCUUUUAUCCCAAAGUUGUUGU-3' | (SEQ ID NO: 7086) |
| | 3'-UCAACGGAAAAUAGGGUUUCAACAACA-5' | (SEQ ID NO: 1541) |
| βc-3639 Target: | 5'-AGTTGCCTTTTATCCCAAAGTTGTTGT-3' | (SEQ ID NO: 2650) |
| | 5'-UUGCCUUUUAUCCCAAAGUUGUUGUAA-3' | (SEQ ID NO: 7087) |
| | 3'-AACGGAAAAUAGGGUUUCAACAACAUU-5' | (SEQ ID NO: 1542) |
| βc-3641 Target: | 5'-TTGCCTTTTATCCCAAAGTTGTTGTAA-3' | (SEQ ID NO: 2651) |
| | 5'-GCCUUUUAUCCCAAAGUUGUUGUAACC-3' | (SEQ ID NO: 7088) |
| | 3'-CGGAAAAUAGGGUUUCAACAACAUUGG-5' | (SEQ ID NO: 1543) |
| βc-3643 Target: | 5'-GCCTTTTATCCCAAAGTTGTTGTAACC-3' | (SEQ ID NO: 2652) |
| | 5'-CUUUUAUCCCAAAGUUGUUGUAACCUG-3' | (SEQ ID NO: 7089) |
| | 3'-GAAAAUAGGGUUUCAACAACAUUGGAC-5' | (SEQ ID NO: 1544) |
| βc-3645 Target: | 5'-CTTTTATCCCAAAGTTGTTGTAACCTG-3' | (SEQ ID NO: 2653) |
| | 5'-UUUAUCCCAAAGUUGUUGUAACCUGCU-3' | (SEQ ID NO: 7090) |
| | 3'-AAAUAGGGUUUCAACAACAUUGGACGA-5' | (SEQ ID NO: 1545) |
| βc-3647 Target: | 5'-TTTATCCCAAAGTTGTTGTAACCTGCT-3' | (SEQ ID NO: 2654) |

TABLE 8-continued

Selected Anti-β-catenin DsiRNA Agents, Blunt Duplexes

```
                       5'-UAUCCCAAAGUUGUUGUAACCUGCUGU-3'    (SEQ ID NO: 7091)
                       3'-AUAGGGUUUCAACAACAUUGGACGACA-5'    (SEQ ID NO: 1546)
βc-3649 Target:        5'-TATCCCAAAGTTGTTGTAACCTGCTGT-3'    (SEQ ID NO: 2655)

5'-UCCCAAAGUUGUUGUAACCUGCUGUGA-3'    (SEQ ID NO: 7092)
                       3'-AGGGUUUCAACAACAUUGGACGACACU-5'    (SEQ ID NO: 1547)
βc-3651 Target:        5'-TCCCAAAGTTGTTGTAACCTGCTGTGA-3'    (SEQ ID NO: 2656)

5'-CCAAAGUUGUUGUAACCUGCUGUGAUA-3'    (SEQ ID NO: 7093)
                       3'-GGUUUCAACAACAUUGGACGACACUAU-5'    (SEQ ID NO: 1548)
βc-3653 Target:        5'-CCAAAGTTGTTGTAACCTGCTGTGATA-3'    (SEQ ID NO: 2657)

5'-AAAGUUGUUGUAACCUGCUGUGAUACG-3'    (SEQ ID NO: 7094)
                       3'-UUUCAACAACAUUGGACGACACUAUGC-5'    (SEQ ID NO: 1549)
βc-3655 Target:        5'-AAAGTTGTTGTAACCTGCTGTGATACG-3'    (SEQ ID NO: 2658)

5'-AGUUGUUGUAACCUGCUGUGAUACGAU-3'    (SEQ ID NO: 7095)
                       3'-UCAACAACAUUGGACGACACUAUGCUA-5'    (SEQ ID NO: 1550)
βc-3657 Target:        5'-AGTTGTTGTAACCTGCTGTGATACGAT-3'    (SEQ ID NO: 2659)

5'-UUGUUGUAACCUGCUGUGAUACGAUGC-3'    (SEQ ID NO: 7096)
                       3'-AACAACAUUGGACGACACUAUGCUACG-5'    (SEQ ID NO: 1551)
βc-3659 Target:        5'-TTGTTGTAACCTGCTGTGATACGATGC-3'    (SEQ ID NO: 2660)

5'-AAAAAUGGUUCAGAAUUAAACUUUUAA-3'    (SEQ ID NO: 7097)
                       3'-UUUUUACCAAGUCUUAAUUUGAAAAUU-5'    (SEQ ID NO: 1552)
βc-3708 Target:        5'-AAAAATGGTTCAGAATTAAACTTTTAA-3'    (SEQ ID NO: 2661)

5'-AAAUGGUUCAGAAUUAAACUUUUAAUU-3'    (SEQ ID NO: 7098)
                       3'-UUUACCAAGUCUUAAUUUGAAAAUUAA-5'    (SEQ ID NO: 1553)
βc-3710 Target:        5'-AAATGGTTCAGAATTAAACTTTTAATT-3'    (SEQ ID NO: 2662)

5'-AUGGUUCAGAAUUAAACUUUUAAUUCA-3'    (SEQ ID NO: 7099)
                       3'-UACCAAGUCUUAAUUUGAAAAUUAAGU-5'    (SEQ ID NO: 1554)
βc-3712 Target:        5'-ATGGTTCAGAATTAAACTTTTAATTCA-3'    (SEQ ID NO: 2663)

5'-GGUUCAGAAUUAAACUUUUAAUUCAUU-3'    (SEQ ID NO: 7100)
                       3'-CCAAGUCUUAAUUUGAAAAUUAAGUAA-5'    (SEQ ID NO: 1555)
βc-3714 Target:        5'-GGTTCAGAATTAAACTTTTAATTCATT-3'    (SEQ ID NO: 2664)

5'-UUCAGAAUUAAACUUUUAAUUCAUUCG-3'    (SEQ ID NO: 7101)
                       3'-AAGUCUUAAUUUGAAAAUUAAGUAAGC-5'    (SEQ ID NO: 1556)
βc-3716 Target:        5'-TTCAGAATTAAACTTTTAATTCATTCG-3'    (SEQ ID NO: 2665)

5'-CAGCAGCAGUCUUACUUGGAUUCUGGA-3'    (SEQ ID NO: 7102)
                       3'-GUCGUCGUCAGAAUGAACCUAAGACCU-5'    (SEQ ID NO: 1557)
βc-m314 Target:        5'-CAGCAGCAGTCTTACTTGGATTCTGGA-3'    (SEQ ID NO: 2666)

5'-UUACUUGGAUUCUGGAAUCCAUUCUGG-3'    (SEQ ID NO: 7103)
                       3'-AAUGAACCUAAGACCUUAGGUAAGACC-5'    (SEQ ID NO: 1558)
βc-m325 Target:        5'-TTACTTGGATTCTGGAATCCATTCTGG-3'    (SEQ ID NO: 2667)
```

TABLE 8-continued

Selected Anti-β-catenin DsiRNA Agents, Blunt Duplexes

|  | | |
|---|---|---|
| | 5'-UUGACACCUCCCAAGUCCUUUAUGAAU-3' | (SEQ ID NO: 7104) |
| | 3'-AACUGUGGAGGGUUCAGGAAAUACUUA-5' | (SEQ ID NO: 1559) |
| βc-m408 Target: | 5'-TTGACACCTCCCAAGTCCTTTATGAAT-3' | (SEQ ID NO: 2668) |
| | 5'-CACGCAAGAGCAAGUAGCUGAUAUUGA-3' | (SEQ ID NO: 7105) |
| | 3'-GUGCGUUCUCGUUCAUCGACUAUAACU-5' | (SEQ ID NO: 1560) |
| βc-m460 Target: | 5'-CACGCAAGAGCAAGTAGCTGATATTGA-3' | (SEQ ID NO: 2669) |
| | 5'-UGCCAUGUUCCCUGAGACGCUAGAUGA-3' | (SEQ ID NO: 7106) |
| | 3'-ACGGUACAAGGGACUCUGCGAUCUACU-5' | (SEQ ID NO: 1561) |
| βc-m526 Target: | 5'-TGCCATGTTCCCTGAGACGCTAGATGA-3' | (SEQ ID NO: 2670) |
| | 5'-GUUGAAACAUGCAGUUGUCAAUUUGAU-3' | (SEQ ID NO: 7107) |
| | 3'-CAACUUUGUACGUCAACAGUUAAACUA-5' | (SEQ ID NO: 1562) |
| βc-m631 Target: | 5'-GTTGAAACATGCAGTTGTCAATTTGAT-3' | (SEQ ID NO: 2671) |
| | 5'-AACAUGCAGUUGUCAAUUUGAUUAACU-3' | (SEQ ID NO: 7108) |
| | 3'-UUGUACGUCAACAGUUAAACUAAUUGA-5' | (SEQ ID NO: 1563) |
| βc-m636 Target: | 5'-AACATGCAGTTGTCAATTTGATTAACT-3' | (SEQ ID NO: 2672) |
| | 5'-CAGUUGUCAAUUUGAUUAACUAUCAGG-3' | (SEQ ID NO: 7109) |
| | 3'-GUCAACAGUUAAACUAAUUGAUAGUCC-5' | (SEQ ID NO: 1564) |
| βc-m642 Target: | 5'-CAGTTGTCAATTTGATTAACTATCAGG-3' | (SEQ ID NO: 2673) |
| | 5'-AUGAGGACCAGGUGGUAGUUAAUAAAG-3' | (SEQ ID NO: 7110) |
| | 3'-UACUCCUGGUCCACCAUCAAUUAUUUC-5' | (SEQ ID NO: 1565) |
| βc-m723 Target: | 5'-ATGAGGACCAGGTGGTAGTTAATAAAG-3' | (SEQ ID NO: 2674) |
| | 5'-UGGGUCACCAGUGGAUUCUGUACUGUU-3' | (SEQ ID NO: 7111) |
| | 3'-ACCCAGUGGUCACCUAAGACAUGACAA-5' | (SEQ ID NO: 1566) |
| βc-m970 Target: | 5'-TGGGTCACCAGTGGATTCTGTACTGTT-3' | (SEQ ID NO: 2675) |
| | 5'-ACCAGUGGAUUCUGUACUGUUCUACGC-3' | (SEQ ID NO: 7112) |
| | 3'-UGGUCACCUAAGACAUGACAAGAUGCG-5' | (SEQ ID NO: 1567) |
| βc-m976 Target: | 5'-ACCAGTGGATTCTGTACTGTTCTACGC-3' | (SEQ ID NO: 2676) |
| | 5'-UGGAUUCUGUACUGUUCUACGCCAUCA-3' | (SEQ ID NO: 7113) |
| | 3'-ACCUAAGACAUGACAAGAUGCGGUAGU-5' | (SEQ ID NO: 1568) |
| βc-m981 Target: | 5'-TGGATTCTGTACTGTTCTACGCCATCA-3' | (SEQ ID NO: 2677) |
| | 5'-UGGUGGACUGCAGAAAAUGGUUGCUUU-3' | (SEQ ID NO: 7114) |
| | 3'-ACCACCUGACGUCUUUUACCAACGAAA-5' | (SEQ ID NO: 1569) |
| βc-m1066 Target: | 5'-TGGTGGACTGCAGAAAATGGTTGCTTT-3' | (SEQ ID NO: 2678) |
| | 5'-AACGUGAAAUUCUUGGCUAUUACAACA-3' | (SEQ ID NO: 7115) |
| | 3'-UUGCACUUUAAGAACCGAUAAUGUUGU-5' | (SEQ ID NO: 1570) |
| βc-m1106 Target: | 5'-AACGTGAAATTCTTGGCTATTACAACA-3' | (SEQ ID NO: 2679) |
| | 5'-CCCAAGUCAGCGACUUGUUCAAAACUG-3' | (SEQ ID NO: 7116) |
| | 3'-GGGUUCAGUCGCUGAACAAGUUUUGAC-5' | (SEQ ID NO: 1571) |
| βc-m1354 Target: | 5'-CCCAAGTCAGCGACTTGTTCAAAACTG-3' | (SEQ ID NO: 2680) |

TABLE 8-continued

Selected Anti-β-catenin DsiRNA Agents, Blunt Duplexes

|  |  |  |
|---|---|---|
|  | 5'-GCGACUUGUUCAAAACUGUCUUUGGAC-3' | (SEQ ID NO: 7117) |
|  | 3'-CGCUGAACAAGUUUUGACAGAAACCUG-5' | (SEQ ID NO: 1572) |
| βc-m1363 Target: | 5'-GCGACTTGTTCAAAACTGTCTTTGGAC-3' | (SEQ ID NO: 2681) |
|  | 5'-CAAAACUGUCUUUGGACUCUCAGAAAC-3' | (SEQ ID NO: 7118) |
|  | 3'-GUUUUGACAGAAACCUGAGAGUCUUUG-5' | (SEQ ID NO: 1573) |
| βc-m1373 Target: | 5'-CAAAACTGTCTTTGGACTCTCAGAAAC-3' | (SEQ ID NO: 2682) |
|  | 5'-CUCUCUAACCUCACUUGCAAUAAUUAC-3' | (SEQ ID NO: 7119) |
|  | 3'-GAGAGAUUGGAGUGAACGUUAUUAAUG-5' | (SEQ ID NO: 1574) |
| βc-m1508 Target: | 5'-CTCTCTAACCTCACTTGCAATAATTAC-3' | (SEQ ID NO: 2683) |
|  | 5'-ACCUCACUUGCAAUAAUUACAAAAACA-3' | (SEQ ID NO: 7120) |
|  | 3'-UGGAGUGAACGUUAUUAAUGUUUUUGU-5' | (SEQ ID NO: 1575) |
| βc-m1515 Target: | 5'-ACCTCACTTGCAATAATTACAAAAACA-3' | (SEQ ID NO: 2684) |
|  | 5'-CAGAAUGCCGUUCGCCUUCAUUAUGGA-3' | (SEQ ID NO: 7121) |
|  | 3'-GUCUUACGGCAAGCGGAAGUAAUACCU-5' | (SEQ ID NO: 1576) |
| βc-m1682 Target: | 5'-CAGAATGCCGTTCGCCTTCATTATGGA-3' | (SEQ ID NO: 2685) |
|  | 5'-UCGCCUUCAUUAUGGACUGCCUGUUGU-3' | (SEQ ID NO: 7122) |
|  | 3'-AGCGGAAGUAAUACCUGACGGACAACA-5' | (SEQ ID NO: 1577) |
| βc-m1693 Target: | 5'-TCGCCTTCATTATGGACTGCCTGTTGT-3' | (SEQ ID NO: 2686) |
|  | 5'-UUCAUUAUGGACUGCCUGUUGUGGUUA-3' | (SEQ ID NO: 7123) |
|  | 3'-AAGUAAUACCUGACGGACAACACCAAU-5' | (SEQ ID NO: 1578) |
| βc-m1698 Target: | 5'-TTCATTATGGACTGCCTGTTGTGGTTA-3' | (SEQ ID NO: 2687) |
|  | 5'-UGGACUGCCUGUUGUGGUUAAACUCCU-3' | (SEQ ID NO: 7124) |
|  | 3'-ACCUGACGGACAACACCAAUUUGAGGA-5' | (SEQ ID NO: 1579) |
| βc-m1705 Target: | 5'-TGGACTGCCTGTTGTGGTTAAACTCCT-3' | (SEQ ID NO: 2688) |
|  | 5'-GCAACUGUUGGAUUGAUUCGAAACCUU-3' | (SEQ ID NO: 7125) |
|  | 3'-CGUUGACAACCUAACUAAGCUUUGGAA-5' | (SEQ ID NO: 1580) |
| βc-m1763 Target: | 5'-GCAACTGTTGGATTGATTCGAAACCTT-3' | (SEQ ID NO: 2689) |
|  | 5'-CCGAGGACUCAAUACCAUUCCAUUGUU-3' | (SEQ ID NO: 7126) |
|  | 3'-GGCUCCUGAGUUAUGGUAAGGUAACAA-5' | (SEQ ID NO: 1581) |
| βc-m2008 Target: | 5'-CCGAGGACTCAATACCATTCCATTGTT-3' | (SEQ ID NO: 2690) |
|  | 5'-CUGAGGACAAGCCACAGGAUUACAAGA-3' | (SEQ ID NO: 7127) |
|  | 3'-GACUCCUGUUCGGUGUCCUAAUGUUCU-5' | (SEQ ID NO: 1582) |
| βc-m2226 Target: | 5'-CTGAGGACAAGCCACAGGATTACAAGA-3' | (SEQ ID NO: 2691) |
|  | 5'-GGAUGGACCCUAUGAUGGAGCAUGAGA-3' | (SEQ ID NO: 7128) |
|  | 3'-CCUACCUGGGAUACUACCUCGUACUCU-5' | (SEQ ID NO: 1583) |
| βc-m2427 Target: | 5'-GGATGGACCCTATGATGGAGCATGAGA-3' | (SEQ ID NO: 2692) |
|  | 5'-UUGAUACUGACCUGUAAAUCGUCCUUU-3' | (SEQ ID NO: 7129) |
|  | 3'-AACUAUGACUGGACAUUUAGCAGGAAA-5' | (SEQ ID NO: 1584) |
| βc-m2568 Target: | 5'-TTGATACTGACCTGTAAATCGTCCTTT-3' | (SEQ ID NO: 2693) |

TABLE 8-continued

Selected Anti-β-catenin DsiRNA Agents, Blunt Duplexes

|  |  |  |
| --- | --- | --- |
|  | 5'-AGCCAGUGUGGGUGAAUACUUUACUCU-3' | (SEQ ID NO: 7130) |
|  | 3'-UCGGUCACACCCACUUAUGAAAUGAGA-5' | (SEQ ID NO: 1585) |
| βc-m2614 Target: | 5'-AGCCAGTGTGGGTGAATACTTTACTCT-3' | (SEQ ID NO: 2694) |
|  | 5'-UGCCACAGCUUUUGCAGCGUUAUACUC-3' | (SEQ ID NO: 7131) |
|  | 3'-ACGGUGUCGAAAACGUCGCAAUAUGAG-5' | (SEQ ID NO: 1586) |
| βc-m2770 Target: | 5'-TGCCACAGCTTTTGCAGCGTTATACTC-3' | (SEQ ID NO: 2695) |
|  | 5'-GCUUUUGCAGCGUUAUACUCAGAUGAG-3' | (SEQ ID NO: 7132) |
|  | 3'-CGAAAACGUCGCAAUAUGAGUCUACUC-5' | (SEQ ID NO: 1587) |
| βc-m2777 Target: | 5'-GCTTTTGCAGCGTTATACTCAGATGAG-3' | (SEQ ID NO: 2696) |
|  | 5'-CAGCGUUAUACUCAGAUGAGUAACAUU-3' | (SEQ ID NO: 7133) |
|  | 3'-GUCGCAAUAUGAGUCUACUCAUUGUAA-5' | (SEQ ID NO: 1588) |
| βc-m2784 Target: | 5'-CAGCGTTATACTCAGATGAGTAACATT-3' | (SEQ ID NO: 2697) |
|  | 5'-ACAUUUGCUGUUUUCAACAUUAAUAGC-3' | (SEQ ID NO: 7134) |
|  | 3'-UGUAAACGACAAAAGUUGUAAUUAUCG-5' | (SEQ ID NO: 1589) |
| βc-m2806 Target: | 5'-ACATTTGCTGTTTTCAACATTAATAGC-3' | (SEQ ID NO: 2698) |
|  | 5'-AGCUGUAGUGUCUGAACGUGCAUUGUG-3' | (SEQ ID NO: 7135) |
|  | 3'-UCGACAUCACAGACUUGCACGUAACAC-5' | (SEQ ID NO: 1590) |
| βc-m2850 Target: | 5'-AGCTGTAGTGTCTGAACGTGCATTGTG-3' | (SEQ ID NO: 2699) |
|  | 5'-GGGAACAGUCGAAGUACGCUUUUUGUU-3' | (SEQ ID NO: 7136) |
|  | 3'-CCCUUGUCAGCUUCAUGCGAAAAACAA-5' | (SEQ ID NO: 1591) |
| βc-m2965 Target: | 5'-GGGAACAGTCGAAGTACGCTTTTTGTT-3' | (SEQ ID NO: 2700) |
|  | 5'-CAGUCGAAGUACGCUUUUUGUUCUGGU-3' | (SEQ ID NO: 7137) |
|  | 3'-GUCAGCUUCAUGCGAAAAACAAGACCA-5' | (SEQ ID NO: 1592) |
| βc-m2970 Target: | 5'-CAGTCGAAGTACGCTTTTTGTTCTGGT-3' | (SEQ ID NO: 2701) |
|  | 5'-AAGUACGCUUUUUGUUCUGGUCCUUUU-3' | (SEQ ID NO: 7138) |
|  | 3'-UUCAUGCGAAAAACAAGACCAGGAAAA-5' | (SEQ ID NO: 1593) |
| βc-m2976 Target: | 5'-AAGTACGCTTTTTGTTCTGGTCCTTTT-3' | (SEQ ID NO: 2702) |
|  | 5'-ACCCUAGCCUUGCUUGUUCUUUGUUUU-3' | (SEQ ID NO: 7139) |
|  | 3'-UGGGAUCGGAACGAACAAGAAACAAAA-5' | (SEQ ID NO: 1594) |
| βc-m3092 Target: | 5'-ACCCTAGCCTTGCTTGTTCTTTGTTTT-3' | (SEQ ID NO: 2703) |
|  | 5'-AGCCUUGCUUGUUCUUUGUUUUAAUAU-3' | (SEQ ID NO: 7140) |
|  | 3'-UCGGAACGAACAAGAAACAAAAUUAUA-5' | (SEQ ID NO: 1595) |
| βc-m3097 Target: | 5'-AGCCTTGCTTGTTCTTTGTTTTAATAT-3' | (SEQ ID NO: 2704) |
|  | 5'-UGAACCUGCUACAGCAAUUUCUGAUUU-3' | (SEQ ID NO: 7141) |
|  | 3'-ACUUGGACGAUGUCGUUAAAGACUAAA-5' | (SEQ ID NO: 1596) |
| βc-m3198 Target: | 5'-TGAACCTGCTACAGCAATTTCTGATTT-3' | (SEQ ID NO: 2705) |
|  | 5'-UACAGCAAUUUCUGAUUUCUAAGAACC-3' | (SEQ ID NO: 7142) |
|  | 3'-AUGUCGUUAAAGACUAAAGAUUCUUGG-5' | (SEQ ID NO: 1597) |
| βc-m3207 Target: | 5'-TACAGCAATTTCTGATTTCTAAGAACC-3' | (SEQ ID NO: 2706) |

TABLE 8-continued

Selected Anti-β-catenin DsiRNA Agents, Blunt Duplexes

```
                5'-CAGUAAGAGGUGUUAUUUGAGCCUUGU-3'    (SEQ ID NO: 7143)
                3'-GUCAUUCUCCACAAUAAACUCGGAACA-5'    (SEQ ID NO: 1598)
βc-m3433 Target: 5'-CAGTAAGAGGTGTTATTTGAGCCTTGT-3'   (SEQ ID NO: 2707)
                5'-GAGGUGUUAUUUGAGCCUUGUUUUGGA-3'    (SEQ ID NO: 7144)
                3'-CUCCACAAUAAACUCGGAACAAAACCU-5'    (SEQ ID NO: 1599)
βc-m3439 Target: 5'-GAGGTGTTATTTGAGCCTTGTTTTGGA-3'   (SEQ ID NO: 2708)
                5'-GUUAUUUGAGCCUUGUUUUGGACAGUA-3'    (SEQ ID NO: 7145)
                3'-CAAUAAACUCGGAACAAAACCUGUCAU-5'    (SEQ ID NO: 1600)
βc-m3444 Target: 5'-GTTATTTGAGCCTTGTTTTGGACAGTA-3'   (SEQ ID NO: 2709)
                5'-UUGAGCCUUGUUUUGGACAGUAUACCA-3'    (SEQ ID NO: 7146)
                3'-AACUCGGAACAAAACCUGUCAUAUGGU-5'    (SEQ ID NO: 1601)
βc-m3449 Target: 5'-TTGAGCCTTGTTTTGGACAGTATACCA-3'   (SEQ ID NO: 2710)
                5'-UUCAACAGAUGCGGUUAUAGAAAUGGU-3'    (SEQ ID NO: 7147)
                3'-AAGUUGUCUACGCCAAUAUCUUUACCA-5'    (SEQ ID NO: 1602)
βc-m3522 Target: 5'-TTCAACAGATGCGGTTATAGAAATGGT-3'   (SEQ ID NO: 2711)
                5'-CGGUUAUAGAAAUGGUUCAGAAUUAAA-3'    (SEQ ID NO: 7148)
                3'-GCCAAUAUCUUUACCAAGUCUUAAUUU-5'    (SEQ ID NO: 1603)
βc-m3533 Target: 5'-CGGTTATAGAAATGGTTCAGAATTAAA-3'   (SEQ ID NO: 2712)
                5'-AUAGAAAUGGUUCAGAAUUAAACUUUU-3'    (SEQ ID NO: 7149)
                3'-UAUCUUUACCAAGUCUUAAUUUGAAAA-5'    (SEQ ID NO: 1604)
βc-m3538 Target: 5'-ATAGAAATGGTTCAGAATTAAACTTTT-3'   (SEQ ID NO: 2713)
```

TABLE 9

Additional Selected Anti-β-catenin DsiRNAs, 25/27mer Duplexes

```
                5'-UGUAUGGUAUACUUCAAAUACCCtc-3'     (SEQ ID NO: 496)
                3'-CAACAUACCAUAUGAAGUUUAUGGGAG-5'   (SEQ ID NO: 1605)
βc-244 Target:  5'-GTTGTATGGTATACTTCAAATACCCTC-3'   (SEQ ID NO: 2714)
                5'-AAACAGUUGUAUGGUAUACUUCAaa-3'    (SEQ ID NO: 497)
                3'-GUUUUGUCAACAUACCAUAUGAAGUUU-5'   (SEQ ID NO: 1606)
βc-251 Target:  5'-CAAAACAGTTGTATGGTATACTTCAAA-3'   (SEQ ID NO: 2715)
                5'-AAAACAGUUGUAUGGUAUACUUCaa-3'    (SEQ ID NO: 498)
                3'-AGUUUUGUCAACAUACCAUAUGAAGUU-5'   (SEQ ID NO: 1607)
βc-252 Target:  5'-TCAAAACAGTTGTATGGTATACTTCAA-3'   (SEQ ID NO: 2716)
                5'-UCAAAACAGUUGUAUGGUAUACUtc-3'    (SEQ ID NO: 499)
                3'-AAAGUUUUGUCAACAUACCAUAUGAAG-5'   (SEQ ID NO: 1608)
βc-254 Target:  5'-TTTCAAAACAGTTGTATGGTATACTTC-3'   (SEQ ID NO: 2717)
                5'-UUCAAAACAGUUGUAUGGUAUACtt-3'    (SEQ ID NO: 500)
                3'-AAAAGUUUUGUCAACAUACCAUAUGAA-5'   (SEQ ID NO: 1609)
βc-255 Target:  5'-TTTTCAAAACAGTTGTATGGTATACTT-3'   (SEQ ID NO: 2718)
```

TABLE 9-continued

Additional Selected Anti-β-catenin DsiRNAs, 25/27mer Duplexes

|  |  |  |  |
|---|---|---|---|
|  | 5'-UUUCAAAACAGUUGUAUGGUAUAct-3' | (SEQ ID NO: 501) |  |
|  | 3'-UAAAAGUUUUGUCAACAUACCAUAUGA-5' | (SEQ ID NO: 1610) |  |
| βc-256 Target: | 5'-ATTTTCAAAACAGTTGTATGGTATACT-3' | (SEQ ID NO: 2719) |  |
|  | 5'-GUCCACGCUGGAUUUUCAAAACAgt-3' | (SEQ ID NO: 502) |  |
|  | 3'-AACAGGUGCGACCUAAAAGUUUUGUCA-5' | (SEQ ID NO: 1611) |  |
| βc-269 Target: | 5'-TTGTCCACGCTGGATTTTCAAAACAGT-3' | (SEQ ID NO: 2720) |  |
|  | 5'-UGUCCACGCUGGAUUUUCAAAACag-3' | (SEQ ID NO: 503) |  |
|  | 3'-UAACAGGUGCGACCUAAAAGUUUUGUC-5' | (SEQ ID NO: 1612) |  |
| βc-270 Target: | 5'-ATTGTCCACGCTGGATTTTCAAAACAG-3' | (SEQ ID NO: 2721) |  |
|  | 5'-AUCAAAUCAGCUUGAGUAGCCAUtg-3' | (SEQ ID NO: 504) |  |
|  | 3'-GGUAGUUUAGUCGAACUCAUCGGUAAC-5' | (SEQ ID NO: 1613) |  |
| βc-293 Target: | 5'-CCATCAAATCAGCTTGAGTAGCCATTG-3' | (SEQ ID NO: 2722) |  |
|  | 5'-UCCAACUCCAUCAAAUCAGCUUGag-3' | (SEQ ID NO: 505) |  |
|  | 3'-ACAGGUUGAGGUAGUUUAGUCGAACUC-5' | (SEQ ID NO: 1614) |  |
| βc-302 Target: | 5'-TGTCCAACTCCATCAAATCAGCTTGAG-3' | (SEQ ID NO: 2723) |  |
|  | 5'-UCCUCAGGAUUGCCUUUACCACUca-3' | (SEQ ID NO: 506) |  |
|  | 3'-GAAGGAGUCCUAACGGAAAUGGUGAGU-5' | (SEQ ID NO: 1615) |  |
| βc-431 Target: | 5'-CTTCCTCAGGATTGCCTTTACCACTCA-3' | (SEQ ID NO: 2724) |  |
|  | 5'-UUCCUCAGGAUUGCCUUUACCACtc-3' | (SEQ ID NO: 507) |  |
|  | 3'-AGAAGGAGUCCUAACGGAAAUGGUGAG-5' | (SEQ ID NO: 1616) |  |
| βc-432 Target: | 5'-TCTTCCTCAGGATTGCCTTTACCACTC-3' | (SEQ ID NO: 2725) |  |
|  | 5'-UCAAUAUCAGCUACUUGUUCUUGag-3' | (SEQ ID NO: 508) |  |
|  | 3'-GUAGUUAUAGUCGAUGAACAAGAACUC-5' | (SEQ ID NO: 1617) |  |
| βc-518 Target: | 5'-CATCAATATCAGCTACTTGTTCTTGAG-3' | (SEQ ID NO: 2726) |  |
|  | 5'-AUCAAUAUCAGCUACUUGUUCUUga-3' | (SEQ ID NO: 509) |  |
|  | 3'-GGUAGUUAUAGUCGAUGAACAAGAACU-5' | (SEQ ID NO: 1618) |  |
| βc-519 Target: | 5'-CCATCAATATCAGCTACTTGTTCTTGA-3' | (SEQ ID NO: 2727) |  |
|  | 5'-UGUCCAUCAAUAUCAGCUACUUGtt-3' | (SEQ ID NO: 510) |  |
|  | 3'-UGACAGGUAGUUAUAGUCGAUGAACAA-5' | (SEQ ID NO: 1619) |  |
| βc-524 Target: | 5'-ACTGTCCATCAATATCAGCTACTTGTT-3' | (SEQ ID NO: 2728) |  |
|  | 5'-UGCAUACUGUCCAUCAAUAUCAGct-3' | (SEQ ID NO: 511) |  |
|  | 3'-UAACGUAUGACAGGUAGUUAUAGUCGA-5' | (SEQ ID NO: 1620) |  |
| βc-531 Target: | 5'-ATTGCATACTGTCCATCAATATCAGCT-3' | (SEQ ID NO: 2729) |  |
|  | 5'-AGUCAUUGCAUACUGUCCAUCAAta-3' | (SEQ ID NO: 512) |  |
|  | 3'-GCUCAGUAACGUAUGACAGGUAGUUAU-5' | (SEQ ID NO: 1621) |  |
| βc-537 Target: | 5'-CGAGTCATTGCATACTGTCCATCAATA-3' | (SEQ ID NO: 2730) |  |
|  | 5'-UCAUCUAAUGUCUCAGGGAACAUag-3' | (SEQ ID NO: 513) |  |
|  | 3'-GGAGUAGAUUACAGAGUCCCUUGUAUC-5' | (SEQ ID NO: 1622) |  |
| βc-584 Target: | 5'-CCTCATCTAATGTCTCAGGGAACATAG-3' | (SEQ ID NO: 2731) |  |

TABLE 9-continued

Additional Selected Anti-β-catenin DsiRNAs, 25/27mer Duplexes

|  |  |  |  |
|---|---|---|---|
|  | 5'-ACAACUGCAUGUUUCAGCAUCUGtg-3' | (SEQ ID NO: 514) |  |
|  | 3'-AAUGUUGACGUACAAAGUCGUAGACAC-5' | (SEQ ID NO: 1623) |  |
| βc-680 Target: | 5'-TTACAACTGCATGTTTCAGCATCTGTG-3' | (SEQ ID NO: 2732) |  |
|  | 5'-UUACAACUGCAUGUUUCAGCAUCtg-3' | (SEQ ID NO: 515) |  |
|  | 3'-CAAAUGUUGACGUACAAAGUCGUAGAC-5' | (SEQ ID NO: 1624) |  |
| βc-682 Target: | 5'-GTTTACAACTGCATGTTTCAGCATCTG-3' | (SEQ ID NO: 2733) |  |
|  | 5'-UUAAUCAAGUUUACAACUGCAUGtt-3' | (SEQ ID NO: 516) |  |
|  | 3'-UCAAUUAGUUCAAAUGUUGACGUACAA-5' | (SEQ ID NO: 1625) |  |
| βc-692 Target: | 5'-AGTTAATCAAGTTTACAACTGCATGTT-3' | (SEQ ID NO: 2734) |  |
|  | 5'-UGAUAGUUAAUCAAGUUUACAACtg-3' | (SEQ ID NO: 517) |  |
|  | 3'-GAACUAUCAAUUAGUUCAAAUGUUGAC-5' | (SEQ ID NO: 1626) |  |
| βc-698 Target: | 5'-CTTGATAGTTAATCAAGTTTACAACTG-3' | (SEQ ID NO: 2735) |  |
|  | 5'-GCAUCAUCUUGAUAGUUAAUCAAgt-3' | (SEQ ID NO: 518) |  |
|  | 3'-GACGUAGUAGAACUAUCAAUUAGUUCA-5' | (SEQ ID NO: 1627) |  |
| βc-707 Target: | 5'-CTGCATCATCTTGATAGTTAATCAAGT-3' | (SEQ ID NO: 2736) |  |
|  | 5'-UGCAUCAUCUUGAUAGUUAAUCAag-3' | (SEQ ID NO: 519) |  |
|  | 3'-AGACGUAGUAGAACUAUCAAUUAGUUC-5' | (SEQ ID NO: 1628) |  |
| βc-708 Target: | 5'-TCTGCATCATCTTGATAGTTAATCAAG-3' | (SEQ ID NO: 2737) |  |
|  | 5'-GGUCCUCGUCAUUUAGCAGUUUUgt-3' | (SEQ ID NO: 520) |  |
|  | 3'-GACCAGGAGCAGUAAAUCGUCAAAACA-5' | (SEQ ID NO: 1629) |  |
| βc-763 Target: | 5'-CTGGTCCTCGTCATTTAGCAGTTTTGT-3' | (SEQ ID NO: 2738) |  |
|  | 5'-UAACUGCAGCCUUAUUAACCACCac-3' | (SEQ ID NO: 521) |  |
|  | 3'-GUAUUGACGUCGGAAUAAUUGGUGGUG-5' | (SEQ ID NO: 1630) |  |
| βc-790 Target: | 5'-CATAACTGCAGCCTTATTAACCACCAC-3' | (SEQ ID NO: 2739) |  |
|  | 5'-AUAACUGCAGCCUUAUUAACCACca-3' | (SEQ ID NO: 522) |  |
|  | 3'-GGUAUUGACGUCGGAAUAAUUGGUGGU-5' | (SEQ ID NO: 1631) |  |
| βc-791 Target: | 5'-CCATAACTGCAGCCTTATTAACCACCA-3' | (SEQ ID NO: 2740) |  |
|  | 5'-ACCAUAACUGCAGCCUUAUUAACca-3' | (SEQ ID NO: 523) |  |
|  | 3'-CCUGGUAUUGACGUCGGAAUAAUUGGU-5' | (SEQ ID NO: 1632) |  |
| βc-794 Target: | 5'-GGACCATAACTGCAGCCTTATTAACCA-3' | (SEQ ID NO: 2741) |  |
|  | 5'-UUUUUAGAAAGCUGAUGGACCAUaa-3' | (SEQ ID NO: 524) |  |
|  | 3'-GGAAAAAUCUUUCGACUACCUGGUAUU-5' | (SEQ ID NO: 1633) |  |
| βc-812 Target: | 5'-CCTTTTTAGAAAGCTGATGGACCATAA-3' | (SEQ ID NO: 2742) |  |
|  | 5'-GGUACGUACAAUAGCAGACACCAtc-3' | (SEQ ID NO: 525) |  |
|  | 3'-UACCAUGCAUGUUAUCGUCUGUGGUAG-5' | (SEQ ID NO: 1634) |  |
| βc-873 Target: | 5'-ATGGTACGTACAATAGCAGACACCATC-3' | (SEQ ID NO: 2743) |  |
|  | 5'-UCAUUUGUAUUCUGCAUGGUACGta-3' | (SEQ ID NO: 526) |  |
|  | 3'-GUAGUAAACAUAAGACGUACCAUGCAU-5' | (SEQ ID NO: 1635) |  |
| βc-890 Target: | 5'-CATCATTTGTATTCTGCATGGTACGTA-3' | (SEQ ID NO: 2744) |  |

TABLE 9-continued

Additional Selected Anti-β-catenin DsiRNAs, 25/27mer Duplexes

|  |  |  |  |
|---|---|---|---|
|  | 5'-GUUUCUACAUCAUUUGUAUUCUGca-3' | (SEQ ID NO: 527) |  |
|  | 3'-GACAAAGAUGUAGUAAACAUAAGACGU-5' | (SEQ ID NO: 1636) |  |
| βc-899 Target: | 5'-CTGTTTCTACATCATTTGTATTCTGCA-3' | (SEQ ID NO: 2745) |  |
|  | 5'-UGUUUCUACAUCAUUUGUAUUCUgc-3' | (SEQ ID NO: 528) |  |
|  | 3'-CGACAAAGAUGUAGUAAACAUAAGACG-5' | (SEQ ID NO: 1637) |  |
| βc-900 Target: | 5'-GCTGTTTCTACATCATTTGTATTCTGC-3' | (SEQ ID NO: 2746) |  |
|  | 5'-ACAACGAGCUGUUUCUACAUCAUtt-3' | (SEQ ID NO: 529) |  |
|  | 3'-CAUGUUGCUCGACAAAGAUGUAGUAAA-5' | (SEQ ID NO: 1638) |  |
| βc-909 Target: | 5'-GTACAACGAGCTGTTTCTACATCATTT-3' | (SEQ ID NO: 2747) |  |
|  | 5'-GUACAACGAGCUGUUUCUACAUCat-3' | (SEQ ID NO: 530) |  |
|  | 3'-GCCAUGUUGCUCGACAAAGAUGUAGUA-5' | (SEQ ID NO: 1639) |  |
| βc-911 Target: | 5'-CGGTACAACGAGCTGTTTCTACATC-3' | (SEQ ID NO: 2748) |  |
|  | 5'-GGUACAACGAGCUGUUUCUACAUca-3' | (SEQ ID NO: 531) |  |
|  | 3'-CGCCAUGUUGCUCGACAAAGAUGUAGU-5' | (SEQ ID NO: 1640) |  |
| βc-912 Target: | 5'-GCGGTACAACGAGCTGTTTCTACATCA-3' | (SEQ ID NO: 2749) |  |
|  | 5'-AUAAAACAACACAGAAUCCACUGgt-3' | (SEQ ID NO: 532) |  |
|  | 3'-CGUAUUUGUUGUGUCUUAGGUGACCA-5' | (SEQ ID NO: 1641) |  |
| βc-1032 Target: | 5'-GCATAAAACAACACAGAATCCACTGGT-3' | (SEQ ID NO: 2750) |  |
|  | 5'-GCAUAAAACAACACAGAAUCCACtg-3' | (SEQ ID NO: 533) |  |
|  | 3'-ACCGUAUUUGUUGUGUCUUAGGUGAC-5' | (SEQ ID NO: 1642) |  |
| βc-1034 Target: | 5'-TGGCATAAAACAACACAGAATCCACTG-3' | (SEQ ID NO: 2751) |  |
|  | 5'-GGCAUAAAACAACACAGAAUCCAct-3' | (SEQ ID NO: 534) |  |
|  | 3'-UACCGUAUUUGUUGUGUCUUAGGUGA-5' | (SEQ ID NO: 1643) |  |
| βc-1035 Target: | 5'-ATGGCATAAAACAACACAGAATCCACT-3' | (SEQ ID NO: 2752) |  |
|  | 5'-GCUCCUUCUUGAUGUAAUAAAAGgt-3' | (SEQ ID NO: 535) |  |
|  | 3'-AUCGAGGAAGAACUACAUUAUUUUCCA-5' | (SEQ ID NO: 1644) |  |
| βc-1076 Target: | 5'-TAGCTCCTTCTTGATGTAATAAAAGGT-3' | (SEQ ID NO: 2753) |  |
|  | 5'-AGCUCCUUCUUGAUGUAAUAAAAgg-3' | (SEQ ID NO: 536) |  |
|  | 3'-AAUCGAGGAAGAACUACAUUAUUUUCC-5' | (SEQ ID NO: 1645) |  |
| βc-1077 Target: | 5'-TTAGCTCCTTCTTGATGTAATAAAAGG-3' | (SEQ ID NO: 2754) |  |
|  | 5'-UAACAUUUGUUUUGUUGAGCAAGgc-3' | (SEQ ID NO: 537) |  |
|  | 3'-AAAUUGUAAACAAAACAACUCGUUCCG-5' | (SEQ ID NO: 1646) |  |
| βc-1144 Target: | 5'-TTTAACATTTGTTTTGTTGAGCAAGGC-3' | (SEQ ID NO: 2755) |  |
|  | 5'-GCCAAGAAUUUAACAUUUGUUUUgt-3' | (SEQ ID NO: 538) |  |
|  | 3'-AUCGGUUCUUAAAUUGUAAACAAAACA-5' | (SEQ ID NO: 1647) |  |
| βc-1154 Target: | 5'-TAGCCAAGAATTTAACATTTGTTTTGT-3' | (SEQ ID NO: 2756) |  |
|  | 5'-UAAUAGCCAAGAAUUUAACAUUUgt-3' | (SEQ ID NO: 539) |  |
|  | 3'-GCAUUAUCGGUUCUUAAAUUGUAAACA-5' | (SEQ ID NO: 1648) |  |
| βc-1159 Target: | 5'-CGTAATAGCCAAGAATTTAACATTTGT-3' | (SEQ ID NO: 2757) |  |

TABLE 9-continued

Additional Selected Anti-β-catenin DsiRNAs, 25/27mer Duplexes

|  |  |  |  |
|---|---|---|---|
|  | 5'-GUAAUAGCCAAGAAUUUAACAUUtg-3' | (SEQ ID NO: 540) |  |
|  | 3'-AGCAUUAUCGGUUCUUAAAUUGUAAAC-5' | (SEQ ID NO: 1649) |  |
| βc-1160 Target: | 5'-TCGTAATAGCCAAGAATTTAACATTTG-3' | (SEQ ID NO: 2758) |  |
|  | 5'-AGCUAAAAUUUGAAGGCAGUCUGtc-3' | (SEQ ID NO: 541) |  |
|  | 3'-AUUCGAUUUUAAACUUCCGUCAGACAG-5' | (SEQ ID NO: 1650) |  |
| βc-1185 Target: | 5'-TAAGCTAAAATTTGAAGGCAGTCTGTC-3' | (SEQ ID NO: 2759) |  |
|  | 5'-GGUCCUCAUUAUAUUUACUAAAGct-3' | (SEQ ID NO: 542) |  |
|  | 3'-AUCCAGGAGUAAUAUAAAUGAUUUCGA-5' | (SEQ ID NO: 1651) |  |
| βc-1260 Target: | 5'-TAGGTCCTCATTATATTTACTAAAGCT-3' | (SEQ ID NO: 2760) |  |
|  | 5'-GUAUAGGUCCUCAUUAUAUUUACta-3' | (SEQ ID NO: 543) |  |
|  | 3'-UUCAUAUCCAGGAGUAAUAUAAAUGAU-5' | (SEQ ID NO: 1652) |  |
| βc-1265 Target: | 5'-AAGTATAGGTCCTCATTATATTTACTA-3' | (SEQ ID NO: 2761) |  |
|  | 5'-AGUAUAGGUCCUCAUUAUAUUUAct-3' | (SEQ ID NO: 544) |  |
|  | 3'-AUUCAUAUCCAGGAGUAAUAUAAAUGA-5' | (SEQ ID NO: 1653) |  |
| βc-1266 Target: | 5'-TAAGTATAGGTCCTCATTATATTTACT-3' | (SEQ ID NO: 2762) |  |
|  | 5'-UUUUCGUAAGUAUAGGUCCUCAUta-3' | (SEQ ID NO: 545) |  |
|  | 3'-CAAAAAGCAUUCAUAUCCAGGAGUAAU-5' | (SEQ ID NO: 1654) |  |
| βc-1274 Target: | 5'-GTTTTTCGTAAGTATAGGTCCTCATTA-3' | (SEQ ID NO: 2763) |  |
|  | 5'-UUUUUCGUAAGUAUAGGUCCUCAtt-3' | (SEQ ID NO: 546) |  |
|  | 3'-UCAAAAAGCAUUCAUAUCCAGGAGUAA-5' | (SEQ ID NO: 1655) |  |
| βc-1275 Target: | 5'-AGTTTTTCGTAAGTATAGGTCCTCATT-3' | (SEQ ID NO: 2764) |  |
|  | 5'-GUUUUUCGUAAGUAUAGGUCCUCat-3' | (SEQ ID NO: 547) |  |
|  | 3'-AUCAAAAAGCAUUCAUAUCCAGGAGUA-5' | (SEQ ID NO: 1656) |  |
| βc-1276 Target: | 5'-TAGTTTTTCGTAAGTATAGGTCCTC-3' | (SEQ ID NO: 2765) |  |
|  | 5'-AGUUUUUCGUAAGUAUAGGUCCUca-3' | (SEQ ID NO: 548) |  |
|  | 3'-CAUCAAAAAGCAUUCAUAUCCAGGAGU-5' | (SEQ ID NO: 1657) |  |
| βc-1277 Target: | 5'-GTAGTTTTTCGTAAGTATAGGTCCTCA-3' | (SEQ ID NO: 2766) |  |
|  | 5'-GGUCCACAGUAGUUUUUCGUAAGta-3' | (SEQ ID NO: 549) |  |
|  | 3'-CACCAGGUGUCAUCAAAAAGCAUUCAU-5' | (SEQ ID NO: 1658) |  |
| βc-1287 Target: | 5'-GTGGTCCACAGTAGTTTTTCGTAAGTA-3' | (SEQ ID NO: 2767) |  |
|  | 5'-UACAAUAGCCGGCUUAUUACUAGag-3' | (SEQ ID NO: 550) |  |
|  | 3'-AGAUGUUAUCGGCCGAAUAAUGAUCUC-5' | (SEQ ID NO: 1659) |  |
| βc-1344 Target: | 5'-TCTACAATAGCCGGCTTATTACTAGAG-3' | (SEQ ID NO: 2768) |  |
|  | 5'-UCUACAAUAGCCGGCUUAUUACUag-3' | (SEQ ID NO: 551) |  |
|  | 3'-GAAGAUGUUAUCGGCCGAAUAAUGAUC-5' | (SEQ ID NO: 1660) |  |
| βc-1346 Target: | 5'-CTTCTACAATAGCCGGCTTATTACTAG-3' | (SEQ ID NO: 2769) |  |
|  | 5'-UCCUAAAGCUUGCAUUCCACCAGct-3' | (SEQ ID NO: 552) |  |
|  | 3'-UCAGGAUUUCGAACGUAAGGUGGUCGA-5' | (SEQ ID NO: 1661) |  |
| βc-1371 Target: | 5'-AGTCCTAAAGCTTGCATTCCACCAGCT-3' | (SEQ ID NO: 2770) |  |

TABLE 9-continued

Additional Selected Anti-β-catenin DsiRNAs, 25/27mer Duplexes

|  |  |  |  |
|---|---|---|---|
|  | 5'-GUCCUAAAGCUUGCAUUCCACCAgc-3' | (SEQ ID NO: 553) |  |
|  | 3'-UUCAGGAUUUCGAACGUAAGGUGGUCG-5' | (SEQ ID NO: 1662) |  |
| βc-1372 Target: | 5'-AAGTCCTAAAGCTTGCATTCCACCAGC-3' | (SEQ ID NO: 2771) |  |
|  | 5'-AGUCCUAAAGCUUGCAUUCCACCAg-3' | (SEQ ID NO: 554) |  |
|  | 3'-CUUCAGGAUUUCGAACGUAAGGUGGUC-5' | (SEQ ID NO: 1663) |  |
| βc-1373 Target: | 5'-GAAGTCCTAAAGCTTGCATTCCACCAG-3' | (SEQ ID NO: 2772) |  |
|  | 5'-GUUCUGAACAAGACGUUGACUUGga-3' | (SEQ ID NO: 555) |  |
|  | 3'-GUCAAGACUUGUUCUGCAACUGAACCU-5' | (SEQ ID NO: 1664) |  |
| βc-1410 Target: | 5'-CAGTTCTGAACAAGACGTTGACTTGGA-3' | (SEQ ID NO: 2773) |  |
|  | 5'-AGUUCUGAACAAGACGUUGACUUgg-3' | (SEQ ID NO: 556) |  |
|  | 3'-UGUCAAGACUUGUUCUGCAACUGAACC-5' | (SEQ ID NO: 1665) |  |
| βc-1411 Target: | 5'-ACAGTTCTGAACAAGACGTTGACTTGG-3' | (SEQ ID NO: 2774) |  |
|  | 5'-GUCCAAAGACAGUUCUGAACAAGac-3' | (SEQ ID NO: 557) |  |
|  | 3'-CUCAGGUUUCUGUCAAGACUUGUUCUG-5' | (SEQ ID NO: 1666) |  |
| βc-1421 Target: | 5'-GAGTCCAAAGACAGTTCTGAACAAGAC-3' | (SEQ ID NO: 2775) |  |
|  | 5'-UUCCUGUUUAGUUGCAGCAUCUGaa-3' | (SEQ ID NO: 558) |  |
|  | 3'-GGAAGGACAAAUCAACGUCGUAGACUU-5' | (SEQ ID NO: 1667) |  |
| βc-1458 Target: | 5'-CCTTCCTGTTTAGTTGCAGCATCTGAA-3' | (SEQ ID NO: 2776) |  |
|  | 5'-ACAUUUAUAUCAUCUGAACCCAGaa-3' | (SEQ ID NO: 559) |  |
|  | 3'-GGUGUAAAUAUAGUAGACUUGGGUCUU-5' | (SEQ ID NO: 1668) |  |
| βc-1517 Target: | 5'-CCACATTTATATCATCTGAACCCAGAA-3' | (SEQ ID NO: 2777) |  |
|  | 5'-ACCACAUUUAUAUCAUCUGAACCca-3' | (SEQ ID NO: 560) |  |
|  | 3'-ACUGGUGUAAAUAUAGUAGACUUGGGU-5' | (SEQ ID NO: 1669) |  |
| βc-1520 Target: | 5'-TGACCACATTTATATCATCTGAACCCA-3' | (SEQ ID NO: 2778) |  |
|  | 5'-GCACAGGUGACCACAUUUAUAUCat-3' | (SEQ ID NO: 561) |  |
|  | 3'-GACGUGUCCACUGGUGUAAAUAUAGUA-5' | (SEQ ID NO: 1670) |  |
| βc-1529 Target: | 5'-CTGCACAGGTGACCACATTTATATC-3' | (SEQ ID NO: 2779) |  |
|  | 5'-UGCACAGGUGACCACAUUUAUAUca-3' | (SEQ ID NO: 562) |  |
|  | 3'-CGACGUGUCCACUGGUGUAAAUAUAGU-5' | (SEQ ID NO: 1671) |  |
| βc-1530 Target: | 5'-GCTGCACAGGTGACCACATTTATATCA-3' | (SEQ ID NO: 2780) |  |
|  | 5'-UGCAAGUGAGGUUAGAAAGAAUUcc-3' | (SEQ ID NO: 563) |  |
|  | 3'-UAACGUUCACUCCAAUCUUUCUUAAGG-5' | (SEQ ID NO: 1672) |  |
| βc-1558 Target: | 5'-ATTGCAAGTGAGGTTAGAAAGAATTCC-3' | (SEQ ID NO: 2781) |  |
|  | 5'-AUAAUUAUUGCAAGUGAGGUUAGaa-3' | (SEQ ID NO: 564) |  |
|  | 3'-AAUAUUAAUAACGUUCACUCCAAUCUU-5' | (SEQ ID NO: 1673) |  |
| βc-1566 Target: | 5'-TTATAATTATTGCAAGTGAGGTTAGAA-3' | (SEQ ID NO: 2782) |  |
|  | 5'-UCAUCUUGUUCUUAUAAUUAUUGca-3' | (SEQ ID NO: 565) |  |
|  | 3'-GUAGUAGAACAAGAAUAUUAAUAACGU-5' | (SEQ ID NO: 1674) |  |
| βc-1579 Target: | 5'-CATCATCTTGTTCTTATAATTATTGCA-3' | (SEQ ID NO: 2783) |  |

TABLE 9-continued

Additional Selected Anti-β-catenin DsiRNAs, 25/27mer Duplexes

|  |  |  |
|---|---|---|
|  | 5'-AUCAUCUUGUUCUUAUAAUUAUUgc-3' | (SEQ ID NO: 566) |
|  | 3'-<u>GG</u>UAGUAGAACAAGAAUAUUAAUAACG-5' | (SEQ ID NO: 1675) |
| βc-1580 Target: | 5'-CCATCATCTTGTTCTTATAATTATTGC-3' | (SEQ ID NO: 2784) |
|  | 5'-ACCAUCAUCUUGUUCUUAUAAUUat-3' | (SEQ ID NO: 567) |
|  | 3'-<u>UC</u>UGGUAGUAGAACAAGAAUAUUAAUA-5' | (SEQ ID NO: 1676) |
| βc-1583 Target: | 5'-AGACCATCATCTTGTTCTTATAATTAT-3' | (SEQ ID NO: 2785) |
|  | 5'-AGACCAUCAUCUUGUUCUUAUAAtt-3' | (SEQ ID NO: 568) |
|  | 3'-<u>CG</u>UCUGGUAGUAGAACAAGAAUAUUAA-5' | (SEQ ID NO: 1677) |
| βc-1585 Target: | 5'-GCAGACCATCATCTTGTTCTTATAATT-3' | (SEQ ID NO: 2786) |
|  | 5'-AAUCCAACAGUAGCCUUUAUCAGag-3' | (SEQ ID NO: 569) |
|  | 3'-<u>AG</u>UUAGGUUGUCAUCGGAAAUAGUCUC-5' | (SEQ ID NO: 1678) |
| βc-1808 Target: | 5'-TCAATCCAACAGTAGCCTTTATCAGAG-3' | (SEQ ID NO: 2787) |
|  | 5'-GAAUCAAUCCAACAGUAGCCUUUat-3' | (SEQ ID NO: 570) |
|  | 3'-<u>AG</u>CUUAGUUAGGUUGUCAUCGGAAAUA-5' | (SEQ ID NO: 1679) |
| βc-1813 Target: | 5'-TCGAATCAATCCAACAGTAGCCTTTAT-3' | (SEQ ID NO: 2788) |
|  | 5'-UCCACAAAUUGCUGCUGUGUCCCac-3' | (SEQ ID NO: 571) |
|  | 3'-<u>GG</u>AGGUGUUUAACGACGACACAGGGUG-5' | (SEQ ID NO: 1680) |
| βc-1955 Target: | 5'-CCTCCACAAATTGCTGCTGTGTCCCAC-3' | (SEQ ID NO: 2789) |
|  | 5'-ACAACCUUCAACUAUUUCUUCCAtg-3' | (SEQ ID NO: 572) |
|  | 3'-<u>CA</u>UGUUGGAAGUUGAUAAAGAAGGUAC-5' | (SEQ ID NO: 1681) |
| βc-1989 Target: | 5'-GTACAACCTTCAACTATTTCTTCCATG-3' | (SEQ ID NO: 2790) |
|  | 5'-UACAACCUUCAACUAUUUCUUCCat-3' | (SEQ ID NO: 573) |
|  | 3'-<u>CC</u>AUGUUGGAAGUUGAUAAAGAAGGUA-5' | (SEQ ID NO: 1682) |
| βc-1990 Target: | 5'-GGTACAACCTTCAACTATTTCTTCC-3' | (SEQ ID NO: 2791) |
|  | 5'-GUACAACCUUCAACUAUUUCUUCca-3' | (SEQ ID NO: 574) |
|  | 3'-<u>GC</u>CAUGUUGGAAGUUGAUAAAGAAGGU-5' | (SEQ ID NO: 1683) |
| βc-1991 Target: | 5'-CGGTACAACCTTCAACTATTTCTTCCA-3' | (SEQ ID NO: 2792) |
|  | 5'-GGUACAACCUUCAACUAUUUCUUcc-3' | (SEQ ID NO: 575) |
|  | 3'-<u>GG</u>CCAUGUUGGAAGUUGAUAAAGAAGG-5' | (SEQ ID NO: 1684) |
| βc-1992 Target: | 5'-CCGGTACAACCTTCAACTATTTCTTCC-3' | (SEQ ID NO: 2793) |
|  | 5'-GCUCCGGUACAACCUUCAACUAUtt-3' | (SEQ ID NO: 576) |
|  | 3'-<u>CC</u>CGAGGCCAUGUUGGAAGUUGAUAAA-5' | (SEQ ID NO: 1685) |
| βc-1997 Target: | 5'-GGGCTCCGGTACAACCTTCAACTATTT-3' | (SEQ ID NO: 2794) |
|  | 5'-ACAAUUCGGUUGUGAACAUCCCGag-3' | (SEQ ID NO: 577) |
|  | 3'-<u>AU</u>UGUUAAGCCAACACUUGUAGGGCUC-5' | (SEQ ID NO: 1686) |
| βc-2036 Target: | 5'-TAACAATTCGGTTGTGAACATCCCGAG-3' | (SEQ ID NO: 2795) |
|  | 5'-AACAAUUCGGUUGUGAACAUCCCga-3' | (SEQ ID NO: 578) |
|  | 3'-<u>UA</u>UUGUUAAGCCAACACUUGUAGGGCU-5' | (SEQ ID NO: 1687) |
| βc-2037 Target: | 5'-ATAACAATTCGGTTGTGAACATCCCGA-3' | (SEQ ID NO: 2796) |

TABLE 9-continued

Additional Selected Anti-β-catenin DsiRNAs, 25/27mer Duplexes

| | | | |
|---|---|---|---|
| | 5'-UAACAAUUCGGUUGUGAACAUCCcg-3' | (SEQ ID NO: 579) | |
| | 3'-CUAUUGUUAAGCCAACACUUGUAGGGC-5' | (SEQ ID NO: 1688) | |
| βc-2038 Target: | 5'-GATAACAATTCGGTTGTGAACATCCCG-3' | (SEQ ID NO: 2797) | |
| | 5'-AUAACAAUUCGGUUGUGAACAUCcc-3' | (SEQ ID NO: 580) | |
| | 3'-ACUAUUGUUAAGCCAACACUUGUAGGG-5' | (SEQ ID NO: 1689) | |
| βc-2039 Target: | 5'-TGATAACAATTCGGTTGTGAACATCCC-3' | (SEQ ID NO: 2798) | |
| | 5'-GAUAACAAUUCGGUUGUGAACAUcc-3' | (SEQ ID NO: 581) | |
| | 3'-GACUAUUGUUAAGCCAACACUUGUAGG-5' | (SEQ ID NO: 1690) | |
| βc-2040 Target: | 5'-CTGATAACAATTCGGTTGTGAACATCC-3' | (SEQ ID NO: 2799) | |
| | 5'-UGAUAACAAUUCGGUUGUGAACAtc-3' | (SEQ ID NO: 582) | |
| | 3'-AGACUAUUGUUAAGCCAACACUUGUAG-5' | (SEQ ID NO: 1691) | |
| βc-2041 Target: | 5'-TCTGATAACAATTCGGTTGTGAACATC-3' | (SEQ ID NO: 2800) | |
| | 5'-AUUUAGUCCUCUGAUAACAAUUCgg-3' | (SEQ ID NO: 583) | |
| | 3'-CAUAAAUCAGGAGACUAUUGUUAAGCC-5' | (SEQ ID NO: 1692) | |
| βc-2052 Target: | 5'-GTATTTAGTCCTCTGATAACAATTCGG-3' | (SEQ ID NO: 2801) | |
| | 5'-UAUUUAGUCCUCUGAUAACAAUUcg-3' | (SEQ ID NO: 584) | |
| | 3'-CCAUAAAUCAGGAGACUAUUGUUAAGC-5' | (SEQ ID NO: 1693) | |
| βc-2053 Target: | 5'-GGTATTTAGTCCTCTGATAACAATTCG-3' | (SEQ ID NO: 2802) | |
| | 5'-GUAUUUAGUCCUCUGAUAACAAUtc-3' | (SEQ ID NO: 585) | |
| | 3'-ACCAUAAAUCAGGAGACUAUUGUUAAG-5' | (SEQ ID NO: 1694) | |
| βc-2054 Target: | 5'-TGGTATTTAGTCCTCTGATAACAATTC-3' | (SEQ ID NO: 2803) | |
| | 5'-GGUAUUUAGUCCUCUGAUAACAAtt-3' | (SEQ ID NO: 586) | |
| | 3'-UACCAUAAAUCAGGAGACUAUUGUUAA-5' | (SEQ ID NO: 1695) | |
| βc-2055 Target: | 5'-ATGGTATTTAGTCCTCTGATAACAATT-3' | (SEQ ID NO: 2804) | |
| | 5'-ACAAUGGAAUGGUAUUUAGUCCUct-3' | (SEQ ID NO: 587) | |
| | 3'-UUUGUUACCUUACCAUAAAUCAGGAGA-5' | (SEQ ID NO: 1696) | |
| βc-2065 Target: | 5'-AAACAATGGAATGGTATTTAGTCCTCT-3' | (SEQ ID NO: 2805) | |
| | 5'-ACAAACAAUGGAAUGGUAUUUAGtc-3' | (SEQ ID NO: 588) | |
| | 3'-CGUGUUUGUUACCUUACCAUAAAUCAG-5' | (SEQ ID NO: 1697) | |
| βc-2069 Target: | 5'-GCACAAACAATGGAATGGTATTTAGTC-3' | (SEQ ID NO: 2806) | |
| | 5'-GCACAAACAAUGGAAUGGUAUUUag-3' | (SEQ ID NO: 589) | |
| | 3'-GACGUGUUUGUUACCUUACCAUAAAUC-5' | (SEQ ID NO: 1698) | |
| βc-2071 Target: | 5'-CTGCACAAACAATGGAATGGTATTTAG-3' | (SEQ ID NO: 2807) | |
| | 5'-UGCACAAACAAUGGAAUGGUAUUta-3' | (SEQ ID NO: 590) | |
| | 3'-CGACGUGUUUGUUACCUUACCAUAAAU-5' | (SEQ ID NO: 1699) | |
| βc-2072 Target: | 5'-GCTGCACAAACAATGGAATGGTATTTA-3' | (SEQ ID NO: 2808) | |
| | 5'-GCUACUCUUUGGAUGUUUUCAAUgg-3' | (SEQ ID NO: 591) | |
| | 3'-GUCGAUGAGAAACCUACAAAAGUUACC-5' | (SEQ ID NO: 1700) | |
| βc-2111 Target: | 5'-CAGCTACTCTTTGGATGTTTTCAATGG-3' | (SEQ ID NO: 2809) | |

TABLE 9-continued

Additional Selected Anti-β-catenin DsiRNAs, 25/27mer Duplexes

|  |  |  |  |
|---|---|---|---|
|  | 5'-AGCUACUCUUUGGAUGUUUUCAAtg-3' | (SEQ ID NO: 592) |  |
|  | 3'-CGUCGAUGAGAAACCUACAAAAGUUAC-5' | (SEQ ID NO: 1701) |  |
| βc-2112 Target: | 5'-GCAGCTACTCTTTGGATGTTTTCAATG-3' | (SEQ ID NO: 2810) |  |
|  | 5'-GCUUCAAUAGCUUCUGCAGCUUCct-3' | (SEQ ID NO: 593) |  |
|  | 3'-GUCGAAGUUAUCGAAGACGUCGAAGGA-5' | (SEQ ID NO: 1702) |  |
| βc-2168 Target: | 5'-CAGCTTCAATAGCTTCTGCAGCTTCCT-3' | (SEQ ID NO: 2811) |  |
|  | 5'-UCCCUCAGCUUCAAUAGCUUCUGca-3' | (SEQ ID NO: 594) |  |
|  | 3'-CGAGGGAGUCGAAGUUAUCGAAGACGU-5' | (SEQ ID NO: 1703) |  |
| βc-2175 Target: | 5'-GCTCCCTCAGCTTCAATAGCTTCTGCA-3' | (SEQ ID NO: 2812) |  |
|  | 5'-GCUCCCUCAGCUUCAAUAGCUUCtg-3' | (SEQ ID NO: 595) |  |
|  | 3'-ACCGAGGGAGUCGAAGUUAUCGAAGAC-5' | (SEQ ID NO: 1704) |  |
| βc-2177 Target: | 5'-TGGCTCCCTCAGCTTCAATAGCTTCTG-3' | (SEQ ID NO: 2813) |  |
|  | 5'-AUUCCUAGAGUGAAGUAACUCUGtc-3' | (SEQ ID NO: 596) |  |
|  | 3'-AGUAAGGAUCUCACUUCAUUGAGACAG-5' | (SEQ ID NO: 1705) |  |
| βc-2214 Target: | 5'-TCATTCCTAGAGTGAAGTAACTCTGTC-3' | (SEQ ID NO: 2814) |  |
|  | 5'-UCAUUCCUAGAGUGAAGUAACUCtg-3' | (SEQ ID NO: 597) |  |
|  | 3'-GAAGUAAGGAUCUCACUUCAUUGAGAC-5' | (SEQ ID NO: 1706) |  |
| βc-2216 Target: | 5'-CTTCATTCCTAGAGTGAAGTAACTCTG-3' | (SEQ ID NO: 2815) |  |
|  | 5'-UUCAUUCCUAGAGUGAAGUAACUct-3' | (SEQ ID NO: 598) |  |
|  | 3'-GGAAGUAAGGAUCUCACUUCAUUGAGA-5' | (SEQ ID NO: 1707) |  |
| βc-2217 Target: | 5'-CCTTCATTCCTAGAGTGAAGTAACTCT-3' | (SEQ ID NO: 2816) |  |
|  | 5'-UCCUCAGACAUUCGGAACAAAACag-3' | (SEQ ID NO: 599) |  |
|  | 3'-ACAGGAGUCUGUAAGCCUUGUUUUGUC-5' | (SEQ ID NO: 1708) |  |
| βc-2264 Target: | 5'-TGTCCTCAGACATTCGGAACAAAACAG-3' | (SEQ ID NO: 2817) |  |
|  | 5'-UGUCCUCAGACAUUCGGAACAAAac-3' | (SEQ ID NO: 600) |  |
|  | 3'-GAACAGGAGUCUGUAAGCCUUGUUUUG-5' | (SEQ ID NO: 1709) |  |
| βc-2266 Target: | 5'-CTTGTCCTCAGACATTCGGAACAAAAC-3' | (SEQ ID NO: 2818) |  |
|  | 5'-GUUUCUUGUAAUCUUGUGGCUUGtc-3' | (SEQ ID NO: 601) |  |
|  | 3'-GGCAAAGAACAUUAGAACACCGAACAG-5' | (SEQ ID NO: 1710) |  |
| βc-2287 Target: | 5'-CCGTTTCTTGTAATCTTGTGGCTTGTC-3' | (SEQ ID NO: 2819) |  |
|  | 5'-UGAAAGCCGUUUCUUGUAAUCUUgt-3' | (SEQ ID NO: 602) |  |
|  | 3'-UGACUUUCGGCAAAGAACAUUAGAACA-5' | (SEQ ID NO: 1711) |  |
| βc-2295 Target: | 5'-ACTGAAAGCCGTTTCTTGTAATCTTGT-3' | (SEQ ID NO: 2820) |  |
|  | 5'-GCUCAACUGAAAGCCGUUUCUUGta-3' | (SEQ ID NO: 603) |  |
|  | 3'-GUCGAGUUGACUUUCGGCAAAGAACAU-5' | (SEQ ID NO: 1712) |  |
| βc-2302 Target: | 5'-CAGCTCAACTGAAAGCCGTTTCTTGTA-3' | (SEQ ID NO: 2821) |  |
|  | 5'-AGUCCAAGAUCAGCAGUCUCAUUcc-3' | (SEQ ID NO: 604) |  |
|  | 3'-GUUCAGGUUCUAGUCGUCAGAGUAAGG-5' | (SEQ ID NO: 1713) |  |
| βc-2363 Target: | 5'-CAAGTCCAAGATCAGCAGTCTCATTCC-3' | (SEQ ID NO: 2822) |  |

TABLE 9-continued

Additional Selected Anti-β-catenin DsiRNAs, 25/27mer Duplexes

|  |  |  |
|---|---|---|
|  | 5'-ACCAUAUCAAGUCCAAGAUCAGca-3' | (SEQ ID NO: 605) |
|  | 3'-CGUGGUUAUAGUUCAGGUUCUAGUCGU-5' | (SEQ ID NO: 1714) |
| βc-2373 Target: | 5'-GCACCAATATCAAGTCCAAGATCAGCA-3' | (SEQ ID NO: 2823) |
|  | 5'-AGAACGAUAGCUAGGAUCAUCCUgg-3' | (SEQ ID NO: 606) |
|  | 3'-UUUCUUGCUAUCGAUCCUAGUAGGACC-5' | (SEQ ID NO: 1715) |
| βc-2424 Target: | 5'-AAAGAACGATAGCTAGGATCATCCTGG-3' | (SEQ ID NO: 2824) |
|  | 5'-UAUCCACCAGAGUGAAAAGAACGat-3' | (SEQ ID NO: 607) |
|  | 3'-GUAUAGGUGGUCUCACUUUUCUUGCUA-5' | (SEQ ID NO: 1716) |
| βc-2441 Target: | 5'-CATATCCACCAGAGTGAAAAGAACGAT-3' | (SEQ ID NO: 2825) |
|  | 5'-AUUUACAGGUCAGUAUCAAACCAgg-3' | (SEQ ID NO: 608) |
|  | 3'-ACUAAAUGUCCAGUCAUAGUUUGGUCC-5' | (SEQ ID NO: 1717) |
| βc-2618 Target: | 5'-TGATTTACAGGTCAGTATCAAACCAGG-3' | (SEQ ID NO: 2826) |
|  | 5'-GAUUUACAGGUCAGUAUCAAACCag-3' | (SEQ ID NO: 609) |
|  | 3'-UACUAAAUGUCCAGUCAUAGUUUGGUC-5' | (SEQ ID NO: 1718) |
| βc-2619 Target: | 5'-ATGATTTACAGGTCAGTATCAAACCAG-3' | (SEQ ID NO: 2827) |
|  | 5'-UGAUUUACAGGUCAGUAUCAAACca-3' | (SEQ ID NO: 610) |
|  | 3'-CUACUAAAUGUCCAGUCAUAGUUUGGU-5' | (SEQ ID NO: 1719) |
| βc-2620 Target: | 5'-GATGATTTACAGGTCAGTATCAAACCA-3' | (SEQ ID NO: 2828) |
|  | 5'-UCUUACCUAAAGGAUGAUUUACAgg-3' | (SEQ ID NO: 611) |
|  | 3'-GAAGAAUGGAUUUCCUACUAAAUGUCC-5' | (SEQ ID NO: 1720) |
| βc-2634 Target: | 5'-CTTCTTACCTAAAGGATGATTTACAGG-3' | (SEQ ID NO: 2829) |
|  | 5'-UUCUUACCUAAAGGAUGAUUUACag-3' | (SEQ ID NO: 612) |
|  | 3'-UGAAGAAUGGAUUUCCUACUAAAUGUC-5' | (SEQ ID NO: 1721) |
| βc-2635 Target: | 5'-ACTTCTTACCTAAAGGATGATTTACAG-3' | (SEQ ID NO: 2830) |
|  | 5'-ACUUCUUACCUAAAGGAUGAUUUac-3' | (SEQ ID NO: 613) |
|  | 3'-UUUGAAGAAUGGAUUUCCUACUAAAUG-5' | (SEQ ID NO: 1722) |
| βc-2637 Target: | 5'-AAACTTCTTACCTAAAGGATGATTTAC-3' | (SEQ ID NO: 2831) |
|  | 5'-UUUUUAAAACUUCUUACCUAAAGga-3' | (SEQ ID NO: 614) |
|  | 3'-CGAAAAAUUUUGAAGAAUGGAUUUCCU-5' | (SEQ ID NO: 1723) |
| βc-2645 Target: | 5'-GCTTTTTAAAACTTCTTACCTAAAGGA-3' | (SEQ ID NO: 2832) |
|  | 5'-GCUUUUUAAAACUUCUUACCUAAag-3' | (SEQ ID NO: 615) |
|  | 3'-ACCGAAAAAUUUUGAAGAAUGGAUUUC-5' | (SEQ ID NO: 1724) |
| βc-2647 Target: | 5'-TGGCTTTTTAAAACTTCTTACCTAAAG-3' | (SEQ ID NO: 2833) |
|  | 5'-AAACUGGCUUUUUAAAACUUCUUac-3' | (SEQ ID NO: 616) |
|  | 3'-GGUUUGACCGAAAAAUUUUGAAGAAUG-5' | (SEQ ID NO: 1725) |
| βc-2653 Target: | 5'-CCAAACTGGCTTTTTAAAACTTCTTAC-3' | (SEQ ID NO: 2834) |
|  | 5'-ACCCAAACUGGCUUUUUAAAACUtc-3' | (SEQ ID NO: 617) |
|  | 3'-AAUGGGUUUGACCGAAAAAUUUUGAAG-5' | (SEQ ID NO: 1726) |
| βc-2657 Target: | 5'-TTACCCAAACTGGCTTTTTAAAACTTC-3' | (SEQ ID NO: 2835) |

TABLE 9-continued

Additional Selected Anti-β-catenin DsiRNAs, 25/27mer Duplexes

|  |  |  |  |
|---|---|---|---|
|  | 5'-UACCCAAACUGGCUUUUUAAAACtt-3' | (SEQ ID NO: 618) |  |
|  | 3'-AAAUGGGUUUGACCGAAAAAUUUUGAA-5' | (SEQ ID NO: 1727) |  |
| βc-2658 Target: | 5'-TTTACCCAAACTGGCTTTTTAAAACTT-3' | (SEQ ID NO: 2836) |  |
|  | 5'-UUACCCAAACUGGCUUUUUAAAAct-3' | (SEQ ID NO: 619) |  |
|  | 3'-AAAUGGGUUUGACCGAAAAAUUUUGA-5' | (SEQ ID NO: 1728) |  |
| βc-2659 Target: | 5'-TTTTACCCAAACTGGCTTTTTAAAACT-3' | (SEQ ID NO: 2837) |  |
|  | 5'-UUUACCCAAACUGGCUUUUUAAAac-3' | (SEQ ID NO: 620) |  |
|  | 3'-UAAAAUGGGUUUGACCGAAAAAUUUUG-5' | (SEQ ID NO: 1729) |  |
| βc-2660 Target: | 5'-ATTTTACCCAAACTGGCTTTTTAAAAC-3' | (SEQ ID NO: 2838) |  |
|  | 5'-AACCAAGUCUUUCUGAAGUUCUGta-3' | (SEQ ID NO: 621) |  |
|  | 3'-GGUUGGUUCAGAAAGACUUCAAGACAU-5' | (SEQ ID NO: 1730) |  |
| βc-2701 Target: | 5'-CCAACCAAGTCTTTCTGAAGTTCTGTA-3' | (SEQ ID NO: 2839) |  |
|  | 5'-ACCCUACCAACCAAGUCUUUCUGaa-3' | (SEQ ID NO: 622) |  |
|  | 3'-GGUGGGAUGGUUGGUUCAGAAAGACUU-5' | (SEQ ID NO: 1731) |  |
| βc-2709 Target: | 5'-CCACCCTACCAACCAAGTCTTTCTGAA-3' | (SEQ ID NO: 2840) |  |
|  | 5'-UUACAAAUAGCCUAAACCACUCCca-3' | (SEQ ID NO: 623) |  |
|  | 3'-UAAAUGUUUAUCGGAUUUGGUGAGGGU-5' | (SEQ ID NO: 1732) |  |
| βc-2733 Target: | 5'-ATTTACAAATAGCCTAAACCACTCCCA-3' | (SEQ ID NO: 2841) |  |
|  | 5'-UUUACAAAUAGCCUAAACCACUCcc-3' | (SEQ ID NO: 624) |  |
|  | 3'-CUAAAUGUUUAUCGGAUUUGGUGAGGG-5' | (SEQ ID NO: 1733) |  |
| βc-2734 Target: | 5'-GATTTACAAATAGCCTAAACCACTCCC-3' | (SEQ ID NO: 2842) |  |
|  | 5'-AUUUACAAAUAGCCUAAACCACUcc-3' | (SEQ ID NO: 625) |  |
|  | 3'-UCUAAAUGUUUAUCGGAUUUGGUGAGG-5' | (SEQ ID NO: 1734) |  |
| βc-2735 Target: | 5'-AGATTTACAAATAGCCTAAACCACTCC-3' | (SEQ ID NO: 2843) |  |
|  | 5'-GAUUUACAAAUAGCCUAAACCACtc-3' | (SEQ ID NO: 626) |  |
|  | 3'-GUCUAAAUGUUUAUCGGAUUUGGUGAG-5' | (SEQ ID NO: 1735) |  |
| βc-2736 Target: | 5'-CAGATTTACAAATAGCCTAAACCACTC-3' | (SEQ ID NO: 2844) |  |
|  | 5'-UUUUUGUGGCAGAUUUACAAAUAgc-3' | (SEQ ID NO: 627) |  |
|  | 3'-ACAAAAACACCGUCUAAAUGUUUAUCG-5' | (SEQ ID NO: 1736) |  |
| βc-2747 Target: | 5'-TGTTTTTGTGGCAGATTTACAAATAGC-3' | (SEQ ID NO: 2845) |  |
|  | 5'-GUUUUUGUGGCAGAUUUACAAAUag-3' | (SEQ ID NO: 628) |  |
|  | 3'-GACAAAAACACCGUCUAAAUGUUUAUC-5' | (SEQ ID NO: 1737) |  |
| βc-2748 Target: | 5'-CTGTTTTTGTGGCAGATTTACAAATAG-3' | (SEQ ID NO: 2846) |  |
|  | 5'-UGUUUUUGUGGCAGAUUUACAAAta-3' | (SEQ ID NO: 629) |  |
|  | 3'-GGACAAAAACACCGUCUAAAUGUUUAU-5' | (SEQ ID NO: 1738) |  |
| βc-2749 Target: | 5'-CCTGTTTTTGTGGCAGATTTACAAATA-3' | (SEQ ID NO: 2847) |  |
|  | 5'-AUACCUGUUUUUGUGGCAGAUUUac-3' | (SEQ ID NO: 630) |  |
|  | 3'-UAUAUGGACAAAAACACCGUCUAAAUG-5' | (SEQ ID NO: 1739) |  |
| βc-2754 Target: | 5'-ATATACCTGTTTTTGTGGCAGATTTAC-3' | (SEQ ID NO: 2848) |  |

TABLE 9-continued

Additional Selected Anti-β-catenin DsiRNAs, 25/27mer Duplexes

|  |  |  |
|---|---|---|
|  | 5'-UUCAAAGUAUAUACCUGUUUUUGtg-3' | (SEQ ID NO: 631) |
|  | 3'-GAAAGUUUCAUAUAUGGACAAAAACAC-5' | (SEQ ID NO: 1740) |
| βc-2764 Target: | 5'-CTTTCAAAGTATATACCTGTTTTGTG-3' | (SEQ ID NO: 2849) |
|  | 5'-UCUCCUUUCAAAGUAUAUACCUGtt-3' | (SEQ ID NO: 632) |
|  | 3'-GUAGAGGAAAGUUUCAUAUAUGGACAA-5' | (SEQ ID NO: 1741) |
| βc-2770 Target: | 5'-CATCTCCTTTCAAAGTATATACCTGTT-3' | (SEQ ID NO: 2850) |
|  | 5'-AUCUCCUUUCAAAGUAUAUACCUgt-3' | (SEQ ID NO: 633) |
|  | 3'-UGUAGAGGAAAGUUUCAUAUAUGGACA-5' | (SEQ ID NO: 1742) |
| βc-2771 Target: | 5'-ACATCTCCTTTCAAAGTATATACCTGT-3' | (SEQ ID NO: 2851) |
|  | 5'-ACAUCUCCUUUCAAAGUAUAUACct-3' | (SEQ ID NO: 634) |
|  | 3'-UCUGUAGAGGAAAGUUUCAUAUAUGGA-5' | (SEQ ID NO: 1743) |
| βc-2773 Target: | 5'-AGACATCTCCTTTCAAAGTATATACCT-3' | (SEQ ID NO: 2852) |
|  | 5'-GACAUCUCCUUUCAAAGUAUAUAcc-3' | (SEQ ID NO: 635) |
|  | 3'-UUCUGUAGAGGAAAGUUUCAUAUAUGG-5' | (SEQ ID NO: 1744) |
| βc-2774 Target: | 5'-AAGACATCTCCTTTCAAAGTATATACC-3' | (SEQ ID NO: 2853) |
|  | 5'-AGACAUCUCCUUUCAAAGUAUAUac-3' | (SEQ ID NO: 636) |
|  | 3'-GUUCUGUAGAGGAAAGUUUCAUAUAUG-5' | (SEQ ID NO: 1745) |
| βc-2775 Target: | 5'-CAAGACATCTCCTTTCAAAGTATATAC-3' | (SEQ ID NO: 2854) |
|  | 5'-UUCCAAGACAUCUCCUUUCAAAGta-3' | (SEQ ID NO: 637) |
|  | 3'-ACAAGGUUCUGUAGAGGAAAGUUUCAU-5' | (SEQ ID NO: 1746) |
| βc-2780 Target: | 5'-TGTTCCAAGACATCTCCTTTCAAAGTA-3' | (SEQ ID NO: 2855) |
|  | 5'-UUCCAAUGUUCCAAGACAUCUCCtt-3' | (SEQ ID NO: 638) |
|  | 3'-GUAAGGUUACAAGGUUCUGUAGAGGAA-5' | (SEQ ID NO: 1747) |
| βc-2788 Target: | 5'-CATTCCAATGTTCCAAGACATCTCCTT-3' | (SEQ ID NO: 2856) |
|  | 5'-AUUCCAAUGUUCCAAGACAUCUCct-3' | (SEQ ID NO: 639) |
|  | 3'-UGUAAGGUUACAAGGUUCUGUAGAGGA-5' | (SEQ ID NO: 1748) |
| βc-2789 Target: | 5'-ACATTCCAATGTTCCAAGACATCTCCT-3' | (SEQ ID NO: 2857) |
|  | 5'-ACAUUCCAAUGUUCCAAGACAUCtc-3' | (SEQ ID NO: 640) |
|  | 3'-CUUGUAAGGUUACAAGGUUCUGUAGAG-5' | (SEQ ID NO: 1749) |
| βc-2791 Target: | 5'-GAACATTCCAATGTTCCAAGACATCTC-3' | (SEQ ID NO: 2858) |
|  | 5'-AGAAAUCUGAGAACAUUCCAAUGtt-3' | (SEQ ID NO: 641) |
|  | 3'-GGUCUUUAGACUCUUGUAAGGUUACAA-5' | (SEQ ID NO: 1750) |
| βc-2803 Target: | 5'-CCAGAAATCTGAGAACATTCCAATGTT-3' | (SEQ ID NO: 2859) |
|  | 5'-AACCAGAAAUCUGAGAACAUUCCaa-3' | (SEQ ID NO: 642) |
|  | 3'-UGUUGGUCUUUAGACUCUUGUAAGGUU-5' | (SEQ ID NO: 1751) |
| βc-2807 Target: | 5'-ACAACCAGAAATCTGAGAACATTCCAA-3' | (SEQ ID NO: 2860) |
|  | 5'-ACAACCAGAAAUCUGAGAACAUUcc-3' | (SEQ ID NO: 643) |
|  | 3'-AUUGUUGGUCUUUAGACUCUUGUAAGG-5' | (SEQ ID NO: 1752) |
| βc-2809 Target: | 5'-TAACAACCAGAAATCTGAGAACATTCC-3' | (SEQ ID NO: 2861) |

TABLE 9-continued

Additional Selected Anti-β-catenin DsiRNAs, 25/27mer Duplexes

|  |  |  |  |
|---|---|---|---|
|  | 5'-AACAACCAGAAAUCUGAGAACAUtc-3' | (SEQ ID NO: 644) |  |
|  | 3'-UAUUGUUGGUCUUUAGACUCUUGUAAG-5' | (SEQ ID NO: 1753) |  |
| βc-2810 Target: | 5'-ATAACAACCAGAAATCTGAGAACATTC-3' | (SEQ ID NO: 2862) |  |
|  | 5'-UAACAACCAGAAAUCUGAGAACAtt-3' | (SEQ ID NO: 645) |  |
|  | 3'-GUAUUGUUGGUCUUUAGACUCUUGUAA-5' | (SEQ ID NO: 1754) |  |
| βc-2811 Target: | 5'-CATAACAACCAGAAATCTGAGAACATT-3' | (SEQ ID NO: 2863) |  |
|  | 5'-AUCACAUAACAACCAGAAAUCUGag-3' | (SEQ ID NO: 646) |  |
|  | 3'-ACUAGUGUAUUGUUGGUCUUUAGACUC-5' | (SEQ ID NO: 1755) |  |
| βc-2817 Target: | 5'-TGATCACATAACAACCAGAAATCTGAG-3' | (SEQ ID NO: 2864) |  |
|  | 5'-GAUCACAUAACAACCAGAAAUCUga-3' | (SEQ ID NO: 647) |  |
|  | 3'-UACUAGUGUAUUGUUGGUCUUUAGACU-5' | (SEQ ID NO: 1756) |  |
| βc-2818 Target: | 5'-ATGATCACATAACAACCAGAAATCTGA-3' | (SEQ ID NO: 2865) |  |
|  | 5'-ACACAUGAUCACAUAACAACCAGaa-3' | (SEQ ID NO: 648) |  |
|  | 3'-GGUGUGUACUAGUGUAUUGUUGGUCUU-5' | (SEQ ID NO: 1757) |  |
| βc-2824 Target: | 5'-CCACACATGATCACATAACAACCAGAA-3' | (SEQ ID NO: 2866) |  |
|  | 5'-UCCACACAUGAUCACAUAACAACca-3' | (SEQ ID NO: 649) |  |
|  | 3'-GAAGGUGUGUACUAGUGUAUUGUUGGU-5' | (SEQ ID NO: 1758) |  |
| βc-2827 Target: | 5'-CTTCCACACATGATCACATAACAACCA-3' | (SEQ ID NO: 2867) |  |
|  | 5'-UAACUUCCACACAUGAUCACAUAac-3' | (SEQ ID NO: 650) |  |
|  | 3'-UUAUUGAAGGUGUGUACUAGUGUAUUG-5' | (SEQ ID NO: 1759) |  |
| βc-2832 Target: | 5'-AATAACTTCCACACATGATCACATAAC-3' | (SEQ ID NO: 2868) |  |
|  | 5'-AUAACUUCCACACAUGAUCACAUaa-3' | (SEQ ID NO: 651) |  |
|  | 3'-AUUAUUGAAGGUGUGUACUAGUGUAUU-5' | (SEQ ID NO: 1760) |  |
| βc-2833 Target: | 5'-TAATAACTTCCACACATGATCACATAA-3' | (SEQ ID NO: 2869) |  |
|  | 5'-AAUAACUUCCACACAUGAUCACAta-3' | (SEQ ID NO: 652) |  |
|  | 3'-AAUUAUUGAAGGUGUGUACUAGUGUAU-5' | (SEQ ID NO: 1761) |  |
| βc-2834 Target: | 5'-TTAATAACTTCCACACATGATCACATA-3' | (SEQ ID NO: 2870) |  |
|  | 5'-UAAUAACUUCCACACAUGAUCACat-3' | (SEQ ID NO: 653) |  |
|  | 3'-CAAUUAUUGAAGGUGUGUACUAGUGUA-5' | (SEQ ID NO: 1762) |  |
| βc-2835 Target: | 5'-GTTAATAACTTCCACACATGATCAC-3' | (SEQ ID NO: 2871) |  |
|  | 5'-UUAAAGUUAAUAACUUCCACACAtg-3' | (SEQ ID NO: 654) |  |
|  | 3'-GUAAUUUCAAUUAUUGAAGGUGUGUAC-5' | (SEQ ID NO: 1763) |  |
| βc-2842 Target: | 5'-CATTAAAGTTAATAACTTCCACACATG-3' | (SEQ ID NO: 2872) |  |
|  | 5'-AUUAAAGUUAAUAACUUCCACACat-3' | (SEQ ID NO: 655) |  |
|  | 3'-UGUAAUUUCAAUUAUUGAAGGUGUGUA-5' | (SEQ ID NO: 1764) |  |
| βc-2843 Target: | 5'-ACATTAAAGTTAATAACTTCCACAC-3' | (SEQ ID NO: 2873) |  |
|  | 5'-ACAUUAAAGUUAAUAACUUCCACac-3' | (SEQ ID NO: 656) |  |
|  | 3'-UUUGUAAUUUCAAUUAUUGAAGGUGUG-5' | (SEQ ID NO: 1765) |  |
| βc-2845 Target: | 5'-AAACATTAAAGTTAATAACTTCCACAC-3' | (SEQ ID NO: 2874) |  |

TABLE 9-continued

Additional Selected Anti-β-catenin DsiRNAs, 25/27mer Duplexes

|  |  |  |  |
|---|---|---|---|
|  | 5'-AACAUUAAAGUUAAUAACUUCCAca-3' | (SEQ ID NO: 657) |  |
|  | 3'-UUUUGUAAUUUCAAUUAUUGAAGGUGU-5' | (SEQ ID NO: 1766) |  |
| βc-2846 Target: | 5'-AAAACATTAAAGTTAATAACTTCCACA-3' | (SEQ ID NO: 2875) |  |
|  | 5'-AAACAUUAAAGUUAAUAACUUCCac-3' | (SEQ ID NO: 658) |  |
|  | 3'-UUUUUGUAAUUUCAAUUAUUGAAGGUG-5' | (SEQ ID NO: 1767) |  |
| βc-2847 Target: | 5'-AAAAACATTAAAGTTAATAACTTCCAC-3' | (SEQ ID NO: 2876) |  |
|  | 5'-AAAACAUUAAAGUUAAUAACUUCCa-3' | (SEQ ID NO: 659) |  |
|  | 3'-UUUUUUGUAAUUUCAAUUAUUGAAGGU-5' | (SEQ ID NO: 1768) |  |
| βc-2848 Target: | 5'-AAAAAACATTAAAGTTAATAACTTCCA-3' | (SEQ ID NO: 2877) |  |
|  | 5'-AAAAACAUUAAAGUUAAUAACUUcc-3' | (SEQ ID NO: 660) |  |
|  | 3'-GUUUUUUGUAAUUUCAAUUAUUGAAGG-5' | (SEQ ID NO: 1769) |  |
| βc-2849 Target: | 5'-CAAAAAACATTAAAGTTAATAACTTCC-3' | (SEQ ID NO: 2878) |  |
|  | 5'-AAAAAACAUUAAAGUUAAUAACUtc-3' | (SEQ ID NO: 661) |  |
|  | 3'-CGUUUUUUGUAAUUUCAAUUAUUGAAG-5' | (SEQ ID NO: 1770) |  |
| βc-2850 Target: | 5'-GCAAAAAACATTAAAGTTAATAACTTC-3' | (SEQ ID NO: 2879) |  |
|  | 5'-GCAAAAAACAUUAAAGUUAAUAAct-3' | (SEQ ID NO: 662) |  |
|  | 3'-ACCGUUUUUUGUAAUUUCAAUUAUUGA-5' | (SEQ ID NO: 1771) |  |
| βc-2852 Target: | 5'-TGGCAAAAAACATTAAAGTTAATAACT-3' | (SEQ ID NO: 2880) |  |
|  | 5'-GGCAAAAAACAUUAAAGUUAAUAac-3' | (SEQ ID NO: 663) |  |
|  | 3'-CACCGUUUUUUGUAAUUUCAAUUAUUG-5' | (SEQ ID NO: 1772) |  |
| βc-2853 Target: | 5'-GTGGCAAAAAACATTAAAGTTAATAAC-3' | (SEQ ID NO: 2881) |  |
|  | 5'-GCAAAAGCUGUGGCAAAAAACAUta-3' | (SEQ ID NO: 664) |  |
|  | 3'-AACGUUUUCGACACCGUUUUUUGUAAU-5' | (SEQ ID NO: 1773) |  |
| βc-2864 Target: | 5'-TTGCAAAAGCTGTGGCAAAAAACATTA-3' | (SEQ ID NO: 2882) |  |
|  | 5'-UGCAAAAGCUGUGGCAAAAAACAtt-3' | (SEQ ID NO: 665) |  |
|  | 3'-CAACGUUUUCGACACCGUUUUUUGUAA-5' | (SEQ ID NO: 1774) |  |
| βc-2865 Target: | 5'-GTTGCAAAAGCTGTGGCAAAAAACATT-3' | (SEQ ID NO: 2883) |  |
|  | 5'-UCAUUUGAGUAUUAAGUUGCAAAag-3' | (SEQ ID NO: 666) |  |
|  | 3'-UGAGUAAACUCAUAAUUCAACGUUUUC-5' | (SEQ ID NO: 1775) |  |
| βc-2882 Target: | 5'-ACTCATTTGAGTATTAAGTTGCAAAAG-3' | (SEQ ID NO: 2884) |  |
|  | 5'-AAAACAGCAAAUGUUACUCAUUUga-3' | (SEQ ID NO: 667) |  |
|  | 3'-AAUUUUGUCGUUUACAAUGAGUAAACU-5' | (SEQ ID NO: 1776) |  |
| βc-2899 Target: | 5'-TTAAAACAGCAAATGTTACTCATTTGA-3' | (SEQ ID NO: 2885) |  |
|  | 5'-UAAAACAGCAAAUGUUACUCAUUtg-3' | (SEQ ID NO: 668) |  |
|  | 3'-AAAUUUUGUCGUUUACAAUGAGUAAAC-5' | (SEQ ID NO: 1777) |  |
| βc-2900 Target: | 5'-TTTAAAACAGCAAATGTTACTCATTTG-3' | (SEQ ID NO: 2886) |  |
|  | 5'-UUAAAACAGCAAAUGUUACUCAUtt-3' | (SEQ ID NO: 669) |  |
|  | 3'-CAAAUUUUGUCGUUUACAAUGAGUAAA-5' | (SEQ ID NO: 1778) |  |
| βc-2901 Target: | 5'-GTTTAAAACAGCAAATGTTACTCATTT-3' | (SEQ ID NO: 2887) |  |

TABLE 9-continued

Additional Selected Anti-β-catenin DsiRNAs, 25/27mer Duplexes

|  |  |  |  |
|---|---|---|---|
|  | 5'-UUUAAAACAGCAAAUGUUACUCAtt-3' | (SEQ ID NO: 670) |  |
|  | 3'-ACAAAUUUUGUCGUUUACAAUGAGUAA-5' | (SEQ ID NO: 1779) |  |
| βc-2902 Target: | 5'-TGTTTAAAACAGCAAATGTTACTCATT-3' | (SEQ ID NO: 2888) |  |
|  | 5'-GUUUAAAACAGCAAAUGUUACUCat-3' | (SEQ ID NO: 671) |  |
|  | 3'-UACAAAUUUUGUCGUUUACAAUGAGUA-5' | (SEQ ID NO: 1780) |  |
| βc-2903 Target: | 5'-ATGTTTAAAACAGCAAATGTTACTC-3' | (SEQ ID NO: 2889) |  |
|  | 5'-UGUUUAAAACAGCAAAUGUUACUca-3' | (SEQ ID NO: 672) |  |
|  | 3'-UUACAAAUUUUGUCGUUUACAAUGAGU-5' | (SEQ ID NO: 1781) |  |
| βc-2904 Target: | 5'-AATGTTTAAAACAGCAAATGTTACTCA-3' | (SEQ ID NO: 2890) |  |
|  | 5'-AUUAAUGUUUAAAACAGCAAAUGtt-3' | (SEQ ID NO: 673) |  |
|  | 3'-GAUAAUUACAAAUUUUGUCGUUUACAA-5' | (SEQ ID NO: 1782) |  |
| βc-2909 Target: | 5'-CTATTAATGTTTAAAACAGCAAATGTT-3' | (SEQ ID NO: 2891) |  |
|  | 5'-AGAAAGGCUGCUAUUAAUGUUUAaa-3' | (SEQ ID NO: 674) |  |
|  | 3'-UCUCUUUCCGACGAUAAUUACAAAUUU-5' | (SEQ ID NO: 1783) |  |
| βc-2921 Target: | 5'-AGAGAAAGGCTGCTATTAATGTTTAAA-3' | (SEQ ID NO: 2892) |  |
|  | 5'-AGUUCAGACAAUACAGCUGUAUAaa-3' | (SEQ ID NO: 675) |  |
|  | 3'-GUUCAAGUCUGUUAUGUCGACAUAUUU-5' | (SEQ ID NO: 1784) |  |
| βc-2949 Target: | 5'-CAAGTTCAGACAATACAGCTGTATAAA-3' | (SEQ ID NO: 2893) |  |
|  | 5'-ACAAUGCAAGUUCAGACAAUACAgc-3' | (SEQ ID NO: 676) |  |
|  | 3'-AGUGUUACGUUCAAGUCUGUUAUGUCG-5' | (SEQ ID NO: 1785) |  |
| βc-2957 Target: | 5'-TCACAATGCAAGTTCAGACAATACAGC-3' | (SEQ ID NO: 2894) |  |
|  | 5'-UCACAAUGCAAGUUCAGACAAUAca-3' | (SEQ ID NO: 677) |  |
|  | 3'-UUAGUGUUACGUUCAAGUCUGUUAUGU-5' | (SEQ ID NO: 1786) |  |
| βc-2959 Target: | 5'-AATCACAATGCAAGTTCAGACAATACA-3' | (SEQ ID NO: 2895) |  |
|  | 5'-AAUCACAAUGCAAGUUCAGACAAta-3' | (SEQ ID NO: 678) |  |
|  | 3'-GGUUAGUGUUACGUUCAAGUCUGUUAU-5' | (SEQ ID NO: 1787) |  |
| βc-2961 Target: | 5'-CCAATCACAATGCAAGTTCAGACAATA-3' | (SEQ ID NO: 2896) |  |
|  | 5'-GGCCAAUCACAAUGCAAGUUCAGac-3' | (SEQ ID NO: 679) |  |
|  | 3'-GUCCGGUUAGUGUUACGUUCAAGUCUG-5' | (SEQ ID NO: 1788) |  |
| βc-2965 Target: | 5'-CAGGCCAATCACAATGCAAGTTCAGAC-3' | (SEQ ID NO: 2897) |  |
|  | 5'-GUUCCCAUAGGAAACUCAGCUUGgt-3' | (SEQ ID NO: 680) |  |
|  | 3'-AACAAGGGUAUCCUUUGAGUCGAACCA-5' | (SEQ ID NO: 1789) |  |
| βc-3052 Target: | 5'-TTGTTCCCATAGGAAACTCAGCTTGGT-3' | (SEQ ID NO: 2898) |  |
|  | 5'-UCAAUUGUUCCCAUAGGAAACUCag-3' | (SEQ ID NO: 681) |  |
|  | 3'-GAAGUUAACAAGGGUAUCCUUUGAGUC-5' | (SEQ ID NO: 1790) |  |
| βc-3058 Target: | 5'-CTTCAATTGTTCCCATAGGAAACTCAG-3' | (SEQ ID NO: 2899) |  |
|  | 5'-UUCAAUUGUUCCCAUAGGAAACUca-3' | (SEQ ID NO: 682) |  |
|  | 3'-UGAAGUUAACAAGGGUAUCCUUUGAGU-5' | (SEQ ID NO: 1791) |  |
| βc-3059 Target: | 5'-ACTTCAATTGTTCCCATAGGAAACTCA-3' | (SEQ ID NO: 2900) |  |

TABLE 9-continued

Additional Selected Anti-β-catenin DsiRNAs, 25/27mer Duplexes

|  |  |  |
|---|---|---|
|  | 5'-GUUUACUUCAAUUGUUCCCAUAGga-3' | (SEQ ID NO: 683) |
|  | 3'-UUCAAAUGAAGUUAACAAGGGUAUCCU-5' | (SEQ ID NO: 1792) |
| βc-3065 Target: | 5'-AAGTTTACTTCAATTGTTCCCATAGGA-3' | (SEQ ID NO: 2901) |
|  | 5'-AGUUUACUUCAAUUGUUCCCAUAgg-3' | (SEQ ID NO: 684) |
|  | 3'-UUUCAAAUGAAGUUAACAAGGGUAUCC-5' | (SEQ ID NO: 1793) |
| βc-3066 Target: | 5'-AAAGTTTACTTCAATTGTTCCCATAGG-3' | (SEQ ID NO: 2902) |
|  | 5'-AAAAAGUUUACUUCAAUUGUUCCca-3' | (SEQ ID NO: 685) |
|  | 3'-UGUUUUUCAAAUGAAGUUAACAAGGGU-5' | (SEQ ID NO: 1794) |
| βc-3070 Target: | 5'-ACAAAAAGTTTACTTCAATTGTTCCCA-3' | (SEQ ID NO: 2903) |
|  | 5'-GAACAAAAAGUUUACUUCAAUUGtt-3' | (SEQ ID NO: 686) |
|  | 3'-GUCUUGUUUUUCAAAUGAAGUUAACAA-5' | (SEQ ID NO: 1795) |
| βc-3074 Target: | 5'-CAGAACAAAAAGTTTACTTCAATTGTT-3' | (SEQ ID NO: 2904) |
|  | 5'-GACCAGAACAAAAAGUUUACUUCaa-3' | (SEQ ID NO: 687) |
|  | 3'-UCCUGGUCUUGUUUUUCAAAUGAAGUU-5' | (SEQ ID NO: 1796) |
| βc-3079 Target: | 5'-AGGACCAGAACAAAAAGTTTACTTCAA-3' | (SEQ ID NO: 2905) |
|  | 5'-GGACCAGAACAAAAAGUUUACUUca-3' | (SEQ ID NO: 688) |
|  | 3'-UUCCUGGUCUUGUUUUUCAAAUGAAGU-5' | (SEQ ID NO: 1797) |
| βc-3080 Target: | 5'-AAGGACCAGAACAAAAAGTTTACTTCA-3' | (SEQ ID NO: 2906) |
|  | 5'-ACCAAAAAGGACCAGAACAAAAAgt-3' | (SEQ ID NO: 689) |
|  | 3'-GCUGGUUUUUCCUGGUCUUGUUUUUCA-5' | (SEQ ID NO: 1798) |
| βc-3088 Target: | 5'-CGACCAAAAAGGACCAGAACAAAAAGT-3' | (SEQ ID NO: 2907) |
|  | 5'-GACCAAAAAGGACCAGAACAAAAag-3' | (SEQ ID NO: 690) |
|  | 3'-AGCUGGUUUUUCCUGGUCUUGUUUUUC-5' | (SEQ ID NO: 1799) |
| βc-3089 Target: | 5'-TCGACCAAAAAGGACCAGAACAAAAAG-3' | (SEQ ID NO: 2908) |
|  | 5'-ACUCCUCGACCAAAAAGGACCAGaa-3' | (SEQ ID NO: 691) |
|  | 3'-AAUGAGGAGCUGGUUUUUCCUGGUCUU-5' | (SEQ ID NO: 1800) |
| βc-3096 Target: | 5'-TTACTCCTCGACCAAAAAGGACCAGAA-3' | (SEQ ID NO: 2909) |
|  | 5'-UCCAUUUGUAUUGUUACUCCUCGac-3' | (SEQ ID NO: 692) |
|  | 3'-UUAGGUAAACAUAACAAUGAGGAGCUG-5' | (SEQ ID NO: 1801) |
| βc-3111 Target: | 5'-AATCCATTTGTATTGTTACTCCTCGAC-3' | (SEQ ID NO: 2910) |
|  | 5'-AUCCAUUUGUAUUGUUACUCCUCga-3' | (SEQ ID NO: 693) |
|  | 3'-UUUAGGUAAACAUAACAAUGAGGAGCU-5' | (SEQ ID NO: 1802) |
| βc-3112 Target: | 5'-AAATCCATTTGTATTGTTACTCCTCGA-3' | (SEQ ID NO: 2911) |
|  | 5'-AAUCCAUUUGUAUUGUUACUCCUcg-3' | (SEQ ID NO: 694) |
|  | 3'-UUUUAGGUAAACAUAACAAUGAGGAGC-5' | (SEQ ID NO: 1803) |
| βc-3113 Target: | 5'-AAAATCCATTTGTATTGTTACTCCTCG-3' | (SEQ ID NO: 2912) |
|  | 5'-AAAUCCAUUUGUAUUGUUACUCCtc-3' | (SEQ ID NO: 695) |
|  | 3'-GUUUUAGGUAAACAUAACAAUGAGGAG-5' | (SEQ ID NO: 1804) |
| βc-3114 Target: | 5'-CAAAATCCATTTGTATTGTTACTCCTC-3' | (SEQ ID NO: 2913) |

TABLE 9-continued

Additional Selected Anti-β-catenin DsiRNAs, 25/27mer Duplexes

|  |  |  |  |
|---|---|---|---|
| | 5'-AAAAUCCAUUUGUAUUGUUACUCct-3' | (SEQ ID NO: 696) |
| | 3'-GGUUUUAGGUAAACAUAACAAUGAGGA-5' | (SEQ ID NO: 1805) |
| βc-3115 Target: | 5'-CCAAAATCCATTTGTATTGTTACTCCT-3' | (SEQ ID NO: 2914) |
| | 5'-ACUCCCAAAAUCCAUUUGUAUUGtt-3' | (SEQ ID NO: 697) |
| | 3'-AGUGAGGGUUUUAGGUAAACAUAACAA-5' | (SEQ ID NO: 1806) |
| βc-3121 Target: | 5'-TCACTCCCAAAATCCATTTGTATTGTT-3' | (SEQ ID NO: 2915) |
| | 5'-UUCACUUCUUGAGUCACUCCCAAaa-3' | (SEQ ID NO: 698) |
| | 3'-AGAAGUGAAGAACUCAGUGAGGGUUUU-5' | (SEQ ID NO: 1807) |
| βc-3136 Target: | 5'-TCTTCACTTCTTGAGTCACTCCCAAAA-3' | (SEQ ID NO: 2916) |
| | 5'-UCUUCACUUCUUGAGUCACUCCCaa-3' | (SEQ ID NO: 699) |
| | 3'-UAAGAAGUGAAGAACUCAGUGAGGGUU-5' | (SEQ ID NO: 1808) |
| βc-3138 Target: | 5'-ATTCTTCACTTCTTGAGTCACTCCCAA-3' | (SEQ ID NO: 2917) |
| | 5'-UUCUUCACUUCUUGAGUCACUCCca-3' | (SEQ ID NO: 700) |
| | 3'-GUAAGAAGUGAAGAACUCAGUGAGGGU-5' | (SEQ ID NO: 1809) |
| βc-3139 Target: | 5'-CATTCTTCACTTCTTGAGTCACTCCCA-3' | (SEQ ID NO: 2918) |
| | 5'-AUUCUUCACUUCUUGAGUCACUCcc-3' | (SEQ ID NO: 701) |
| | 3'-CGUAAGAAGUGAAGAACUCAGUGAGGG-5' | (SEQ ID NO: 1810) |
| βc-3140 Target: | 5'-GCATTCTTCACTTCTTGAGTCACTCCC-3' | (SEQ ID NO: 2919) |
| | 5'-GCAUUCUUCACUUCUUGAGUCACtc-3' | (SEQ ID NO: 702) |
| | 3'-CACGUAAGAAGUGAAGAACUCAGUGAG-5' | (SEQ ID NO: 1811) |
| βc-3142 Target: | 5'-GTGCATTCTTCACTTCTTGAGTCACTC-3' | (SEQ ID NO: 2920) |
| | 5'-AUUCUUGUGCAUUCUUCACUUCUtg-3' | (SEQ ID NO: 703) |
| | 3'-GGUAAGAACACGUAAGAAGUGAAGAAC-5' | (SEQ ID NO: 1812) |
| βc-3150 Target: | 5'-CCATTCTTGTGCATTCTTCACTTCTTG-3' | (SEQ ID NO: 2921) |
| | 5'-UCCAUUCUUGUGCAUUCUUCACUtc-3' | (SEQ ID NO: 704) |
| | 3'-CUAGGUAAGAACACGUAAGAAGUGAAG-5' | (SEQ ID NO: 1813) |
| βc-3153 Target: | 5'-GATCCATTCTTGTGCATTCTTCACTTC-3' | (SEQ ID NO: 2922) |
| | 5'-AUCCAUUCUUGUGCAUUCUUCACtt-3' | (SEQ ID NO: 705) |
| | 3'-ACUAGGUAAGAACACGUAAGAAGUGAA-5' | (SEQ ID NO: 1814) |
| βc-3154 Target: | 5'-TGATCCATTCTTGTGCATTCTTCACTT-3' | (SEQ ID NO: 2923) |
| | 5'-GAUCCAUUCUUGUGCAUUCUUCAct-3' | (SEQ ID NO: 706) |
| | 3'-CACUAGGUAAGAACACGUAAGAAGUGA-5' | (SEQ ID NO: 1815) |
| βc-3155 Target: | 5'-GTGATCCATTCTTGTGCATTCTTCACT-3' | (SEQ ID NO: 2924) |
| | 5'-AAUUCCAUCUUGUGAUCCAUUCUtg-3' | (SEQ ID NO: 707) |
| | 3'-AUUUAAGGUAGAACACUAGGUAAGAAC-5' | (SEQ ID NO: 1816) |
| βc-3168 Target: | 5'-TAAATTCCATCTTGTGATCCATTCTTG-3' | (SEQ ID NO: 2925) |
| | 5'-UAAAUUCCAUCUUGUGAUCCAUUct-3' | (SEQ ID NO: 708) |
| | 3'-CUAUUUAAGGUAGAACACUAGGUAAGA-5' | (SEQ ID NO: 1817) |
| βc-3170 Target: | 5'-GATAAATTCCATCTTGTGATCCATTCT-3' | (SEQ ID NO: 2926) |

TABLE 9-continued

Additional Selected Anti-β-catenin DsiRNAs, 25/27mer Duplexes

|  |  |  |  |
|---|---|---|---|
|  | 5'-AUAAAUUCCAUCUUGUGAUCCAUtc-3' | (SEQ ID NO: 709) |  |
|  | 3'-ACUAUUUAAGGUAGAACACUAGGUAAG-5' | (SEQ ID NO: 1818) |  |
| βc-3171 Target: | 5'-TGATAAATTCCATCTTGTGATCCATTC-3' | (SEQ ID NO: 2927) |  |
|  | 5'-GAUAAAUUCCAUCUUGUGAUCCAtt-3' | (SEQ ID NO: 710) |  |
|  | 3'-AACUAUUUAAGGUAGAACACUAGGUAA-5' | (SEQ ID NO: 1819) |  |
| βc-3172 Target: | 5'-TTGATAAATTCCATCTTGTGATCCATT-3' | (SEQ ID NO: 2928) |  |
|  | 5'-UGAUAAAUUCCAUCUUGUGAUCCat-3' | (SEQ ID NO: 711) |  |
|  | 3'-AAACUAUUUAAGGUAGAACACUAGGUA-5' | (SEQ ID NO: 1820) |  |
| βc-3173 Target: | 5'-TTTGATAAATTCCATCTTGTGATCC-3' | (SEQ ID NO: 2929) |  |
|  | 5'-GGCUAGGGUUUGAUAAAUUCCAUct-3' | (SEQ ID NO: 712) |  |
|  | 3'-UUCCGAUCCCAAACUAUUUAAGGUAGA-5' | (SEQ ID NO: 1821) |  |
| βc-3183 Target: | 5'-AAGGCTAGGGTTTGATAAATTCCATCT-3' | (SEQ ID NO: 2930) |  |
|  | 5'-AAAAAUUUAACAAGCAAGGCUAGgg-3' | (SEQ ID NO: 713) |  |
|  | 3'-UUUUUUUAAAUUGUUCGUUCCGAUCCC-5' | (SEQ ID NO: 1822) |  |
| βc-3200 Target: | 5'-AAAAAAATTTAACAAGCAAGGCTAGGG-3' | (SEQ ID NO: 2931) |  |
|  | 5'-AAAAAAAAAAAAAUUUAACAAGca-3' | (SEQ ID NO: 714) |  |
|  | 3'-UUUUUUUUUUUUUUUAAAUUGUUCGU-5' | (SEQ ID NO: 1823) |  |
| βc-3209 Target: | 5'-AAAAAAAAAAAAAAATTTAACAAGCA-3' | (SEQ ID NO: 2932) |  |
|  | 5'-AAAAAAAAAAAAAAUUUAACAAgc-3' | (SEQ ID NO: 715) |  |
|  | 3'-UUUUUUUUUUUUUUUUAAAUUGUUCG-5' | (SEQ ID NO: 1824) |  |
| βc-3210 Target: | 5'-AAAAAAAAAAAAAAAATTTAACAAGC-3' | (SEQ ID NO: 2933) |  |
|  | 5'-AAAAAAAAAAAAAAAUUUAACAag-3' | (SEQ ID NO: 716) |  |
|  | 3'-UUUUUUUUUUUUUUUUUAAAUUGUUC-5' | (SEQ ID NO: 1825) |  |
| βc-3211 Target: | 5'-AAAAAAAAAAAAAAAAATTTAACAAG-3' | (SEQ ID NO: 2934) |  |
|  | 5'-AAAAAAAAAAAAAAAAUUUAACaa-3' | (SEQ ID NO: 717) |  |
|  | 3'-UUUUUUUUUUUUUUUUUUAAAUUGUU-5' | (SEQ ID NO: 1826) |  |
| βc-3212 Target: | 5'-AAAAAAAAAAAAAAAAAATTTAACAA-3' | (SEQ ID NO: 2935) |  |
|  | 5'-AAAAAAAAAAAAAAAAAUUUAAca-3' | (SEQ ID NO: 718) |  |
|  | 3'-AUUUUUUUUUUUUUUUUUUAAAUUGU-5' | (SEQ ID NO: 1827) |  |
| βc-3213 Target: | 5'-TAAAAAAAAAAAAAAAAAATTTAACA-3' | (SEQ ID NO: 2936) |  |
|  | 5'-AAAAAAAAAAAAAAAAAAUUUAac-3' | (SEQ ID NO: 719) |  |
|  | 3'-AAUUUUUUUUUUUUUUUUUUAAAUUG-5' | (SEQ ID NO: 1828) |  |
| βc-3214 Target: | 5'-TTAAAAAAAAAAAAAAAAAAATTTAAC-3' | (SEQ ID NO: 2937) |  |
|  | 5'-UAAAAAAAAAAAAAAAAAAAUUUaa-3' | (SEQ ID NO: 720) |  |
|  | 3'-GAAUUUUUUUUUUUUUUUUUUUAAAUU-5' | (SEQ ID NO: 1829) |  |
| βc-3215 Target: | 5'-CTTAAAAAAAAAAAAAAAAAAATTTAA-3' | (SEQ ID NO: 2938) |  |
|  | 5'-UUAAAAAAAAAAAAAAAAAAAAUUta-3' | (SEQ ID NO: 721) |  |
|  | 3'-AGAAUUUUUUUUUUUUUUUUUUUAAAU-5' | (SEQ ID NO: 1830) |  |
| βc-3216 Target: | 5'-TCTTAAAAAAAAAAAAAAAAAAAATTTA-3' | (SEQ ID NO: 2939) |  |

TABLE 9-continued

Additional Selected Anti-β-catenin DsiRNAs, 25/27mer Duplexes

|  |  |  |  |
|---|---|---|---|
| | 5'-UCUUAAAAAAAAAAAAAAAAAAAtt-3' | (SEQ ID NO: 722) |
| | 3'-UAAGAAUUUUUUUUUUUUUUUUUAA-5' | (SEQ ID NO: 1831) |
| βc-3218 Target: | 5'-ATTCTTAAAAAAAAAAAAAAAAATT-3' | (SEQ ID NO: 2940) |
| | 5'-UUCUUAAAAAAAAAAAAAAAAAAat-3' | (SEQ ID NO: 723) |
| | 3'-AUAAGAAUUUUUUUUUUUUUUUUUA-5' | (SEQ ID NO: 1832) |
| βc-3219 Target: | 5'-TATTCTTAAAAAAAAAAAAAAAAAT-3' | (SEQ ID NO: 2941) |
| | 5'-AUUCUUAAAAAAAAAAAAAAAAAaa-3' | (SEQ ID NO: 724) |
| | 3'-UAUAAGAAUUUUUUUUUUUUUUUUU-5' | (SEQ ID NO: 1833) |
| βc-3220 Target: | 5'-ATATTCTTAAAAAAAAAAAAAAAAA-3' | (SEQ ID NO: 2942) |
| | 5'-UAUUCUUAAAAAAAAAAAAAAAAaa-3' | (SEQ ID NO: 725) |
| | 3'-CUAUAAGAAUUUUUUUUUUUUUUUU-5' | (SEQ ID NO: 1834) |
| βc-3221 Target: | 5'-GATATTCTTAAAAAAAAAAAAAAAA-3' | (SEQ ID NO: 2943) |
| | 5'-AUAUUCUUAAAAAAAAAAAAAAAaa-3' | (SEQ ID NO: 726) |
| | 3'-UCUAUAAGAAUUUUUUUUUUUUUUU-5' | (SEQ ID NO: 1835) |
| βc-3222 Target: | 5'-AGATATTCTTAAAAAAAAAAAAAAA-3' | (SEQ ID NO: 2944) |
| | 5'-GAUAUUCUUAAAAAAAAAAAAAAaa-3' | (SEQ ID NO: 727) |
| | 3'-GUCUAUAAGAAUUUUUUUUUUUUUU-5' | (SEQ ID NO: 1836) |
| βc-3223 Target: | 5'-CAGATATTCTTAAAAAAAAAAAAAA-3' | (SEQ ID NO: 2945) |
| | 5'-AGAUAUUCUUAAAAAAAAAAAAAaa-3' | (SEQ ID NO: 728) |
| | 3'-UGUCUAUAAGAAUUUUUUUUUUUUU-5' | (SEQ ID NO: 1837) |
| βc-3224 Target: | 5'-ACAGATATTCTTAAAAAAAAAAAAA-3' | (SEQ ID NO: 2946) |
| | 5'-UUACAGAUAUUCUUAAAAAAAAAaa-3' | (SEQ ID NO: 729) |
| | 3'-GUAAUGUCUAUAAGAAUUUUUUUUU-5' | (SEQ ID NO: 1838) |
| βc-3228 Target: | 5'-CATTACAGATATTCTTAAAAAAAAA-3' | (SEQ ID NO: 2947) |
| | 5'-AUUACAGAUAUUCUUAAAAAAAAaa-3' | (SEQ ID NO: 730) |
| | 3'-GGUAAUGUCUAUAAGAAUUUUUUUU-5' | (SEQ ID NO: 1839) |
| βc-3229 Target: | 5'-CCATTACAGATATTCTTAAAAAAAA-3' | (SEQ ID NO: 2948) |
| | 5'-UACCAUUACAGAUAUUCUUAAAAaa-3' | (SEQ ID NO: 731) |
| | 3'-UCAUGGUAAUGUCUAUAAGAAUUUUU-5' | (SEQ ID NO: 1840) |
| βc-3233 Target: | 5'-AGTACCATTACAGATATTCTTAAAAAA-3' | (SEQ ID NO: 2949) |
| | 5'-GUACCAUUACAGAUAUUCUUAAAaa-3' | (SEQ ID NO: 732) |
| | 3'-GUCAUGGUAAUGUCUAUAAGAAUUUUU-5' | (SEQ ID NO: 1841) |
| βc-3234 Target: | 5'-CAGTACCATTACAGATATTCTTAAAAA-3' | (SEQ ID NO: 2950) |
| | 5'-AGUACCAUUACAGAUAUUCUUAAaa-3' | (SEQ ID NO: 733) |
| | 3'-AGUCAUGGUAAUGUCUAUAAGAAUUUUU-5' | (SEQ ID NO: 1842) |
| βc-3235 Target: | 5'-TCAGTACCATTACAGATATTCTTAAAA-3' | (SEQ ID NO: 2951) |
| | 5'-AGUCAGUACCAUUACAGAUAUUCtt-3' | (SEQ ID NO: 734) |
| | 3'-UUUCAGUCAUGGUAAUGUCUAUAAGAA-5' | (SEQ ID NO: 1843) |
| βc-3239 Target: | 5'-AAAGTCAGTACCATTACAGATATTCTT-3' | (SEQ ID NO: 2952) |

TABLE 9-continued

Additional Selected Anti-β-catenin DsiRNAs, 25/27mer Duplexes

|  |  |  |  |
|---|---|---|---|
| | 5'-UACUUCAAAGCAAGCAAAGUCAGta-3' | (SEQ ID NO: 735) |
| | 3'-CGAUGAAGUUUCGUUCGUUUCAGUCAU-5' | (SEQ ID NO: 1844) |
| βc-3256 Target: | 5'-GCTACTTCAAAGCAAGCAAAGTCAGTA-3' | (SEQ ID NO: 2953) |
| | 5'-AAAAAGAGCUACUUCAAAGCAAGca-3' | (SEQ ID NO: 736) |
| | 3'-UUUUUUUCUCGAUGAAGUUUCGUUCGU-5' | (SEQ ID NO: 1845) |
| βc-3265 Target: | 5'-AAAAAAAGAGCTACTTCAAAGCAAGCA-3' | (SEQ ID NO: 2954) |
| | 5'-AAAAAAAAAAGAGCUACUUCAAAgc-3' | (SEQ ID NO: 737) |
| | 3'-UUUUUUUUUUUUCUCGAUGAAGUUUCG-5' | (SEQ ID NO: 1846) |
| βc-3270 Target: | 5'-AAAAAAAAAAAAGAGCTACTTCAAAGC-3' | (SEQ ID NO: 2955) |
| | 5'-AAAAAAAAAAAGAGCUACUUCAAag-3' | (SEQ ID NO: 738) |
| | 3'-UUUUUUUUUUUUUCUCGAUGAAGUUUC-5' | (SEQ ID NO: 1847) |
| βc-3271 Target: | 5'-AAAAAAAAAAAAAGAGCTACTTCAAAG-3' | (SEQ ID NO: 2956) |
| | 5'-AAAAAAAAAAAAGAGCUACUUCaa-3' | (SEQ ID NO: 739) |
| | 3'-UUUUUUUUUUUUUUCUCGAUGAAGUU-5' | (SEQ ID NO: 1848) |
| βc-3273 Target: | 5'-AAAAAAAAAAAAAAGAGCTACTTCAA-3' | (SEQ ID NO: 2957) |
| | 5'-AAAAAAAAAAAAAAGAGCUACUUca-3' | (SEQ ID NO: 740) |
| | 3'-UUUUUUUUUUUUUUUCUCGAUGAAGU-5' | (SEQ ID NO: 1849) |
| βc-3274 Target: | 5'-AAAAAAAAAAAAAAAGAGCTACTTCA-3' | (SEQ ID NO: 2958) |
| | 5'-AAAAAAAAAAAAAAAGAGCUACUtc-3' | (SEQ ID NO: 741) |
| | 3'-UUUUUUUUUUUUUUUUCUCGAUGAAG-5' | (SEQ ID NO: 1850) |
| βc-3275 Target: | 5'-AAAAAAAAAAAAAAAAGAGCTACTTC-3' | (SEQ ID NO: 2959) |
| | 5'-AAAAAAAAAAAAAAAAGAGCUACtt-3' | (SEQ ID NO: 742) |
| | 3'-UUUUUUUUUUUUUUUUUCUCGAUGAA-5' | (SEQ ID NO: 1851) |
| βc-3276 Target: | 5'-AAAAAAAAAAAAAAAAAGAGCTACTT-3' | (SEQ ID NO: 2960) |
| | 5'-AAAAAAAAAAAAAAAAAAAAAGag-3' | (SEQ ID NO: 743) |
| | 3'-UUUUUUUUUUUUUUUUUUUUUUUCUC-5' | (SEQ ID NO: 1852) |
| βc-3282 Target: | 5'-AAAAAAAAAAAAAAAAAAAAAAGAG-3' | (SEQ ID NO: 2961) |
| | 5'-AAAAAAAAAAAAAAAAAAAAAAAga-3' | (SEQ ID NO: 744) |
| | 3'-UUUUUUUUUUUUUUUUUUUUUUUUCU-5' | (SEQ ID NO: 1853) |
| βc-3283 Target: | 5'-AAAAAAAAAAAAAAAAAAAAAAAGA-3' | (SEQ ID NO: 2962) |
| | 5'-AAAAAAAAAAAAAAAAAAAAAAAag-3' | (SEQ ID NO: 745) |
| | 3'-GUUUUUUUUUUUUUUUUUUUUUUUUC-5' | (SEQ ID NO: 1854) |
| βc-3284 Target: | 5'-CAAAAAAAAAAAAAAAAAAAAAAAAG-3' | (SEQ ID NO: 2963) |
| | 5'-AAAAAAAAAAAAAAAAAAAAAAAaa-3' | (SEQ ID NO: 746) |
| | 3'-CGUUUUUUUUUUUUUUUUUUUUUUUU-5' | (SEQ ID NO: 1855) |
| βc-3285 Target: | 5'-GCAAAAAAAAAAAAAAAAAAAAAAAA-3' | (SEQ ID NO: 2964) |
| | 5'-GCAAAAAAAAAAAAAAAAAAAAAaa-3' | (SEQ ID NO: 747) |
| | 3'-GACGUUUUUUUUUUUUUUUUUUUUUU-5' | (SEQ ID NO: 1856) |
| βc-3287 Target: | 5'-CTGCAAAAAAAAAAAAAAAAAAAAAA-3' | (SEQ ID NO: 2965) |

TABLE 9-continued

Additional Selected Anti-β-catenin DsiRNAs, 25/27mer Duplexes

|  |  |  |
|---|---|---|
|  | 5'-UGCAAAAAAAAAAAAAAAAAAAAaa-3' | (SEQ ID NO: 748) |
|  | 3'-UGACGUUUUUUUUUUUUUUUUUUUU-5' | (SEQ ID NO: 1857) |
| βc-3288 Target: | 5'-ACTGCAAAAAAAAAAAAAAAAAAAA-3' | (SEQ ID NO: 2966) |
|  | 5'-UUACUGCAAAAAAAAAAAAAAAAaa-3' | (SEQ ID NO: 749) |
|  | 3'-UCAAUGACGUUUUUUUUUUUUUUUU-5' | (SEQ ID NO: 1858) |
| βc-3292 Target: | 5'-AGTTACTGCAAAAAAAAAAAAAAAA-3' | (SEQ ID NO: 2967) |
|  | 5'-GUUACUGCAAAAAAAAAAAAAAAaa-3' | (SEQ ID NO: 750) |
|  | 3'-GUCAAUGACGUUUUUUUUUUUUUUU-5' | (SEQ ID NO: 1859) |
| βc-3293 Target: | 5'-CAGTTACTGCAAAAAAAAAAAAAAA-3' | (SEQ ID NO: 2968) |
|  | 5'-AGUUACUGCAAAAAAAAAAAAAAaa-3' | (SEQ ID NO: 751) |
|  | 3'-UGUCAAUGACGUUUUUUUUUUUUUU-5' | (SEQ ID NO: 1860) |
| βc-3294 Target: | 5'-ACAGTTACTGCAAAAAAAAAAAAAA-3' | (SEQ ID NO: 2969) |
|  | 5'-AAACAGUUACUGCAAAAAAAAAAaa-3' | (SEQ ID NO: 752) |
|  | 3'-UUUUUGUCAAUGACGUUUUUUUUUU-5' | (SEQ ID NO: 1861) |
| βc-3298 Target: | 5'-AAAAACAGTTACTGCAAAAAAAAAA-3' | (SEQ ID NO: 2970) |
|  | 5'-AAAACAGUUACUGCAAAAAAAAAaa-3' | (SEQ ID NO: 753) |
|  | 3'-UUUUUUGUCAAUGACGUUUUUUUUU-5' | (SEQ ID NO: 1862) |
| βc-3299 Target: | 5'-AAAAAACAGTTACTGCAAAAAAAAA-3' | (SEQ ID NO: 2971) |
|  | 5'-AAAAACAGUUACUGCAAAAAAAAaa-3' | (SEQ ID NO: 754) |
|  | 3'-AUUUUUUGUCAAUGACGUUUUUUUU-5' | (SEQ ID NO: 1863) |
| βc-3300 Target: | 5'-TAAAAAACAGTTACTGCAAAAAAAA-3' | (SEQ ID NO: 2972) |
|  | 5'-UAAAAAACAGUUACUGCAAAAAAaa-3' | (SEQ ID NO: 755) |
|  | 3'-GAAUUUUUUGUCAAUGACGUUUUUUU-5' | (SEQ ID NO: 1864) |
| βc-3302 Target: | 5'-CTTAAAAAACAGTTACTGCAAAAAAA-3' | (SEQ ID NO: 2973) |
|  | 5'-UUAAAAAACAGUUACUGCAAAAAaa-3' | (SEQ ID NO: 756) |
|  | 3'-UGAAUUUUUUGUCAAUGACGUUUUUU-5' | (SEQ ID NO: 1865) |
| βc-3303 Target: | 5'-ACTTAAAAAACAGTTACTGCAAAAAA-3' | (SEQ ID NO: 2974) |
|  | 5'-ACUUAAAAAACAGUUACUGCAAAaa-3' | (SEQ ID NO: 757) |
|  | 3'-UCUGAAUUUUUUGUCAAUGACGUUUUU-5' | (SEQ ID NO: 1866) |
| βc-3305 Target: | 5'-AGACTTAAAAAACAGTTACTGCAAAAA-3' | (SEQ ID NO: 2975) |
|  | 5'-ACUACGAGAGACUUAAAAAACAGtt-3' | (SEQ ID NO: 758) |
|  | 3'-UGUGAUGCUCUCUGAAUUUUUUGUCAA-5' | (SEQ ID NO: 1867) |
| βc-3315 Target: | 5'-ACACTACGAGAGACTTAAAAAACAGTT-3' | (SEQ ID NO: 2976) |
|  | 5'-ACACUACGAGAGACUUAAAAAACag-3' | (SEQ ID NO: 759) |
|  | 3'-AUUGUGAUGCUCUCUGAAUUUUUUGUC-5' | (SEQ ID NO: 1868) |
| βc-3317 Target: | 5'-TAACACTACGAGAGACTTAAAAAACAG-3' | (SEQ ID NO: 2977) |
|  | 5'-AACACUACGAGAGACUUAAAAAAca-3' | (SEQ ID NO: 760) |
|  | 3'-AAUUGUGAUGCUCUCUGAAUUUUUUGU-5' | (SEQ ID NO: 1869) |
| βc-3318 Target: | 5'-TTAACACTACGAGAGACTTAAAAAACA-3' | (SEQ ID NO: 2978) |

TABLE 9-continued

Additional Selected Anti-β-catenin DsiRNAs, 25/27mer Duplexes

|  |  |  |  |
|---|---|---|---|
|  | 5'-UUAACACUACGAGAGACUUAAAAaa-3' | (SEQ ID NO: 761) |  |
|  | 3'-UGAAUUGUGAUGCUCUCUGAAUUUUU-5' | (SEQ ID NO: 1870) |  |
| βc-3320 Target: | 5'-ACTTAACACTACGAGAGACTTAAAAAA-3' | (SEQ ID NO: 2979) |  |
|  | 5'-AACUUAACACUACGAGAGACUUAaa-3' | (SEQ ID NO: 762) |  |
|  | 3'-UAUUGAAUUGUGAUGCUCUCUGAAUUU-5' | (SEQ ID NO: 1871) |  |
| βc-3323 Target: | 5'-ATAACTTAACACTACGAGAGACTTAAA-3' | (SEQ ID NO: 2980) |  |
|  | 5'-UAACUUAACACUACGAGAGACUUaa-3' | (SEQ ID NO: 763) |  |
|  | 3'-AUAUUGAAUUGUGAUGCUCUCUGAAUU-5' | (SEQ ID NO: 1872) |  |
| βc-3324 Target: | 5'-TATAACTTAACACTACGAGAGACTTAA-3' | (SEQ ID NO: 2981) |  |
|  | 5'-AUUCACUAUAACUUAACACUACGag-3' | (SEQ ID NO: 764) |  |
|  | 3'-CAUAAGUGAUAUUGAAUUGUGAUGCUC-5' | (SEQ ID NO: 1873) |  |
| βc-3332 Target: | 5'-GTATTCACTATAACTTAACACTACGAG-3' | (SEQ ID NO: 2982) |  |
|  | 5'-UAUUCACUAUAACUUAACACUACga-3' | (SEQ ID NO: 765) |  |
|  | 3'-UCAUAAGUGAUAUUGAAUUGUGAUGCU-5' | (SEQ ID NO: 1874) |  |
| βc-3333 Target: | 5'-AGTATTCACTATAACTTAACACTACGA-3' | (SEQ ID NO: 2983) |  |
|  | 5'-GUAUUCACUAUAACUUAACACUAcg-3' | (SEQ ID NO: 766) |  |
|  | 3'-GUCAUAAGUGAUAUUGAAUUGUGAUGC-5' | (SEQ ID NO: 1875) |  |
| βc-3334 Target: | 5'-CAGTATTCACTATAACTTAACACTACG-3' | (SEQ ID NO: 2984) |  |
|  | 5'-AGUAUUCACUAUAACUUAACACUac-3' | (SEQ ID NO: 767) |  |
|  | 3'-CGUCAUAAGUGAUAUUGAAUUGUGAUG-5' | (SEQ ID NO: 1876) |  |
| βc-3335 Target: | 5'-GCAGTATTCACTATAACTTAACACTAC-3' | (SEQ ID NO: 2985) |  |
|  | 5'-AAAUUGCUGUAGCAGUAUUCACUat-3' | (SEQ ID NO: 768) |  |
|  | 3'-UCUUUAACGACAUCGUCAUAAGUGAUA-5' | (SEQ ID NO: 1877) |  |
| βc-3348 Target: | 5'-AGAAATTGCTGTAGCAGTATTCACTAT-3' | (SEQ ID NO: 2986) |  |
|  | 5'-GAAAUUGCUGUAGCAGUAUUCACta-3' | (SEQ ID NO: 769) |  |
|  | 3'-AUCUUUAACGACAUCGUCAUAAGUGAU-5' | (SEQ ID NO: 1878) |  |
| βc-3349 Target: | 5'-TAGAAATTGCTGTAGCAGTATTCACTA-3' | (SEQ ID NO: 2987) |  |
|  | 5'-AGAAAUUGCUGUAGCAGUAUUCAct-3' | (SEQ ID NO: 770) |  |
|  | 3'-AAUCUUUAACGACAUCGUCAUAAGUGA-5' | (SEQ ID NO: 1879) |  |
| βc-3350 Target: | 5'-TTAGAAATTGCTGTAGCAGTATTCACT-3' | (SEQ ID NO: 2988) |  |
|  | 5'-UCAAUUCUUAAAAAUUAGAAAUUgc-3' | (SEQ ID NO: 771) |  |
|  | 3'-UGAGUUAAGAAUUUUUAAUCUUUAACG-5' | (SEQ ID NO: 1880) |  |
| βc-3366 Target: | 5'-ACTCAATTCTTAAAAATTAGAAATTGC-3' | (SEQ ID NO: 2989) |  |
|  | 5'-AUUACUCAAUUCUUAAAAAUUAGaa-3' | (SEQ ID NO: 772) |  |
|  | 3'-GGUAAUGAGUUAAGAAUUUUUAAUCUU-5' | (SEQ ID NO: 1881) |  |
| βc-3371 Target: | 5'-CCATTACTCAATTCTTAAAAATTAGAA-3' | (SEQ ID NO: 2990) |  |
|  | 5'-ACCAUUACUCAAUUCUUAAAAAUta-3' | (SEQ ID NO: 773) |  |
|  | 3'-UGUGGUAAUGAGUUAAGAAUUUUUAAU-5' | (SEQ ID NO: 1882) |  |
| βc-3374 Target: | 5'-ACACCATTACTCAATTCTTAAAAATTA-3' | (SEQ ID NO: 2991) |  |

TABLE 9-continued

Additional Selected Anti-β-catenin DsiRNAs, 25/27mer Duplexes

|  |  |  |
|---|---|---|
|  | 5'-ACACCAUUACUCAAUUCUUAAAAat-3' | (SEQ ID NO: 774) |
|  | 3'-GAUGUGGUAAUGAGUUAAGAAUUUUUA-5' | (SEQ ID NO: 1883) |
| βc-3376 Target: | 5'-CTACACCATTACTCAATTCTTAAAAAT-3' | (SEQ ID NO: 2992) |
|  | 5'-UACACCAUUACUCAAUUCUUAAAaa-3' | (SEQ ID NO: 775) |
|  | 3'-AGAUGUGGUAAUGAGUUAAGAAUUUUU-5' | (SEQ ID NO: 1884) |
| βc-3377 Target: | 5'-TCTACACCATTACTCAATTCTTAAAAA-3' | (SEQ ID NO: 2993) |
|  | 5'-UCUACACCAUUACUCAAUUCUUAaa-3' | (SEQ ID NO: 776) |
|  | 3'-CAAGAUGUGGUAAUGAGUUAAGAAUUU-5' | (SEQ ID NO: 1885) |
| βc-3379 Target: | 5'-GTTCTACACCATTACTCAATTCTTAAA-3' | (SEQ ID NO: 2994) |
|  | 5'-GUUCUACACCAUUACUCAAUUCUta-3' | (SEQ ID NO: 777) |
|  | 3'-CACAAGAUGUGGUAAUGAGUUAAGAAU-5' | (SEQ ID NO: 1886) |
| βc-3381 Target: | 5'-GTGTTCTACACCATTACTCAATTCTTA-3' | (SEQ ID NO: 2995) |
|  | 5'-GAAUUAGUGUUCUACACCAUUACtc-3' | (SEQ ID NO: 778) |
|  | 3'-UACUUAAUCACAAGAUGUGGUAAUGAG-5' | (SEQ ID NO: 1887) |
| βc-3389 Target: | 5'-ATGAATTAGTGTTCTACACCATTACTC-3' | (SEQ ID NO: 2996) |
|  | 5'-AUUAUGAAUUAGUGUUCUACACCat-3' | (SEQ ID NO: 779) |
|  | 3'-ACUAAUACUUAAUCACAAGAUGUGGUA-5' | (SEQ ID NO: 1888) |
| βc-3394 Target: | 5'-TGATTATGAATTAGTGTTCTACACC-3' | (SEQ ID NO: 2997) |
|  | 5'-GAUUAUGAAUUAGUGUUCUACACca-3' | (SEQ ID NO: 780) |
|  | 3'-CACUAAUACUUAAUCACAAGAUGUGGU-5' | (SEQ ID NO: 1889) |
| βc-3395 Target: | 5'-GTGATTATGAATTAGTGTTCTACACCA-3' | (SEQ ID NO: 2998) |
|  | 5'-UGAUUAUGAAUUAGUGUUCUACAcc-3' | (SEQ ID NO: 781) |
|  | 3'-UCACUAAUACUUAAUCACAAGAUGUGG-5' | (SEQ ID NO: 1890) |
| βc-3396 Target: | 5'-AGTGATTATGAATTAGTGTTCTACACC-3' | (SEQ ID NO: 2999) |
|  | 5'-UAAUUAGAGUGAUUAUGAAUUAGtg-3' | (SEQ ID NO: 782) |
|  | 3'-UAAUUAAUCUCACUAAUACUUAAUCAC-5' | (SEQ ID NO: 1891) |
| βc-3405 Target: | 5'-ATTAATTAGAGTGATTATGAATTAGTG-3' | (SEQ ID NO: 3000) |
|  | 5'-UUAAUUAGAGUGAUUAUGAAUUAgt-3' | (SEQ ID NO: 783) |
|  | 3'-UUAAUUAAUCUCACUAAUACUUAAUCA-5' | (SEQ ID NO: 1892) |
| βc-3406 Target: | 5'-AATTAATTAGAGTGATTATGAATTAGT-3' | (SEQ ID NO: 3001) |
|  | 5'-AUUAAUUAGAGUGAUUAUGAAUUag-3' | (SEQ ID NO: 784) |
|  | 3'-GUUAAUUAAUCUCACUAAUACUUAAUC-5' | (SEQ ID NO: 1893) |
| βc-3407 Target: | 5'-CAATTAATTAGAGTGATTATGAATTAG-3' | (SEQ ID NO: 3002) |
|  | 5'-UACAAUUAAUUAGAGUGAUUAUGaa-3' | (SEQ ID NO: 785) |
|  | 3'-UAAUGUUAAUUAAUCUCACUAAUACUU-5' | (SEQ ID NO: 1894) |
| βc-3411 Target: | 5'-ATTACAATTAATTAGAGTGATTATGAA-3' | (SEQ ID NO: 3003) |
|  | 5'-UUACAAUUAAUUAGAGUGAUUAUga-3' | (SEQ ID NO: 786) |
|  | 3'-CUAAUGUUAAUUAAUCUCACUAAUACU-5' | (SEQ ID NO: 1895) |
| βc-3412 Target: | 5'-GATTACAATTAATTAGAGTGATTATGA-3' | (SEQ ID NO: 3004) |

TABLE 9-continued

Additional Selected Anti-β-catenin DsiRNAs, 25/27mer Duplexes

|  |  |  |  |
|---|---|---|---|
|  | 5'-AUUACAAUUAAUUAGAGUGAUUAtg-3' | (SEQ ID NO: 787) |  |
|  | 3'-UCUAAUGUUAAUUAAUCUCACUAAUAC-5' | (SEQ ID NO: 1896) |  |
| βc-3413 Target: | 5'-AGATTACAATTAATTAGAGTGATTATG-3' | (SEQ ID NO: 3005) |  |
|  | 5'-UUAUUCAGAUUACAAUUAAUUAGag-3' | (SEQ ID NO: 788) |  |
|  | 3'-GAAAUAAGUCUAAUGUUAAUUAAUCUC-5' | (SEQ ID NO: 1897) |  |
| βc-3421 Target: | 5'-CTTTATTCAGATTACAATTAATTAGAG-3' | (SEQ ID NO: 3006) |  |
|  | 5'-UUUAUUCAGAUUACAAUUAUUAga-3' | (SEQ ID NO: 789) |  |
|  | 3'-UGAAAUAAGUCUAAUGUUAAUUAAUCU-5' | (SEQ ID NO: 1898) |  |
| βc-3422 Target: | 5'-ACTTTATTCAGATTACAATTAATTAGA-3' | (SEQ ID NO: 3007) |  |
|  | 5'-ACACUUUAUUCAGAUUACAAUUAat-3' | (SEQ ID NO: 790) |  |
|  | 3'-AAUGUGAAAUAAGUCUAAUGUUAAUUA-5' | (SEQ ID NO: 1899) |  |
| βc-3426 Target: | 5'-TTACACTTTATTCAGATTACAATTAAT-3' | (SEQ ID NO: 3008) |  |
|  | 5'-UACACUUUAUUCAGAUUACAAUUaa-3' | (SEQ ID NO: 791) |  |
|  | 3'-CAAUGUGAAAUAAGUCUAAUGUUAAUU-5' | (SEQ ID NO: 1900) |  |
| βc-3427 Target: | 5'-GTTACACTTTATTCAGATTACAATTAA-3' | (SEQ ID NO: 3009) |  |
|  | 5'-UUACACUUUAUUCAGAUUACAAUta-3' | (SEQ ID NO: 792) |  |
|  | 3'-ACAAUGUGAAAUAAGUCUAAUGUUAAU-5' | (SEQ ID NO: 1901) |  |
| βc-3428 Target: | 5'-TGTTACACTTTATTCAGATTACAATTA-3' | (SEQ ID NO: 3010) |  |
|  | 5'-GUUACACUUUAUUCAGAUUACAAtt-3' | (SEQ ID NO: 793) |  |
|  | 3'-AACAAUGUGAAAUAAGUCUAAUGUUAA-5' | (SEQ ID NO: 1902) |  |
| βc-3429 Target: | 5'-TTGTTACACTTTATTCAGATTACAATT-3' | (SEQ ID NO: 3011) |  |
|  | 5'-UGUUACACUUUAUUCAGAUUACAat-3' | (SEQ ID NO: 794) |  |
|  | 3'-UAACAAUGUGAAAUAAGUCUAAUGUUA-5' | (SEQ ID NO: 1903) |  |
| βc-3430 Target: | 5'-ATTGTTACACTTTATTCAGATTACAAT-3' | (SEQ ID NO: 3012) |  |
|  | 5'-ACACAAUUGUUACACUUUAUUCAga-3' | (SEQ ID NO: 795) |  |
|  | 3'-GAUGUGUUAACAAUGUGAAAUAAGUCU-5' | (SEQ ID NO: 1904) |  |
| βc-3437 Target: | 5'-CTACACAATTGTTACACTTTATTCAGA-3' | (SEQ ID NO: 3013) |  |
|  | 5'-GGCUACACAAUUGUUACACUUUAtt-3' | (SEQ ID NO: 796) |  |
|  | 3'-UUCCGAUGUGUUAACAAUGUGAAAUAA-5' | (SEQ ID NO: 1905) |  |
| βc-3441 Target: | 5'-AAGGCTACACAATTGTTACACTTTATT-3' | (SEQ ID NO: 3014) |  |
|  | 5'-AAAAAGGCUACACAAUUGUUACAct-3' | (SEQ ID NO: 797) |  |
|  | 3'-UGUUUUCCGAUGUGUUAACAAUGUGA-5' | (SEQ ID NO: 1906) |  |
| βc-3446 Target: | 5'-ACAAAAGGCTACACAATTGTTACACT-3' | (SEQ ID NO: 3015) |  |
|  | 5'-UUAUACAAAAGGCUACACAAUUgt-3' | (SEQ ID NO: 798) |  |
|  | 3'-AAAAUAUGUUUUCCGAUGUGUUAACA-5' | (SEQ ID NO: 1907) |  |
| βc-3452 Target: | 5'-TTTTATACAAAAGGCTACACAATTGT-3' | (SEQ ID NO: 3016) |  |
|  | 5'-UUUAUACAAAAGGCUACACAAUtg-3' | (SEQ ID NO: 799) |  |
|  | 3'-UAAAAUAUGUUUUCCGAUGUGUUAAC-5' | (SEQ ID NO: 1908) |  |
| βc-3453 Target: | 5'-ATTTTATACAAAAGGCTACACAATTG-3' | (SEQ ID NO: 3017) |  |

TABLE 9-continued

Additional Selected Anti-β-catenin DsiRNAs, 25/27mer Duplexes

|  |  |  |
|---|---|---|
|  | 5'-AUUUUAUACAAAAAGGCUACACAat-3' | (SEQ ID NO: 800) |
|  | 3'-<u>GA</u>UAAAAUAUGUUUUUCCGAUGUGUUA-5' | (SEQ ID NO: 1909) |
| βc-3455 Target: | 5'-CTATTTTATACAAAAAGGCTACACAAT-3' | (SEQ ID NO: 3018) |
|  | 5'-UAUUUUAUACAAAAAGGCUACACaa-3' | (SEQ ID NO: 801) |
|  | 3'-<u>AGA</u>UAAAAUAUGUUUUUCCGAUGUGUU-5' | (SEQ ID NO: 1910) |
| βc-3456 Target: | 5'-TCTATTTTATACAAAAAGGCTACACAA-3' | (SEQ ID NO: 3019) |
|  | 5'-UCUAUUUUAUACAAAAAGGCUACac-3' | (SEQ ID NO: 802) |
|  | 3'-<u>ACA</u>GAUAAAAUAUGUUUUUCCGAUGUG-5' | (SEQ ID NO: 1911) |
| βc-3458 Target: | 5'-TGTCTATTTTATACAAAAAGGCTACAC-3' | (SEQ ID NO: 3020) |
|  | 5'-UAUUUGUCUAUUUUAUACAAAAAgg-3' | (SEQ ID NO: 803) |
|  | 3'-<u>AGA</u>UAAACAGAUAAAAUAUGUUUUUCC-5' | (SEQ ID NO: 1912) |
| βc-3464 Target: | 5'-TCTATTTGTCTATTTTATACAAAAAGG-3' | (SEQ ID NO: 3021) |
|  | 5'-UCUAUUUGUCUAUUUUAUACAAAaa-3' | (SEQ ID NO: 804) |
|  | 3'-<u>AAA</u>GAUAAACAGAUAAAAUAUGUUUUU-5' | (SEQ ID NO: 1913) |
| βc-3466 Target: | 5'-TTTCTATTTGTCTATTTTATACAAAAA-3' | (SEQ ID NO: 3022) |
|  | 5'-UUCUAUUUGUCUAUUUUAUACAAaa-3' | (SEQ ID NO: 805) |
|  | 3'-<u>AAA</u>AGAUAAACAGAUAAAAUAUGUUUU-5' | (SEQ ID NO: 1914) |
| βc-3467 Target: | 5'-TTTTCTATTTGTCTATTTTATACAAAA-3' | (SEQ ID NO: 3023) |
|  | 5'-UUUCUAUUUGUCUAUUUUAUACAaa-3' | (SEQ ID NO: 806) |
|  | 3'-<u>UAA</u>AAGAUAAACAGAUAAAAUAUGUUU-5' | (SEQ ID NO: 1915) |
| βc-3468 Target: | 5'-ATTTTCTATTTGTCTATTTTATACAAA-3' | (SEQ ID NO: 3024) |
|  | 5'-UUUUCUAUUUGUCUAUUUUAUACaa-3' | (SEQ ID NO: 807) |
|  | 3'-<u>GUA</u>AAAGAUAAACAGAUAAAAUAUGUU-5' | (SEQ ID NO: 1916) |
| βc-3469 Target: | 5'-CATTTTCTATTTGTCTATTTTATACAA-3' | (SEQ ID NO: 3025) |
|  | 5'-AUUUUCUAUUUGUCUAUUUUAUAca-3' | (SEQ ID NO: 808) |
|  | 3'-<u>GGU</u>AAAAGAUAAACAGAUAAAAUAUGU-5' | (SEQ ID NO: 1917) |
| βc-3470 Target: | 5'-CCATTTTCTATTTGTCTATTTTATACA-3' | (SEQ ID NO: 3026) |
|  | 5'-ACCAUUUUCUAUUUGUCUAUUUUat-3' | (SEQ ID NO: 809) |
|  | 3'-<u>CCU</u>GGUAAAAGAUAAACAGAUAAAAUA-5' | (SEQ ID NO: 1918) |
| βc-3473 Target: | 5'-GGACCATTTTCTATTTGTCTATTTTAT-3' | (SEQ ID NO: 3027) |
|  | 5'-GACCAUUUUCUAUUUGUCUAUUUta-3' | (SEQ ID NO: 810) |
|  | 3'-<u>ACC</u>UGGUAAAAGAUAAACAGAUAAAAU-5' | (SEQ ID NO: 1919) |
| βc-3474 Target: | 5'-TGGACCATTTTCTATTTGTCTATTTTA-3' | (SEQ ID NO: 3028) |
|  | 5'-GGACCAUUUUCUAUUUGUCUAUUtt-3' | (SEQ ID NO: 811) |
|  | 3'-<u>AAC</u>CUGGUAAAAGAUAAACAGAUAAAA-5' | (SEQ ID NO: 1920) |
| βc-3475 Target: | 5'-TTGGACCATTTTCTATTTGTCTATTTT-3' | (SEQ ID NO: 3029) |
|  | 5'-ACUAAUUGGACCAUUUUCUAUUUgt-3' | (SEQ ID NO: 812) |
|  | 3'-<u>UUU</u>GAUUAACCUGGUAAAAGAUAAACA-5' | (SEQ ID NO: 1921) |
| βc-3482 Target: | 5'-AAACTAATTGGACCATTTTCTATTTGT-3' | (SEQ ID NO: 3030) |

TABLE 9-continued

Additional Selected Anti-β-catenin DsiRNAs, 25/27mer Duplexes

|  |  |  |
|---|---|---|
|  | 5'-AACUAAUUGGACCAUUUUCUAUUtg-3' | (SEQ ID NO: 813) |
|  | 3'-CUUUGAUUAACCUGGUAAAAGAUAAAC-5' | (SEQ ID NO: 1922) |
| βc-3483 Target: | 5'-GAAACTAATTGGACCATTTTCTATTTG-3' | (SEQ ID NO: 3031) |
|  | 5'-AAACUAAUUGGACCAUUUUCUAUtt-3' | (SEQ ID NO: 814) |
|  | 3'-CCUUUGAUUAACCUGGUAAAAGAUAAA-5' | (SEQ ID NO: 1923) |
| βc-3484 Target: | 5'-GGAAACTAATTGGACCATTTTCTATTT-3' | (SEQ ID NO: 3032) |
|  | 5'-GAAACUAAUUGGACCAUUUUCUAtt-3' | (SEQ ID NO: 815) |
|  | 3'-UCCUUUGAUUAACCUGGUAAAAGAUAA-5' | (SEQ ID NO: 1924) |
| βc-3485 Target: | 5'-AGGAAACTAATTGGACCATTTTCTATT-3' | (SEQ ID NO: 3033) |
|  | 5'-AAAAAGGAAACUAAUUGGACCAUtt-3' | (SEQ ID NO: 816) |
|  | 3'-AAUUUUCCUUUGAUUAACCUGGUAAA-5' | (SEQ ID NO: 1925) |
| βc-3491 Target: | 5'-TTAAAAAGGAAACTAATTGGACCATTT-3' | (SEQ ID NO: 3034) |
|  | 5'-UAAAAGGAAACUAAUUGGACCAtt-3' | (SEQ ID NO: 817) |
|  | 3'-UAAUUUUCCUUUGAUUAACCUGGUAA-5' | (SEQ ID NO: 1926) |
| βc-3492 Target: | 5'-ATTAAAAAGGAAACTAATTGGACCATT-3' | (SEQ ID NO: 3035) |
|  | 5'-GCAUAUUAAAAGGAAACUAAUUgg-3' | (SEQ ID NO: 818) |
|  | 3'-UUCGUAUAAUUUUUCCUUUGAUUAACC-5' | (SEQ ID NO: 1927) |
| βc-3498 Target: | 5'-AAGCATATTAAAAGGAAACTAATTGG-3' | (SEQ ID NO: 3036) |
|  | 5'-AGCAUAUUAAAAGGAAACUAAUtg-3' | (SEQ ID NO: 819) |
|  | 3'-AUUCGUAUAAUUUUUCCUUUGAUUAAC-5' | (SEQ ID NO: 1928) |
| βc-3499 Target: | 5'-TAAGCATATTAAAAGGAAACTAATTG-3' | (SEQ ID NO: 3037) |
|  | 5'-UUUAAGCAUAUUAAAAGGAAACta-3' | (SEQ ID NO: 820) |
|  | 3'-UAAAAUUCGUAUAAUUUUUCCUUUGAU-5' | (SEQ ID NO: 1929) |
| βc-3503 Target: | 5'-ATTTTAAGCATATTAAAAGGAAACTA-3' | (SEQ ID NO: 3038) |
|  | 5'-GCUUAUUUUAAGCAUAUUAAAAAgg-3' | (SEQ ID NO: 821) |
|  | 3'-GACGAAUAAAAUUCGUAUAAUUUUUCC-5' | (SEQ ID NO: 1930) |
| βc-3509 Target: | 5'-CTGCTTATTTTAAGCATATTAAAAGG-3' | (SEQ ID NO: 3039) |
|  | 5'-UGCUUAUUUUAAGCAUAUUAAAAag-3' | (SEQ ID NO: 822) |
|  | 3'-GGACGAAUAAAAUUCGUAUAAUUUUUC-5' | (SEQ ID NO: 1931) |
| βc-3510 Target: | 5'-CCTGCTTATTTTAAGCATATTAAAAG-3' | (SEQ ID NO: 3040) |
|  | 5'-UCCACCUGCUUAUUUUAAGCAUAtt-3' | (SEQ ID NO: 823) |
|  | 3'-CUAGGUGGACGAAUAAAAUUCGUAUAA-5' | (SEQ ID NO: 1932) |
| βc-3516 Target: | 5'-GATCCACCTGCTTATTTTAAGCATATT-3' | (SEQ ID NO: 3041) |
|  | 5'-AAAACAUGAAAUAGAUCCACCUGct-3' | (SEQ ID NO: 824) |
|  | 3'-GUUUUUGUACUUUAUCUAGGUGGACGA-5' | (SEQ ID NO: 1933) |
| βc-3531 Target: | 5'-CAAAAACATGAAATAGATCCACCTGCT-3' | (SEQ ID NO: 3042) |
|  | 5'-AAAAACAUGAAAUAGAUCCACCUgc-3' | (SEQ ID NO: 825) |
|  | 3'-AGUUUUUGUACUUUAUCUAGGUGGACG-5' | (SEQ ID NO: 1934) |
| βc-3532 Target: | 5'-TCAAAAACATGAAATAGATCCACCTGC-3' | (SEQ ID NO: 3043) |

TABLE 9-continued

Additional Selected Anti-β-catenin DsiRNAs, 25/27mer Duplexes

|  |  |  |
|---|---|---|
|  | 5'-UCAAAAACAUGAAAUAGAUCCACct-3' | (SEQ ID NO: 826) |
|  | 3'-CUAGUUUUUGUACUUUAUCUAGGUGGA-5' | (SEQ ID NO: 1935) |
| βc-3534 Target: | 5'-GATCAAAAACATGAAATAGATCCACCT-3' | (SEQ ID NO: 3044) |
|  | 5'-AUCAAAAACAUGAAAUAGAUCCAcc-3' | (SEQ ID NO: 827) |
|  | 3'-ACUAGUUUUUGUACUUUAUCUAGGUGG-5' | (SEQ ID NO: 1936) |
| βc-3535 Target: | 5'-TGATCAAAAACATGAAATAGATCCACC-3' | (SEQ ID NO: 3045) |
|  | 5'-GAUCAAAAACAUGAAAUAGAUCCac-3' | (SEQ ID NO: 828) |
|  | 3'-AACUAGUUUUUGUACUUUAUCUAGGUG-5' | (SEQ ID NO: 1937) |
| βc-3536 Target: | 5'-TTGATCAAAAACATGAAATAGATCCAC-3' | (SEQ ID NO: 3046) |
|  | 5'-UUUUUGAUCAAAAACAUGAAAUAga-3' | (SEQ ID NO: 829) |
|  | 3'-UCAAAAACUAGUUUUUGUACUUUAUCU-5' | (SEQ ID NO: 1938) |
| βc-3541 Target: | 5'-AGTTTTTGATCAAAAACATGAAATAGA-3' | (SEQ ID NO: 3047) |
|  | 5'-AAAUAGUUUUUGAUCAAAAACAUga-3' | (SEQ ID NO: 830) |
|  | 3'-GGUUUAUCAAAAACUAGUUUUUGUACU-5' | (SEQ ID NO: 1939) |
| βc-3547 Target: | 5'-CCAAATAGTTTTTGATCAAAAACATGA-3' | (SEQ ID NO: 3048) |
|  | 5'-UCCCAAAUAGUUUUUGAUCAAAAac-3' | (SEQ ID NO: 831) |
|  | 3'-AUAGGGUUUAUCAAAAACUAGUUUUUG-5' | (SEQ ID NO: 1940) |
| βc-3551 Target: | 5'-TATCCCAAATAGTTTTTGATCAAAAAC-3' | (SEQ ID NO: 3049) |
|  | 5'-AUCCCAAAUAGUUUUUGAUCAAAaa-3' | (SEQ ID NO: 832) |
|  | 3'-UAUAGGGUUUAUCAAAAACUAGUUUUU-5' | (SEQ ID NO: 1941) |
| βc-3552 Target: | 5'-ATATCCCAAATAGTTTTTGATCAAAAA-3' | (SEQ ID NO: 3050) |
|  | 5'-UAUCCCAAAUAGUUUUUGAUCAAaa-3' | (SEQ ID NO: 833) |
|  | 3'-GUAUAGGGUUUAUCAAAAACUAGUUUU-5' | (SEQ ID NO: 1942) |
| βc-3553 Target: | 5'-CATATCCCAAATAGTTTTTGATCAAAA-3' | (SEQ ID NO: 3051) |
|  | 5'-AUAUCCCAAAUAGUUUUUGAUCAaa-3' | (SEQ ID NO: 834) |
|  | 3'-UGUAUAGGGUUUAUCAAAAACUAGUUU-5' | (SEQ ID NO: 1943) |
| βc-3554 Target: | 5'-ACATATCCCAAATAGTTTTTGATCAAA-3' | (SEQ ID NO: 3052) |
|  | 5'-AUACAUAUCCCAAAUAGUUUUUGat-3' | (SEQ ID NO: 835) |
|  | 3'-GGUAUGUAUAGGGUUUAUCAAAAACUA-5' | (SEQ ID NO: 1944) |
| βc-3558 Target: | 5'-CCATACATATCCCAAATAGTTTTTGAT-3' | (SEQ ID NO: 3053) |
|  | 5'-ACCCUACCCAUACAUAUCCCAAAta-3' | (SEQ ID NO: 836) |
|  | 3'-AAUGGGAUGGGUAUGUAUAGGGUUUAU-5' | (SEQ ID NO: 1945) |
| βc-3567 Target: | 5'-TTACCCTACCCATACATATCCCAAATA-3' | (SEQ ID NO: 3054) |
|  | 5'-UACCCUACCCAUACAUAUCCCAAat-3' | (SEQ ID NO: 837) |
|  | 3'-AAAUGGGAUGGGUAUGUAUAGGGUUUA-5' | (SEQ ID NO: 1946) |
| βc-3568 Target: | 5'-TTTACCCTACCCATACATATCCCAAAT-3' | (SEQ ID NO: 3055) |
|  | 5'-UUACCCUACCCAUACAUAUCCCAaa-3' | (SEQ ID NO: 838) |
|  | 3'-UAAAUGGGAUGGGUAUGUAUAGGGUUU-5' | (SEQ ID NO: 1947) |
| βc-3569 Target: | 5'-ATTTACCCTACCCATACATATCCCAAA-3' | (SEQ ID NO: 3056) |

TABLE 9-continued

Additional Selected Anti-β-catenin DsiRNAs, 25/27mer Duplexes

|  |  |  |
|---|---|---|
|  | 5'-ACCUCUUACUGAUUUACCCUACCca-3' | (SEQ ID NO: 839) |
|  | 3'-UGUGGAGAAUGACUAAAUGGGAUGGGU-5' | (SEQ ID NO: 1948) |
| βc-3582 Target: | 5'-ACACCTCTTACTGATTTACCCTACCCA-3' | (SEQ ID NO: 3057) |
|  | 5'-ACACCUCUUACUGAUUUACCCUAcc-3' | (SEQ ID NO: 840) |
|  | 3'-AUUGUGGAGAAUGACUAAAUGGGAUGG-5' | (SEQ ID NO: 1949) |
| βc-3584 Target: | 5'-TAACACCTCTTACTGATTTACCCTACC-3' | (SEQ ID NO: 3058) |
|  | 5'-AACACCUCUUACUGAUUUACCCUac-3' | (SEQ ID NO: 841) |
|  | 3'-UAUUGUGGAGAAUGACUAAAUGGGAUG-5' | (SEQ ID NO: 1950) |
| βc-3585 Target: | 5'-ATAACACCTCTTACTGATTTACCCTAC-3' | (SEQ ID NO: 3059) |
|  | 5'-UAACACCUCUUACUGAUUUACCCta-3' | (SEQ ID NO: 842) |
|  | 3'-UUAUUGUGGAGAAUGACUAAAUGGGAU-5' | (SEQ ID NO: 1951) |
| βc-3586 Target: | 5'-AATAACACCTCTTACTGATTTACCCTA-3' | (SEQ ID NO: 3060) |
|  | 5'-AUAACACCUCUUACUGAUUUACCct-3' | (SEQ ID NO: 843) |
|  | 3'-UUUAUUGUGGAGAAUGACUAAAUGGGA-5' | (SEQ ID NO: 1952) |
| βc-3587 Target: | 5'-AAATAACACCTCTTACTGATTTACCCT-3' | (SEQ ID NO: 3061) |
|  | 5'-AAUAACACCUCUUACUGAUUUACcc-3' | (SEQ ID NO: 844) |
|  | 3'-GUUUAUUGUGGAGAAUGACUAAAUGGG-5' | (SEQ ID NO: 1953) |
| βc-3588 Target: | 5'-CAAATAACACCTCTTACTGATTTACCC-3' | (SEQ ID NO: 3062) |
|  | 5'-GUUCCAAAUAACACCUCUUACUGat-3' | (SEQ ID NO: 845) |
|  | 3'-UCCAAGGUUUAUUGUGGAGAAUGACUA-5' | (SEQ ID NO: 1954) |
| βc-3594 Target: | 5'-AGGTTCCAAATAACACCTCTTACTGAT-3' | (SEQ ID NO: 3063) |
|  | 5'-AACAAGGUUCCAAAUAACACCUCtt-3' | (SEQ ID NO: 846) |
|  | 3'-UUUUGUUCCAAGGUUUAUUGUGGAGAA-5' | (SEQ ID NO: 1955) |
| βc-3600 Target: | 5'-AAAACAAGGTTCCAAATAACACCTCTT-3' | (SEQ ID NO: 3064) |
|  | 5'-AAACAAGGUUCCAAAUAACACCUct-3' | (SEQ ID NO: 847) |
|  | 3'-GUUUUGUUCCAAGGUUUAUUGUGGAGA-5' | (SEQ ID NO: 1956) |
| βc-3601 Target: | 5'-CAAAACAAGGTTCCAAATAACACCTCT-3' | (SEQ ID NO: 3065) |
|  | 5'-AAAACAAGGUUCCAAAUAACACCtc-3' | (SEQ ID NO: 848) |
|  | 3'-GGUUUUGUUCCAAGGUUUAUUGUGGAG-5' | (SEQ ID NO: 1957) |
| βc-3602 Target: | 5'-CCAAAACAAGGTTCCAAATAACACCTC-3' | (SEQ ID NO: 3066) |
|  | 5'-UGUCCAAAACAAGGUUCCAAAUAac-3' | (SEQ ID NO: 849) |
|  | 3'-UGACAGGUUUUGUUCCAAGGUUUAUUG-5' | (SEQ ID NO: 1958) |
| βc-3607 Target: | 5'-ACTGTCCAAAACAAGGTTCCAAATAAC-3' | (SEQ ID NO: 3067) |
|  | 5'-AAACUGUCCAAAACAAGGUUCCAaa-3' | (SEQ ID NO: 850) |
|  | 3'-CAUUUGACAGGUUUUGUUCCAAGGUUU-5' | (SEQ ID NO: 1959) |
| βc-3611 Target: | 5'-GTAAACTGTCCAAAACAAGGTTCCAAA-3' | (SEQ ID NO: 3068) |
|  | 5'-UAAACUGUCCAAAACAAGGUUCCaa-3' | (SEQ ID NO: 851) |
|  | 3'-CCAUUUGACAGGUUUUGUUCCAAGGUU-5' | (SEQ ID NO: 1960) |
| βc-3612 Target: | 5'-GGTAAACTGTCCAAAACAAGGTTCCAA-3' | (SEQ ID NO: 3069) |

TABLE 9-continued

Additional Selected Anti-β-catenin DsiRNAs, 25/27mer Duplexes

|  |  |  |
|---|---|---|
|  | 5'-GCAACUGGUAAACUGUCCAAAACaa-3' | (SEQ ID NO: 852) |
|  | 3'-UCCGUUGACCAUUUGACAGGUUUUGUU-5' | (SEQ ID NO: 1961) |
| βc-3620 Target: | 5'-AGGCAACTGGTAAACTGTCCAAAACAA-3' | (SEQ ID NO: 3070) |
|  | 5'-GAUAAAAGGCAACUGGUAAACUGtc-3' | (SEQ ID NO: 853) |
|  | 3'-CCCUAUUUUCCGUUGACCAUUUGACAG-5' | (SEQ ID NO: 1962) |
| βc-3628 Target: | 5'-GGGATAAAAGGCAACTGGTAAACTGTC-3' | (SEQ ID NO: 3071) |
|  | 5'-GGAUAAAAGGCAACUGGUAAACUgt-3' | (SEQ ID NO: 854) |
|  | 3'-ACCCUAUUUUCCGUUGACCAUUUGACA-5' | (SEQ ID NO: 1963) |
| βc-3629 Target: | 5'-TGGGATAAAAGGCAACTGGTAAACTGT-3' | (SEQ ID NO: 3072) |
|  | 5'-AACUUUGGGAUAAAAGGCAACUGgt-3' | (SEQ ID NO: 855) |
|  | 3'-UGUUGAAACCCUAUUUUCCGUUGACCA-5' | (SEQ ID NO: 1964) |
| βc-3636 Target: | 5'-ACAACTTTGGGATAAAAGGCAACTGGT-3' | (SEQ ID NO: 3073) |
|  | 5'-ACAACUUUGGGAUAAAAGGCAACtg-3' | (SEQ ID NO: 856) |
|  | 3'-GUUGUUGAAACCCUAUUUUCCGUUGAC-5' | (SEQ ID NO: 1965) |
| βc-3638 Target: | 5'-CAACAACTTTGGGATAAAAGGCAACTG-3' | (SEQ ID NO: 3074) |
|  | 5'-UUACAACAACUUUGGGAUAAAAGgc-3' | (SEQ ID NO: 857) |
|  | 3'-CCAAUGUUGUUGAAACCCUAUUUUCCG-5' | (SEQ ID NO: 1966) |
| βc-3643 Target: | 5'-GGTTACAACAACTTTGGGATAAAAGGC-3' | (SEQ ID NO: 3075) |
|  | 5'-GUUACAACAACUUUGGGAUAAAAgg-3' | (SEQ ID NO: 858) |
|  | 3'-UCCAAUGUUGUUGAAACCCUAUUUUCC-5' | (SEQ ID NO: 1967) |
| βc-3644 Target: | 5'-AGGTTACAACAACTTTGGGATAAAAGG-3' | (SEQ ID NO: 3076) |
|  | 5'-GGUUACAACAACUUUGGGAUAAAag-3' | (SEQ ID NO: 859) |
|  | 3'-GUCCAAUGUUGUUGAAACCCUAUUUUC-5' | (SEQ ID NO: 1968) |
| βc-3645 Target: | 5'-CAGGTTACAACAACTTTGGGATAAAAG-3' | (SEQ ID NO: 3077) |
|  | 5'-UCACAGCAGGUUACAACAACUUUgg-3' | (SEQ ID NO: 860) |
|  | 3'-AUAGUGUCGUCCAAUGUUGUUGAAACC-5' | (SEQ ID NO: 1969) |
| βc-3653 Target: | 5'-TATCACAGCAGGTTACAACAACTTTGG-3' | (SEQ ID NO: 3078) |
|  | 5'-AUCACAGCAGGUUACAACAACUUtg-3' | (SEQ ID NO: 861) |
|  | 3'-CAUAGUGUCGUCCAAUGUUGUUGAAAC-5' | (SEQ ID NO: 1970) |
| βc-3654 Target: | 5'-GTATCACAGCAGGTTACAACAACTTTG-3' | (SEQ ID NO: 3079) |
|  | 5'-GUAUCACAGCAGGUUACAACAACtt-3' | (SEQ ID NO: 862) |
|  | 3'-AGCAUAGUGUCGUCCAAUGUUGUUGAA-5' | (SEQ ID NO: 1971) |
| βc-3656 Target: | 5'-TCGTATCACAGCAGGTTACAACAACTT-3' | (SEQ ID NO: 3080) |
|  | 5'-UCUCUUGAAGCAUCGUAUCACAGca-3' | (SEQ ID NO: 863) |
|  | 3'-AAAGAGAACUUCGUAGCAUAGUGUCGU-5' | (SEQ ID NO: 1972) |
| βc-3670 Target: | 5'-TTTCTCTTGAAGCATCGTATCACAGCA-3' | (SEQ ID NO: 3081) |
|  | 5'-UUCUCUUGAAGCAUCGUAUCACAGc-3' | (SEQ ID NO: 864) |
|  | 3'-AAAAGAGAACUUCGUAGCAUAGUGUCG-5' | (SEQ ID NO: 1973) |
| βc-3671 Target: | 5'-TTTTCTCTTGAAGCATCGTATCACAGC-3' | (SEQ ID NO: 3082) |

TABLE 9-continued

Additional Selected Anti-β-catenin DsiRNAs, 25/27mer Duplexes

```
                    5'-UUUUCUCUUGAAGCAUCGUAUCAca-3'      (SEQ ID NO: 865)
                    3'-GUAAAAGAGAACUUCGUAGCAUAGUGU-5'    (SEQ ID NO: 1974)
βc-3673 Target:     5'-CATTTTCTCTTGAAGCATCGTATCACA-3'    (SEQ ID NO: 3083)

5'-UUUUAUAACCGCAUUUUCUCUUGaa-3'      (SEQ ID NO: 866)
                    3'-AAAAAAUAUUGGCGUAAAAGAGAACUU-5'    (SEQ ID NO: 1975)
βc-3686 Target:     5'-TTTTTTATAACCGCATTTTCTCTTGAA-3'    (SEQ ID NO: 3084)

5'-UUUUUAUAACCGCAUUUUCUCUUga-3'      (SEQ ID NO: 867)
                    3'-UAAAAAAUAUUGGCGUAAAAGAGAACU-5'    (SEQ ID NO: 1976)
βc-3687 Target:     5'-ATTTTTTATAACCGCATTTTCTCTTGA-3'    (SEQ ID NO: 3085)

5'-UUUUUUAUAACCGCAUUUUCUCUtg-3'      (SEQ ID NO: 868)
                    3'-GUAAAAAAUAUUGGCGUAAAAGAGAAC-5'    (SEQ ID NO: 1977)
βc-3688 Target:     5'-CATTTTTTATAACCGCATTTTCTCTTG-3'    (SEQ ID NO: 3086)

5'-AUUUUUUAUAACCGCAUUUUCUCtt-3'      (SEQ ID NO: 869)
                    3'-GGUAAAAAAUAUUGGCGUAAAAGAGAA-5'    (SEQ ID NO: 1978)
βc-3689 Target:     5'-CCATTTTTTATAACCGCATTTTCTCTT-3'    (SEQ ID NO: 3087)

5'-GAACCAUUUUUUAUAACCGCAUUtt-3'      (SEQ ID NO: 870)
                    3'-GACUUGGUAAAAAAUAUUGGCGUAAAA-5'    (SEQ ID NO: 1979)
βc-3694 Target:     5'-CTGAACCATTTTTTATAACCGCATTTT-3'    (SEQ ID NO: 3088)

5'-AUUCUGAACCAUUUUUUAUAACCgc-3'      (SEQ ID NO: 871)
                    3'-AUUAAGACUUGGUAAAAAAUAUUGGCG-5'    (SEQ ID NO: 1980)
βc-3699 Target:     5'-TAATTCTGAACCATTTTTTATAACCGC-3'    (SEQ ID NO: 3089)

5'-AAUUCUGAACCAUUUUUUAUAACcg-3'      (SEQ ID NO: 872)
                    3'-AAUUAAGACUUGGUAAAAAAUAUUGGC-5'    (SEQ ID NO: 1981)
βc-3700 Target:     5'-TTAATTCTGAACCATTTTTTATAACCG-3'    (SEQ ID NO: 3090)

5'-UAAUUCUGAACCAUUUUUUAUAAcc-3'      (SEQ ID NO: 873)
                    3'-AAAUUAAGACUUGGUAAAAAAUAUUGG-5'    (SEQ ID NO: 1982)
βc-3701 Target:     5'-TTTAATTCTGAACCATTTTTTATAACC-3'    (SEQ ID NO: 3091)

5'-UUAAUUCUGAACCAUUUUUUAUAac-3'      (SEQ ID NO: 874)
                    3'-CAAAUUAAGACUUGGUAAAAAAUAUUG-5'    (SEQ ID NO: 1983)
βc-3702 Target:     5'-GTTTAATTCTGAACCATTTTTTATAAC-3'    (SEQ ID NO: 3092)

5'-UUUAAUUCUGAACCAUUUUUUAUaa-3'      (SEQ ID NO: 875)
                    3'-UCAAAUUAAGACUUGGUAAAAAAUAUU-5'    (SEQ ID NO: 1984)
βc-3703 Target:     5'-AGTTTAATTCTGAACCATTTTTTATAA-3'    (SEQ ID NO: 3093)

5'-GUUUAAUUCUGAACCAUUUUUUAta-3'      (SEQ ID NO: 876)
                    3'-UUCAAAUUAAGACUUGGUAAAAAAUAU-5'    (SEQ ID NO: 1985)
βc-3704 Target:     5'-AAGTTTAATTCTGAACCATTTTTTATA-3'    (SEQ ID NO: 3094)

5'-UAAAAGUUUAAUUCUGAACCAUUtt-3'      (SEQ ID NO: 877)
                    3'-UAAUUUCAAAUUAAGACUUGGUAAAA-5'     (SEQ ID NO: 1986)
βc-3709 Target:     5'-ATTAAAAGTTTAATTCTGAACCATTTT-3'    (SEQ ID NO: 3095)
```

TABLE 9-continued

Additional Selected Anti-β-catenin DsiRNAs, 25/27mer Duplexes

|  |  |  |  |
|---|---|---|---|
|  | 5'-UUAAAAGUUUAAUUCUGAACCAUtt-3' | (SEQ ID NO: 878) |  |
|  | 3'-UUAAUUUUCAAAUUAAGACUUGGUAAA-5' | (SEQ ID NO: 1987) |  |
| βc-3710 Target: | 5'-AATTAAAAGTTTAATTCTGAACCATTT-3' | (SEQ ID NO: 3096) |  |
|  | 5'-AAUUAAAAGUUUAAUUCUGAACCat-3' | (SEQ ID NO: 879) |  |
|  | 3'-ACUUAAUUUUCAAAUUAAGACUUGGUA-5' | (SEQ ID NO: 1988) |  |
| βc-3712 Target: | 5'-TGAATTAAAAGTTTAATTCTGAACC-3' | (SEQ ID NO: 3097) |  |
|  | 5'-AUACAGCUAAAGGAUGAUUUACAgg-3' | (SEQ ID NO: 880) |  |
|  | 3'-GUUAUGUCGAUUUCCUACUAAAUGUCC-5' | (SEQ ID NO: 1989) |  |
| βc-2634t2 Target: | 5'-CAATACAGCTAAAGGATGATTTACAGG-3' | (SEQ ID NO: 3098) |  |
|  | 5'-AAUACAGCUAAAGGAUGAUUUACag-3' | (SEQ ID NO: 881) |  |
|  | 3'-UGUUAUGUCGAUUUCCUACUAAAUGUC-5' | (SEQ ID NO: 1990) |  |
| βc-2635t2 Target: | 5'-ACAATACAGCTAAAGGATGATTTACAG-3' | (SEQ ID NO: 3099) |  |
|  | 5'-ACAAUACAGCUAAAGGAUGAUUUac-3' | (SEQ ID NO: 882) |  |
|  | 3'-UCUGUUAUGUCGAUUUCCUACUAAAUG-5' | (SEQ ID NO: 1991) |  |
| βc-2637t2 Target: | 5'-AGACAATACAGCTAAAGGATGATTTAC-3' | (SEQ ID NO: 3100) |  |
|  | 5'-UACUCCUAAAGGAUGAUUUACAGgt-3' | (SEQ ID NO: 883) |  |
|  | 3'-CAAUGAGGAUUUCCUACUAAAUGUCCA-5' | (SEQ ID NO: 1992) |  |
| βc-2633t3 Target: | 5'-GTTACTCCTAAAGGATGATTTACAGGT-3' | (SEQ ID NO: 3101) |  |
|  | 5'-UUACUCCUAAAGGAUGAUUUACAgg-3' | (SEQ ID NO: 884) |  |
|  | 3'-ACAAUGAGGAUUUCCUACUAAAUGUCC-5' | (SEQ ID NO: 1993) |  |
| βc-2634t3 Target: | 5'-TGTTACTCCTAAAGGATGATTTACAGG-3' | (SEQ ID NO: 3102) |  |
|  | 5'-GUUACUCCUAAAGGAUGAUUUACag-3' | (SEQ ID NO: 885) |  |
|  | 3'-AACAAUGAGGAUUUCCUACUAAAUGUC-5' | (SEQ ID NO: 1994) |  |
| βc-2635t3 Target: | 5'-TTGTTACTCCTAAAGGATGATTTACAG-3' | (SEQ ID NO: 3103) |  |
|  | 5'-UGUUACUCCUAAAGGAUGAUUUAca-3' | (SEQ ID NO: 886) |  |
|  | 3'-UAACAAUGAGGAUUUCCUACUAAAUGU-5' | (SEQ ID NO: 1995) |  |
| βc-2636t3 Target: | 5'-ATTGTTACTCCTAAAGGATGATTTACA-3' | (SEQ ID NO: 3104) |  |
|  | 5'-AUUCCAGAAUCCAAGUAAGACUGct-3' | (SEQ ID NO: 887) |  |
|  | 3'-CCUAAGGUCUUAGGUUCAUUCUGACGA-5' | (SEQ ID NO: 1996) |  |
| βc-m318 Target: | 5'-GGATTCCAGAATCCAAGTAAGACTGCT-3' | (SEQ ID NO: 3105) |  |
|  | 5'-UGCUCCCAUUCAUAAAGGACUUGgg-3' | (SEQ ID NO: 888) |  |
|  | 3'-GAACGAGGGUAAGUAUUUCCUGAACCC-5' | (SEQ ID NO: 1997) |  |
| βc-m417 Target: | 5'-CTTGCTCCCATTCATAAAGGACTTGGG-3' | (SEQ ID NO: 3106) |  |
|  | 5'-UCAAUAUCAGCUACUUGCUCUUGcg-3' | (SEQ ID NO: 889) |  |
|  | 3'-GCAGUUAUAGUCGAUGAACGAGAACGC-5' | (SEQ ID NO: 1998) |  |
| βc-m462 Target: | 5'-CGTCAATATCAGCTACTTGCTCTTGCG-3' | (SEQ ID NO: 3107) |  |
|  | 5'-GUCAAUAUCAGCUACUUGCUCUUgc-3' | (SEQ ID NO: 890) |  |
|  | 3'-GGCAGUUAUAGUCGAUGAACGAGAACG-5' | (SEQ ID NO: 1999) |  |
| βc-m463 Target: | 5'-CCGTCAATATCAGCTACTTGCTCTTGC-3' | (SEQ ID NO: 3108) |  |

TABLE 9-continued

Additional Selected Anti-β-catenin DsiRNAs, 25/27mer Duplexes

|  |  |  |  |
|---|---|---|---|
|  | 5'-UGCCCGUCAAUAUCAGCUACUUGct-3' | (SEQ ID NO: 891) |  |
|  | 3'-UGACGGGCAGUUAUAGUCGAUGAACGA-5' | (SEQ ID NO: 2000) |  |
| βc-m468 Target: | 5'-ACTGCCCGTCAATATCAGCTACTTGCT-3' | (SEQ ID NO: 3109) |  |
|  | 5'-UUUCAACAUCUGUGAUGGUUCAGcc-3' | (SEQ ID NO: 892) |  |
|  | 3'-ACAAAGUUGUAGACACUACCAAGUCGG-5' | (SEQ ID NO: 2001) |  |
| βc-m613 Target: | 5'-TGTTTCAACATCTGTGATGGTTCAGCC-3' | (SEQ ID NO: 3110) |  |
|  | 5'-GUUUCAACAUCUGUGAUGGUUCAgc-3' | (SEQ ID NO: 893) |  |
|  | 3'-UACAAAGUUGUAGACACUACCAAGUCG-5' | (SEQ ID NO: 2002) |  |
| βc-m614 Target: | 5'-ATGTTTCAACATCTGTGATGGTTCAGC-3' | (SEQ ID NO: 3111) |  |
|  | 5'-ACAACUGCAUGUUUCAACAUCUGtg-3' | (SEQ ID NO: 894) |  |
|  | 3'-ACUGUUGACGUACAAAGUUGUAGACAC-5' | (SEQ ID NO: 2003) |  |
| βc-m624 Target: | 5'-TGACAACTGCATGTTTCAACATCTGTG-3' | (SEQ ID NO: 3112) |  |
|  | 5'-UGACAACUGCAUGUUUCAACAUCtg-3' | (SEQ ID NO: 895) |  |
|  | 3'-UAACUGUUGACGUACAAAGUUGUAGAC-5' | (SEQ ID NO: 2004) |  |
| βc-m626 Target: | 5'-ATTGACAACTGCATGTTTCAACATCTG-3' | (SEQ ID NO: 3113) |  |
|  | 5'-AAAUUGACAACUGCAUGUUUCAAca-3' | (SEQ ID NO: 896) |  |
|  | 3'-AGUUUAACUGUUGACGUACAAAGUUGU-5' | (SEQ ID NO: 2005) |  |
| βc-m630 Target: | 5'-TCAAATTGACAACTGCATGTTTCAACA-3' | (SEQ ID NO: 3114) |  |
|  | 5'-UUAAUCAAAUUGACAACUGCAUGtt-3' | (SEQ ID NO: 897) |  |
|  | 3'-UCAAUUAGUUUAACUGUUGACGUACAA-5' | (SEQ ID NO: 2006) |  |
| βc-m636 Target: | 5'-AGTTAATCAAATTGACAACTGCATGTT-3' | (SEQ ID NO: 3115) |  |
|  | 5'-UGAUAGUUAAUCAAAUUGACAACtg-3' | (SEQ ID NO: 898) |  |
|  | 3'-GGACUAUCAAUUAGUUUAACUGUUGAC-5' | (SEQ ID NO: 2007) |  |
| βc-m642 Target: | 5'-CCTGATAGTTAATCAAATTGACAACTG-3' | (SEQ ID NO: 3116) |  |
|  | 5'-UCAUCCUGAUAGUUAAUCAAAUUga-3' | (SEQ ID NO: 899) |  |
|  | 3'-GCAGUAGGACUAUCAAUUAGUUUAACU-5' | (SEQ ID NO: 2008) |  |
| βc-m648 Target: | 5'-CGTCATCCTGATAGTTAATCAAATTGA-3' | (SEQ ID NO: 3117) |  |
|  | 5'-GUCAUCCUGAUAGUUAAUCAAAUtg-3' | (SEQ ID NO: 900) |  |
|  | 3'-CGCAGUAGGACUAUCAAUUAGUUUAAC-5' | (SEQ ID NO: 2009) |  |
| βc-m649 Target: | 5'-GCGTCATCCTGATAGTTAATCAAATTG-3' | (SEQ ID NO: 3118) |  |
|  | 5'-UCAUCGUUUAGCAGUUUUGUCAGct-3' | (SEQ ID NO: 901) |  |
|  | 3'-GGAGUAGCAAAUCGUCAAAACAGUCGA-5' | (SEQ ID NO: 2010) |  |
| βc-m702 Target: | 5'-CCTCATCGTTTAGCAGTTTTGTCAGCT-3' | (SEQ ID NO: 3119) |  |
|  | 5'-GGUCCUCAUCGUUUAGCAGUUUUgt-3' | (SEQ ID NO: 902) |  |
|  | 3'-GACCAGGAGUAGCAAAUCGUCAAAACA-5' | (SEQ ID NO: 2011) |  |
| βc-m707 Target: | 5'-CTGGTCCTCATCGTTTAGCAGTTTTGT-3' | (SEQ ID NO: 3120) |  |
|  | 5'-UAACAGCAGCUUUAUUAACUACCac-3' | (SEQ ID NO: 903) |  |
|  | 3'-GUAUUGUCGUCGAAAUAAUUGAUGGUG-5' | (SEQ ID NO: 2012) |  |
| βc-m734 Target: | 5'-CATAACAGCAGCTTTATTAACTACCAC-3' | (SEQ ID NO: 3121) |  |

TABLE 9-continued

Additional Selected Anti-β-catenin DsiRNAs, 25/27mer Duplexes

|  |  |  |  |
|---|---|---|---|
| | 5'-AUAACAGCAGCUUUAUUAACUACca-3' | (SEQ ID NO: 904) | |
| | 3'-GGUAUUGUCGUCGAAAUAAUUGAUGGU-5' | (SEQ ID NO: 2013) | |
| βc-m735 Target: | 5'-CCATAACAGCAGCTTTATTAACTACCA-3' | (SEQ ID NO: 3122) | |
| | 5'-ACCAUAACAGCAGCUUUAUUAACta-3' | (SEQ ID NO: 905) | |
| | 3'-CCUGGUAUUGUCGUCGAAAUAAUUGAU-5' | (SEQ ID NO: 2014) | |
| βc-m738 Target: | 5'-GGACCATAACAGCAGCTTTATTAACTA-3' | (SEQ ID NO: 3123) | |
| | 5'-GACCAUAACAGCAGCUUUAUUAAct-3' | (SEQ ID NO: 906) | |
| | 3'-ACCUGGUAUUGUCGUCGAAAUAAUUGA-5' | (SEQ ID NO: 2015) | |
| βc-m739 Target: | 5'-TGGACCATAACAGCAGCTTTATTAACT-3' | (SEQ ID NO: 3124) | |
| | 5'-GUCUCUACAUCAUUUGUAUUCUGca-3' | (SEQ ID NO: 907) | |
| | 3'-GACAGAGAUGUAGUAAACAUAAGACGU-5' | (SEQ ID NO: 2016) | |
| βc-m843 Target: | 5'-CTGTCTCTACATCATTTGTATTCTGCA-3' | (SEQ ID NO: 3125) | |
| | 5'-UGUCUCUACAUCAUUUGUAUUCUgc-3' | (SEQ ID NO: 908) | |
| | 3'-CGACAGAGAUGUAGUAAACAUAAGACG-5' | (SEQ ID NO: 2017) | |
| βc-m844 Target: | 5'-GCTGTCTCTACATCATTTGTATTCTGC-3' | (SEQ ID NO: 3126) | |
| | 5'-AACCAUUUCUGCAGUCCACCAGct-3' | (SEQ ID NO: 909) | |
| | 3'-CGUUGGUAAAAGACGUCAGGUGGUCGA-5' | (SEQ ID NO: 2018) | |
| βc-m1063 Target: | 5'-GCAACCATTTTCTGCAGTCCACCAGCT-3' | (SEQ ID NO: 3127) | |
| | 5'-GCAACCAUUUUCUGCAGUCCACCag-3' | (SEQ ID NO: 910) | |
| | 3'-UUCGUUGGUAAAAGACGUCAGGUGGUC-5' | (SEQ ID NO: 2019) | |
| βc-m1065 Target: | 5'-AAGCAACCATTTTCTGCAGTCCACCAG-3' | (SEQ ID NO: 3128) | |
| | 5'-GUUUUGUUGAGCAAAGCAACCAUtt-3' | (SEQ ID NO: 911) | |
| | 3'-AACAAAACAACUCGUUUCGUUGGUAAA-5' | (SEQ ID NO: 2020) | |
| βc-m1080 Target: | 5'-TTGTTTTGTTGAGCAAAGCAACCATTT-3' | (SEQ ID NO: 3129) | |
| | 5'-UGUUUUGUUGAGCAAAGCAACCAtt-3' | (SEQ ID NO: 912) | |
| | 3'-AAACAAAACAACUCGUUUCGUUGGUAA-5' | (SEQ ID NO: 2021) | |
| βc-m1081 Target: | 5'-TTTGTTTTGTTGAGCAAAGCAACCATT-3' | (SEQ ID NO: 3130) | |
| | 5'-GCCAAGAAUUUCACGUUUGUUUUgt-3' | (SEQ ID NO: 913) | |
| | 3'-AUCGGUUCUUAAAGUGCAAACAAAACA-5' | (SEQ ID NO: 2022) | |
| βc-m1098 Target: | 5'-TAGCCAAGAATTTCACGTTTGTTTTGT-3' | (SEQ ID NO: 3131) | |
| | 5'-UGAUUGCCAUAAGCUAAGAUCUGaa-3' | (SEQ ID NO: 914) | |
| | 3'-GAACUAACGGUAUUCGAUUCUAGACUU-5' | (SEQ ID NO: 2023) | |
| βc-m1140 Target: | 5'-CTTGATTGCCATAAGCTAAGATCTGAA-3' | (SEQ ID NO: 3132) | |
| | 5'-UCUCUUGAUUGCCAUAAGCUAAGat-3' | (SEQ ID NO: 915) | |
| | 3'-CGAGAGAACUAACGGUAUUCGAUUCUA-5' | (SEQ ID NO: 2024) | |
| βc-m1145 Target: | 5'-GCTCTCTTGATTGCCATAAGCTAAGAT-3' | (SEQ ID NO: 3133) | |
| | 5'-UCUCAUAAGUGUAGGUCCUCAUUat-3' | (SEQ ID NO: 916) | |
| | 3'-GAAGAGUAUUCACAUCCAGGAGUAAUA-5' | (SEQ ID NO: 2025) | |
| βc-m1217 Target: | 5'-CTTCTCATAAGTGTAGGTCCTCATTAT-3' | (SEQ ID NO: 3134) | |

TABLE 9-continued

Additional Selected Anti-β-catenin DsiRNAs, 25/27mer Duplexes

|  |  |  |  |
|---|---|---|---|
|  | 5'-UUCUCAUAAGUGUAGGUCCUCAUta-3' | (SEQ ID NO: 917) |  |
|  | 3'-<u>CGA</u>AGAGUAUUCACAUCCAGGAGUAAU-5' | (SEQ ID NO: 2026) |  |
| βc-m1218 Target: | 5'-GCTTCTCATAAGTGTAGGTCCTCATTA-3' | (SEQ ID NO: 3135) |  |
|  | 5'-GCUUCUCAUAAGUGUAGGUCCUCat-3' | (SEQ ID NO: 918) |  |
|  | 3'-<u>UUC</u>GAAGAGUAUUCACAUCCAGGAGUA-5' | (SEQ ID NO: 2027) |  |
| βc-m1220 Target: | 5'-AAGCTTCTCATAAGTGTAGGTCCTC-3' | (SEQ ID NO: 3136) |  |
|  | 5'-AGCUUCUCAUAAGUGUAGGUCCUca-3' | (SEQ ID NO: 919) |  |
|  | 3'-<u>CUU</u>CGAAGAGUAUUCACAUCCAGGAGU-5' | (SEQ ID NO: 2028) |  |
| βc-m1221 Target: | 5'-GAAGCTTCTCATAAGTGTAGGTCCTCA-3' | (SEQ ID NO: 3137) |  |
|  | 5'-GUCCAAAGACAGUUUUGAACAAGtc-3' | (SEQ ID NO: 920) |  |
|  | 3'-<u>CUC</u>AGGUUUCUGUCAAAACUUGUUCAG-5' | (SEQ ID NO: 2029) |  |
| βc-m1365 Target: | 5'-GAGTCCAAAGACAGTTTTGAACAAGTC-3' | (SEQ ID NO: 3138) |  |
|  | 5'-AGUCCAAAGACAGUUUUGAACAAgt-3' | (SEQ ID NO: 921) |  |
|  | 3'-<u>UCU</u>CAGGUUUCUGUCAAAACUUGUUCA-5' | (SEQ ID NO: 2030) |  |
| βc-m1366 Target: | 5'-AGAGTCCAAAGACAGTTTTGAACAAGT-3' | (SEQ ID NO: 3139) |  |
|  | 5'-ACAUUUAUAUCAUCGGAACCCAGaa-3' | (SEQ ID NO: 922) |  |
|  | 3'-<u>GGU</u>GUAAAUAUAGUAGCCUUGGGUCUU-5' | (SEQ ID NO: 2031) |  |
| βc-m1461 Target: | 5'-CCACATTTATATCATCGGAACCCAGAA-3' | (SEQ ID NO: 3140) |  |
|  | 5'-ACCACAUUUAUAUCAUCGGAACCca-3' | (SEQ ID NO: 923) |  |
|  | 3'-<u>ACU</u>GGUGUAAAUAUAGUAGCCUUGGGU-5' | (SEQ ID NO: 2032) |  |
| βc-m1464 Target: | 5'-TGACCACATTTATATCATCGGAACCCA-3' | (SEQ ID NO: 3141) |  |
|  | 5'-GCACAGGUGACCACAUUUAUAUCat-3' | (SEQ ID NO: 924) |  |
|  | 3'-<u>GAC</u>GUGUCCACUGGUGUAAAUAUAGUA-5' | (SEQ ID NO: 2033) |  |
| βc-m1473 Target: | 5'-CTGCACAGGTGACCACATTTATATC-3' | (SEQ ID NO: 3142) |  |
|  | 5'-UGCACAGGUGACCACAUUUAUAUca-3' | (SEQ ID NO: 925) |  |
|  | 3'-<u>CGA</u>CGUGUCCACUGGUGUAAAUAUAGU-5' | (SEQ ID NO: 2034) |  |
| βc-m1474 Target: | 5'-GCTGCACAGGTGACCACATTTATATCA-3' | (SEQ ID NO: 3143) |  |
|  | 5'-GUAAUUAUUGCAAGUGAGGUUAGag-3' | (SEQ ID NO: 926) |  |
|  | 3'-<u>AAC</u>AUUAAUAACGUUCACUCCAAUCUC-5' | (SEQ ID NO: 2035) |  |
| βc-m1510 Target: | 5'-TTGTAATTATTGCAAGTGAGGTTAGAG-3' | (SEQ ID NO: 3144) |  |
|  | 5'-UCAUCUUGUUUUGUAAUUAUUGca-3' | (SEQ ID NO: 927) |  |
|  | 3'-<u>GUA</u>GUAGAACAAAAACAUUAAUAACGU-5' | (SEQ ID NO: 2036) |  |
| βc-m1523 Target: | 5'-CATCATCTTGTTTTGTAATTATTGCA-3' | (SEQ ID NO: 3145) |  |
|  | 5'-AUCAUCUUGUUUUUGUAAUUAUUgc-3' | (SEQ ID NO: 928) |  |
|  | 3'-<u>GGU</u>AGUAGAACAAAAACAUUAAUAACG-5' | (SEQ ID NO: 2037) |  |
| βc-m1524 Target: | 5'-CCATCATCTTGTTTTGTAATTATTGC-3' | (SEQ ID NO: 3146) |  |
|  | 5'-ACCAUCAUCUUGUUUUUGUAAUUat-3' | (SEQ ID NO: 929) |  |
|  | 3'-<u>UGU</u>GGUAGUAGAACAAAAACAUUAAUA-5' | (SEQ ID NO: 2038) |  |
| βc-m1527 Target: | 5'-ACACCATCATCTTGTTTTGTAATTAT-3' | (SEQ ID NO: 3147) |  |

TABLE 9-continued

Additional Selected Anti-β-catenin DsiRNAs, 25/27mer Duplexes

|  |  |  |  |
|---|---|---|---|
|  | 5'-GGCACACCAUCAUCUUGUUUUUGta-3' | (SEQ ID NO: 930) |
|  | 3'-AACCGUGUGGUAGUAGAACAAAAACAU-5' | (SEQ ID NO: 2039) |
| βc-m1532 Target: | 5'-TTGGCACACCATCATCTTGTTTTGTA-3' | (SEQ ID NO: 3148) |
|  | 5'-AAUCCAACAGUUGCCUUUAUCAGag-3' | (SEQ ID NO: 931) |
|  | 3'-AGUUAGGUUGUCAACGGAAAUAGUCUC-5' | (SEQ ID NO: 2040) |
| βc-m1752 Target: | 5'-TCAATCCAACAGTTGCCTTTATCAGAG-3' | (SEQ ID NO: 3149) |
|  | 5'-GAAUCAAUCCAACAGUUGCCUUUat-3' | (SEQ ID NO: 932) |
|  | 3'-AGCUUAGUUAGGUUGUCAACGGAAAUA-5' | (SEQ ID NO: 2041) |
| βc-m1757 Target: | 5'-TCGAATCAATCCAACAGTTGCCTTTAT-3' | (SEQ ID NO: 3150) |
|  | 5'-UGAACUAGUCGUGGAAUAGCACCct-3' | (SEQ ID NO: 933) |
|  | 3'-CGACUUGAUCAGCACCUUAUCGUGGGA-5' | (SEQ ID NO: 2042) |
| βc-m1827 Target: | 5'-GCTGAACTAGTCGTGGAATAGCACCCT-3' | (SEQ ID NO: 3151) |
|  | 5'-UACACCCUUCUACUAUCUCCUCCat-3' | (SEQ ID NO: 934) |
|  | 3'-UCAUGUGGGAAGAUGAUAGAGGAGGUA-5' | (SEQ ID NO: 2043) |
| βc-m1934 Target: | 5'-AGTACACCCTTCTACTATCTCCTCC-3' | (SEQ ID NO: 3152) |
|  | 5'-GUACACCCUUCUACUAUCUCCUCca-3' | (SEQ ID NO: 935) |
|  | 3'-GUCAUGUGGGAAGAUGAUAGAGGAGGU-5' | (SEQ ID NO: 2044) |
| βc-m1935 Target: | 5'-CAGTACACCCTTCTACTATCTCCTCCA-3' | (SEQ ID NO: 3153) |
|  | 5'-AGUACACCCUUCUACUAUCUCCUcc-3' | (SEQ ID NO: 936) |
|  | 3'-GGUCAUGUGGGAAGAUGAUAGAGGAGG-5' | (SEQ ID NO: 2045) |
| βc-m1936 Target: | 5'-CCAGTACACCCTTCTACTATCTCCTCC-3' | (SEQ ID NO: 3154) |
|  | 5'-GCUCCAGUACACCCUUCUACUAUct-3' | (SEQ ID NO: 937) |
|  | 3'-CUCGAGGUCAUGUGGGAAGAUGAUAGA-5' | (SEQ ID NO: 2046) |
| βc-m1941 Target: | 5'-GAGCTCCAGTACACCCTTCTACTATCT-3' | (SEQ ID NO: 3155) |
|  | 5'-ACAAUGGAAUGGUAUUGAGUCCUcg-3' | (SEQ ID NO: 938) |
|  | 3'-UUUGUUACCUUACCAUAACUCAGGAGC-5' | (SEQ ID NO: 2047) |
| βc-m2009 Target: | 5'-AAACAATGGAATGGTATTGAGTCCTCG-3' | (SEQ ID NO: 3156) |
|  | 5'-GCACAAACAAUGGAAUGGUAUUGag-3' | (SEQ ID NO: 939) |
|  | 3'-GACGUGUUUGUUACCUUACCAUAACUC-5' | (SEQ ID NO: 2048) |
| βc-m2015 Target: | 5'-CTGCACAAACAATGGAATGGTATTGAG-3' | (SEQ ID NO: 3157) |
|  | 5'-UGCACAAACAAUGGAAUGGUAUUga-3' | (SEQ ID NO: 940) |
|  | 3'-UGACGUGUUUGUUACCUUACCAUAACU-5' | (SEQ ID NO: 2049) |
| βc-m2016 Target: | 5'-ACTGCACAAACAATGGAATGGTATTGA-3' | (SEQ ID NO: 3158) |
|  | 5'-GCAACUGCACAAACAAUGGAAUGgt-3' | (SEQ ID NO: 941) |
|  | 3'-UUCGUUGACGUGUUUGUUACCUUACCA-5' | (SEQ ID NO: 2050) |
| βc-m2021 Target: | 5'-AAGCAACTGCACAAACAATGGAATGGT-3' | (SEQ ID NO: 3159) |
|  | 5'-GAAUAAAGCAACUGCACAAACAAtg-3' | (SEQ ID NO: 942) |
|  | 3'-CUCUUAUUUCGUUGACGUGUUUGUUAC-5' | (SEQ ID NO: 2051) |
| βc-m2028 Target: | 5'-GAGAATAAAGCAACTGCACAAACAATG-3' | (SEQ ID NO: 3160) |

TABLE 9-continued

Additional Selected Anti-β-catenin DsiRNAs, 25/27mer Duplexes

|  |  |  |  |
|---|---|---|---|
|  | 5'-UCAAUGGGAGAAUAAAGCAACUGca-3' | (SEQ ID NO: 943) |  |
|  | 3'-AAAGUUACCCUCUUAUUUCGUUGACGU-5' | (SEQ ID NO: 2052) |  |
| βc-m2037 Target: | 5'-TTTCAATGGGAGAATAAAGCAACTGCA-3' | (SEQ ID NO: 3161) |  |
|  | 5'-UUCAAUGGGAGAAUAAAGCAACUgc-3' | (SEQ ID NO: 944) |  |
|  | 3'-AAAAGUUACCCUCUUAUUUCGUUGACG-5' | (SEQ ID NO: 2053) |  |
| βc-m2038 Target: | 5'-TTTTCAATGGGAGAATAAAGCAACTGC-3' | (SEQ ID NO: 3162) |  |
|  | 5'-UUUCAAUGGGAGAAUAAAGCAACtg-3' | (SEQ ID NO: 945) |  |
|  | 3'-UAAAAGUUACCCUCUUAUUUCGUUGAC-5' | (SEQ ID NO: 2054) |  |
| βc-m2039 Target: | 5'-ATTTTCAATGGGAGAATAAAGCAACTG-3' | (SEQ ID NO: 3163) |  |
|  | 5'-AUAUUUUCAAUGGGAGAAUAAAGca-3' | (SEQ ID NO: 946) |  |
|  | 3'-CCUAUAAAAGUUACCCUCUUAUUUCGU-5' | (SEQ ID NO: 2055) |  |
| βc-m2043 Target: | 5'-GGATATTTTCAATGGGAGAATAAAGCA-3' | (SEQ ID NO: 3164) |  |
|  | 5'-GAUAUUUUCAAUGGGAGAAUAAAgc-3' | (SEQ ID NO: 947) |  |
|  | 3'-ACCUAUAAAAGUUACCCUCUUAUUUCG-5' | (SEQ ID NO: 2056) |  |
| βc-m2044 Target: | 5'-TGGATATTTTCAATGGGAGAATAAAGC-3' | (SEQ ID NO: 3165) |  |
|  | 5'-GGAUAUUUUCAAUGGGAGAAUAAag-3' | (SEQ ID NO: 948) |  |
|  | 3'-AACCUAUAAAAGUUACCCUCUUAUUUC-5' | (SEQ ID NO: 2057) |  |
| βc-m2045 Target: | 5'-TTGGATATTTTCAATGGGAGAATAAAG-3' | (SEQ ID NO: 3166) |  |
|  | 5'-GCUACUCUUUGGAUAUUUUCAAUgg-3' | (SEQ ID NO: 949) |  |
|  | 3'-GUCGAUGAGAAACCUAUAAAAGUUACC-5' | (SEQ ID NO: 2058) |  |
| βc-m2055 Target: | 5'-CAGCTACTCTTTGGATATTTTCAATGG-3' | (SEQ ID NO: 3167) |  |
|  | 5'-AGCUACUCUUUGGAUAUUUUCAAtg-3' | (SEQ ID NO: 950) |  |
|  | 3'-CGUCGAUGAGAAACCUAUAAAAGUUAC-5' | (SEQ ID NO: 2059) |  |
| βc-m2056 Target: | 5'-GCAGCTACTCTTTGGATATTTTCAATG-3' | (SEQ ID NO: 3168) |  |
|  | 5'-GCUUCUUGUAAUCCUGUGGCUUGtc-3' | (SEQ ID NO: 951) |  |
|  | 3'-GGCGAAGAACAUUAGGACACCGAACAG-5' | (SEQ ID NO: 2060) |  |
| βc-m2231 Target: | 5'-CCGCTTCTTGTAATCCTGTGGCTTGTC-3' | (SEQ ID NO: 3169) |  |
|  | 5'-AGUCCAAGAUCUGCAGUCUCAUUcc-3' | (SEQ ID NO: 952) |  |
|  | 3'-GGUCAGGUUCUAGACGUCAGAGUAAGG-5' | (SEQ ID NO: 2061) |  |
| βc-m2307 Target: | 5'-CCAGTCCAAGATCTGCAGTCTCATTCC-3' | (SEQ ID NO: 3170) |  |
|  | 5'-UAUCCACCAGAGUGAAAAGAACGgt-3' | (SEQ ID NO: 953) |  |
|  | 3'-GCAUAGGUGGUCUCACUUUUCUUGCCA-5' | (SEQ ID NO: 2062) |  |
| βc-m2385 Target: | 5'-CGTATCCACCAGAGTGAAAAGAACGGT-3' | (SEQ ID NO: 3171) |  |
|  | 5'-GGCCAGCUGAUUGCUAUCACCUGgg-3' | (SEQ ID NO: 954) |  |
|  | 3'-GUCCGGUCGACUAACGAUAGUGGACCC-5' | (SEQ ID NO: 2063) |  |
| βc-m2539 Target: | 5'-CAGGCCAGCTGATTGCTATCACCTGGG-3' | (SEQ ID NO: 3172) |  |
|  | 5'-AUUUACAGGUCAGUAUCAAACCAgg-3' | (SEQ ID NO: 955) |  |
|  | 3'-GCUAAAUGUCCAGUCAUAGUUUGGUCC-5' | (SEQ ID NO: 2064) |  |
| βc-m2562 Target: | 5'-CGATTTACAGGTCAGTATCAAACCAGG-3' | (SEQ ID NO: 3173) |  |

TABLE 9-continued

Additional Selected Anti-β-catenin DsiRNAs, 25/27mer Duplexes

|  |  |  |  |
|---|---|---|---|
|  | 5'-GAUUUACAGGUCAGUAUCAAACCag-3' | (SEQ ID NO: 956) |  |
|  | 3'-UGCUAAAUGUCCAGUCAUAGUUUGGUC-5' | (SEQ ID NO: 2065) |  |
| βc-m2563 Target: | 5'-ACGATTTACAGGTCAGTATCAAACCAG-3' | (SEQ ID NO: 3174) |  |
|  | 5'-UCUUACCUAAAGGACGAUUUACAgg-3' | (SEQ ID NO: 957) |  |
|  | 3'-AAAGAAUGGAUUUCCUGCUAAAUGUCC-5' | (SEQ ID NO: 2066) |  |
| βc-m2578 Target: | 5'-TTTCTTACCTAAAGGACGATTTACAGG-3' | (SEQ ID NO: 3175) |  |
|  | 5'-UUUCUUACCUAAAGGACGAUUUAca-3' | (SEQ ID NO: 958) |  |
|  | 3'-CGAAAGAAUGGAUUUCCUGCUAAAUGU-5' | (SEQ ID NO: 2067) |  |
| βc-m2580 Target: | 5'-GCTTTCTTACCTAAAGGACGATTTACA-3' | (SEQ ID NO: 3176) |  |
|  | 5'-UUUAUAAGCUUUCUUACCUAAAGga-3' | (SEQ ID NO: 959) |  |
|  | 3'-GAAAAUAUUCGAAAGAAUGGAUUUCCU-5' | (SEQ ID NO: 2068) |  |
| βc-m2589 Target: | 5'-CTTTTATAAGCTTTCTTACCTAAAGGA-3' | (SEQ ID NO: 3177) |  |
|  | 5'-UUUUAUAAGCUUUCUUACCUAAAgg-3' | (SEQ ID NO: 960) |  |
|  | 3'-CGAAAAUAUUCGAAAGAAUGGAUUUCC-5' | (SEQ ID NO: 2069) |  |
| βc-m2590 Target: | 5'-GCTTTTATAAGCTTTCTTACCTAAAGG-3' | (SEQ ID NO: 3178) |  |
|  | 5'-GGCUUUUAUAAGCUUUCUUACCUaa-3' | (SEQ ID NO: 961) |  |
|  | 3'-GACCGAAAAUAUUCGAAAGAAUGGAUU-5' | (SEQ ID NO: 2070) |  |
| βc-m2593 Target: | 5'-CTGGCTTTTATAAGCTTTCTTACCTAA-3' | (SEQ ID NO: 3179) |  |
|  | 5'-ACACUGGCUUUUAUAAGCUUUCUta-3' | (SEQ ID NO: 962) |  |
|  | 3'-GGUGUGACCGAAAAUAUUCGAAAGAAU-5' | (SEQ ID NO: 2071) |  |
| βc-m2598 Target: | 5'-CCACACTGGCTTTTATAAGCTTTCTTA-3' | (SEQ ID NO: 3180) |  |
|  | 5'-UCACCCACACUGGCUUUUAUAAGct-3' | (SEQ ID NO: 963) |  |
|  | 3'-UAAGUGGGUGUGACCGAAAAUAUUCGA-5' | (SEQ ID NO: 2072) |  |
| βc-m2604 Target: | 5'-ATTCACCCACACTGGCTTTTATAAGCT-3' | (SEQ ID NO: 3181) |  |
|  | 5'-UACCAAGUCUUUCUGGAGUUCUGca-3' | (SEQ ID NO: 964) |  |
|  | 3'-GGAUGGUUCAGAAAGACCUCAAGACGU-5' | (SEQ ID NO: 2073) |  |
| βc-m2644 Target: | 5'-CCTACCAAGTCTTTCTGGAGTTCTGCA-3' | (SEQ ID NO: 3182) |  |
|  | 5'-UUACAAACAGGCCUAAAACCAUUcc-3' | (SEQ ID NO: 965) |  |
|  | 3'-UAAAUGUUUGUCCGGAUUUUGGUAAGG-5' | (SEQ ID NO: 2074) |  |
| βc-m2674 Target: | 5'-ATTTACAAACAGGCCTAAAACCATTCC-3' | (SEQ ID NO: 3183) |  |
|  | 5'-UUUACAAACAGGCCUAAAACCAUtc-3' | (SEQ ID NO: 966) |  |
|  | 3'-CUAAAUGUUUGUCCGGAUUUUGGUAAG-5' | (SEQ ID NO: 2075) |  |
| βc-m2675 Target: | 5'-GATTTACAAACAGGCCTAAAACCATTC-3' | (SEQ ID NO: 3184) |  |
|  | 5'-AUUUACAAACAGGCCUAAAACCAtt-3' | (SEQ ID NO: 967) |  |
|  | 3'-UCUAAAUGUUUGUCCGGAUUUUGGUAA-5' | (SEQ ID NO: 2076) |  |
| βc-m2676 Target: | 5'-AGATTTACAAACAGGCCTAAAACCATT-3' | (SEQ ID NO: 3185) |  |
|  | 5'-UCUCCUUCCAAGGUAUGUAUCUGtt-3' | (SEQ ID NO: 968) |  |
|  | 3'-GUAGAGGAAGGUUCCAUACAUAGACAA-5' | (SEQ ID NO: 2077) |  |
| βc-m2710 Target: | 5'-CATCTCCTTCCAAGGTATGTATCTGTT-3' | (SEQ ID NO: 3186) |  |

TABLE 9-continued

Additional Selected Anti-β-catenin DsiRNAs, 25/27mer Duplexes

|  |  |  |
|---|---|---|
|  | 5'-AUCUCCUUCCAAGGUAUGUAUCUgt-3' | (SEQ ID NO: 969) |
|  | 3'-UGUAGAGGAAGGUUCCAUACAUAGACA-5' | (SEQ ID NO: 2078) |
| βc-m2711 Target: | 5'-ACATCTCCTTCCAAGGTATGTATCTGT-3' | (SEQ ID NO: 3187) |
|  | 5'-UUCCACACAUGAACAUCUCCUUCca-3' | (SEQ ID NO: 970) |
|  | 3'-UGAAGGUGUGUACUUGUAGAGGAAGGU-5' | (SEQ ID NO: 2079) |
| βc-m2725 Target: | 5'-ACTTCCACACATGAACATCTCCTTCCA-3' | (SEQ ID NO: 3188) |
|  | 5'-AACUUCCACACAUGAACAUCUCCtt-3' | (SEQ ID NO: 971) |
|  | 3'-CUUUGAAGGUGUGUACUUGUAGAGGAA-5' | (SEQ ID NO: 2080) |
| βc-m2728 Target: | 5'-GAAACTTCCACACATGAACATCTCCTT-3' | (SEQ ID NO: 3189) |
|  | 5'-AAACUUCCACACAUGAACAUCUCct-3' | (SEQ ID NO: 972) |
|  | 3'-UCUUUGAAGGUGUGUACUUGUAGAGGA-5' | (SEQ ID NO: 2081) |
| βc-m2729 Target: | 5'-AGAAACTTCCACACATGAACATCTCCT-3' | (SEQ ID NO: 3190) |
|  | 5'-GAAACUUCCACACAUGAACAUCUcc-3' | (SEQ ID NO: 973) |
|  | 3'-CUCUUUGAAGGUGUGUACUUGUAGAGG-5' | (SEQ ID NO: 2082) |
| βc-m2730 Target: | 5'-GAGAAACTTCCACACATGAACATCTCC-3' | (SEQ ID NO: 3191) |
|  | 5'-AGAAACUUCCACACAUGAACAUCtc-3' | (SEQ ID NO: 974) |
|  | 3'-ACUCUUUGAAGGUGUGUACUUGUAGAG-5' | (SEQ ID NO: 2083) |
| βc-m2731 Target: | 5'-TGAGAAACTTCCACACATGAACATCTC-3' | (SEQ ID NO: 3192) |
|  | 5'-UCAACGUGAGAAACUUCCACACAtg-3' | (SEQ ID NO: 975) |
|  | 3'-GUAGUUGCACUCUUUGAAGGUGUGUAC-5' | (SEQ ID NO: 2084) |
| βc-m2739 Target: | 5'-CATCAACGTGAGAAACTTCCACACATG-3' | (SEQ ID NO: 3193) |
|  | 5'-ACAUCAACGUGAGAAACUUCCACac-3' | (SEQ ID NO: 976) |
|  | 3'-UUUGUAGUUGCACUCUUUGAAGGUGUG-5' | (SEQ ID NO: 2085) |
| βc-m2742 Target: | 5'-AAACATCAACGTGAGAAACTTCCACAC-3' | (SEQ ID NO: 3194) |
|  | 5'-AACAUCAACGUGAGAAACUUCCAca-3' | (SEQ ID NO: 977) |
|  | 3'-UUUUGUAGUUGCACUCUUUGAAGGUGU-5' | (SEQ ID NO: 2086) |
| βc-m2743 Target: | 5'-AAAACATCAACGTGAGAAACTTCCACA-3' | (SEQ ID NO: 3195) |
|  | 5'-AAACAUCAACGUGAGAAACUUCCac-3' | (SEQ ID NO: 978) |
|  | 3'-UUUUUGUAGUUGCACUCUUUGAAGGUG-5' | (SEQ ID NO: 2087) |
| βc-m2744 Target: | 5'-AAAACATCAACGTGAGAAACTTCCAC-3' | (SEQ ID NO: 3196) |
|  | 5'-AAAACAUCAACGUGAGAAACUUCca-3' | (SEQ ID NO: 979) |
|  | 3'-GUUUUUGUAGUUGCACUCUUUGAAGGU-5' | (SEQ ID NO: 2088) |
| βc-m2745 Target: | 5'-CAAAAACATCAACGTGAGAAACTTCCA-3' | (SEQ ID NO: 3197) |
|  | 5'-AAAAACAUCAACGUGAGAAACUUcc-3' | (SEQ ID NO: 980) |
|  | 3'-CGUUUUUGUAGUUGCACUCUUUGAAGG-5' | (SEQ ID NO: 2089) |
| βc-m2746 Target: | 5'-GCAAAAACATCAACGTGAGAAACTTCC-3' | (SEQ ID NO: 3198) |
|  | 5'-GCAAAAACAUCAACGUGAGAAACtt-3' | (SEQ ID NO: 981) |
|  | 3'-ACCGUUUUUGUAGUUGCACUCUUUGAA-5' | (SEQ ID NO: 2090) |
| βc-m2748 Target: | 5'-TGGCAAAAACATCAACGTGAGAAACTT-3' | (SEQ ID NO: 3199) |

TABLE 9-continued

Additional Selected Anti-β-catenin DsiRNAs, 25/27mer Duplexes

|  |  |  |  |
|---|---|---|---|
|  | 5'-GCAAAAGCUGUGGCAAAAACAUCaa-3' | (SEQ ID NO: 982) |  |
|  | 3'-GACGUUUUCGACACCGUUUUUGUAGUU-5' | (SEQ ID NO: 2091) |  |
| βc-m2760 Target: | 5'-CTGCAAAAGCTGTGGCAAAAACATCAA-3' | (SEQ ID NO: 3200) |  |
|  | 5'-UGCAAAAGCUGUGGCAAAAACAUca-3' | (SEQ ID NO: 983) |  |
|  | 3'-CGACGUUUUCGACACCGUUUUUGUAGU-5' | (SEQ ID NO: 2092) |  |
| βc-m2761 Target: | 5'-GCTGCAAAAGCTGTGGCAAAAACATCA-3' | (SEQ ID NO: 3201) |  |
|  | 5'-UCAUCUGAGUAUAACGCUGCAAAag-3' | (SEQ ID NO: 984) |  |
|  | 3'-UGAGUAGACUCAUAUUGCGACGUUUUC-5' | (SEQ ID NO: 2093) |  |
| βc-m2778 Target: | 5'-ACTCATCTGAGTATAACGCTGCAAAAG-3' | (SEQ ID NO: 3202) |  |
|  | 5'-AAAACAGCAAAUGUUACUCAUCUga-3' | (SEQ ID NO: 985) |  |
|  | 3'-ACUUUUGUCGUUUACAAUGAGUAGACU-5' | (SEQ ID NO: 2094) |  |
| βc-m2795 Target: | 5'-TGAAAACAGCAAATGTTACTCATCTGA-3' | (SEQ ID NO: 3203) |  |
|  | 5'-GAAAACAGCAAAUGUUACUCAUCtg-3' | (SEQ ID NO: 986) |  |
|  | 3'-AACUUUUGUCGUUUACAAUGAGUAGAC-5' | (SEQ ID NO: 2095) |  |
| βc-m2796 Target: | 5'-TTGAAAACAGCAAATGTTACTCATCTG-3' | (SEQ ID NO: 3204) |  |
|  | 5'-UGAAAACAGCAAAUGUUACUCAUct-3' | (SEQ ID NO: 987) |  |
|  | 3'-CAACUUUUGUCGUUUACAAUGAGUAGA-5' | (SEQ ID NO: 2096) |  |
| βc-m2797 Target: | 5'-GTTGAAAACAGCAAATGTTACTCATCT-3' | (SEQ ID NO: 3205) |  |
|  | 5'-AUUAAUGUUGAAAACAGCAAAUGtt-3' | (SEQ ID NO: 988) |  |
|  | 3'-GAUAAUUACAACUUUUGUCGUUUACAA-5' | (SEQ ID NO: 2097) |  |
| βc-m2805 Target: | 5'-CTATTAATGTTGAAAACAGCAAATGTT-3' | (SEQ ID NO: 3206) |  |
|  | 5'-ACUACAGCUGUAUAGAGAGAAAGgc-3' | (SEQ ID NO: 989) |  |
|  | 3'-UGUGAUGUCGACAUAUCUCUCUUUCCG-5' | (SEQ ID NO: 2098) |  |
| βc-m2834 Target: | 5'-ACACTACAGCTGTATAGAGAGAAAGGC-3' | (SEQ ID NO: 3207) |  |
|  | 5'-GGCCAAUCACAAUGCACGUUCAGac-3' | (SEQ ID NO: 990) |  |
|  | 3'-GUCCGGUUAGUGUUACGUGCAAGUCUG-5' | (SEQ ID NO: 2099) |  |
| βc-m2859 Target: | 5'-CAGGCCAATCACAATGCACGTTCAGAC-3' | (SEQ ID NO: 3208) |  |
|  | 5'-GUUCCCAUAGGAAACUCAGCUUGgt-3' | (SEQ ID NO: 991) |  |
|  | 3'-GACAAGGGUAUCCUUUGAGUCGAACCA-5' | (SEQ ID NO: 2100) |  |
| βc-m2946 Target: | 5'-CTGTTCCCATAGGAAACTCAGCTTGGT-3' | (SEQ ID NO: 3209) |  |
|  | 5'-GAACAAAAAGCGUACUUCGACUGtt-3' | (SEQ ID NO: 992) |  |
|  | 3'-GUCUUGUUUUCGCAUGAAGCUGACAA-5' | (SEQ ID NO: 2101) |  |
| βc-m2968 Target: | 5'-CAGAACAAAAAGCGTACTTCGACTGTT-3' | (SEQ ID NO: 3210) |  |
|  | 5'-GGACCAGAACAAAAAGCGUACUUcg-3' | (SEQ ID NO: 993) |  |
|  | 3'-UUCCUGGUCUUGUUUUUCGCAUGAAGC-5' | (SEQ ID NO: 2102) |  |
| βc-m2974 Target: | 5'-AAGGACCAGAACAAAAAGCGTACTTCG-3' | (SEQ ID NO: 3211) |  |
|  | 5'-ACCAAAAAGGACCAGAACAAAAAgc-3' | (SEQ ID NO: 994) |  |
|  | 3'-GCUGGUUUUUCCUGGUCUUGUUUUUCG-5' | (SEQ ID NO: 2103) |  |
| βc-m2982 Target: | 5'-CGACCAAAAAGGACCAGAACAAAAAGC-3' | (SEQ ID NO: 3212) |  |

TABLE 9-continued

Additional Selected Anti-β-catenin DsiRNAs, 25/27mer Duplexes

|  |  |  |  |
|---|---|---|---|
|  | 5'-GACCAAAAAGGACCAGAACAAAAag-3' | (SEQ ID NO: 995) |  |
|  | 3'-AGCUGGUUUUUCCUGGUCUUGUUUUUC-5' | (SEQ ID NO: 2104) |  |
| βc-m2983 Target: | 5'-TCGACCAAAAAGGACCAGAACAAAAAG-3' | (SEQ ID NO: 3213) |  |
|  | 5'-ACUCCUCGACCAAAAAGGACCAGaa-3' | (SEQ ID NO: 996) |  |
|  | 3'-AAUGAGGAGCUGGUUUUUCCUGGUCUU-5' | (SEQ ID NO: 2105) |  |
| βc-m2990 Target: | 5'-TTACTCCTCGACCAAAAAGGACCAGAA-3' | (SEQ ID NO: 3214) |  |
|  | 5'-UCCAUUUGUAUUGUUACUCCUCGac-3' | (SEQ ID NO: 997) |  |
|  | 3'-UUAGGUAAACAUAACAAUGAGGAGCUG-5' | (SEQ ID NO: 2106) |  |
| βc-m3005 Target: | 5'-AATCCATTTGTATTGTTACTCCTCGAC-3' | (SEQ ID NO: 3215) |  |
|  | 5'-AUCCAUUUGUAUUGUUACUCCUCga-3' | (SEQ ID NO: 998) |  |
|  | 3'-UUUAGGUAAACAUAACAAUGAGGAGCU-5' | (SEQ ID NO: 2107) |  |
| βc-m3006 Target: | 5'-AAATCCATTTGTATTGTTACTCCTCGA-3' | (SEQ ID NO: 3216) |  |
|  | 5'-AAUCCAUUUGUAUUGUUACUCCUcg-3' | (SEQ ID NO: 999) |  |
|  | 3'-GUUUAGGUAAACAUAACAAUGAGGAGC-5' | (SEQ ID NO: 2108) |  |
| βc-m3007 Target: | 5'-CAAATCCATTTGTATTGTTACTCCTCG-3' | (SEQ ID NO: 3217) |  |
|  | 5'-AAAUCCAUUUGUAUUGUUACUCCtc-3' | (SEQ ID NO: 1000) |  |
|  | 3'-GGUUUAGGUAAACAUAACAAUGAGGAG-5' | (SEQ ID NO: 2109) |  |
| βc-m3008 Target: | 5'-CCAAATCCATTTGTATTGTTACTCCTC-3' | (SEQ ID NO: 3218) |  |
|  | 5'-ACUCCCCAAAUCCAUUUGUAUUGtt-3' | (SEQ ID NO: 1001) |  |
|  | 3'-AGUGAGGGGUUUAGGUAAACAUAACAA-5' | (SEQ ID NO: 2110) |  |
| βc-m3015 Target: | 5'-TCACTCCCCAAATCCATTTGTATTGTT-3' | (SEQ ID NO: 3219) |  |
|  | 5'-UCCAUUCGUGUGCAUUCUUCACUgc-3' | (SEQ ID NO: 1002) |  |
|  | 3'-CUAGGUAAGCACACGUAAGAAGUGACG-5' | (SEQ ID NO: 2111) |  |
| βc-m3047 Target: | 5'-GATCCATTCGTGTGCATTCTTCACTGC-3' | (SEQ ID NO: 3220) |  |
|  | 5'-AUCCAUUCGUGUGCAUUCUUCACtg-3' | (SEQ ID NO: 1003) |  |
|  | 3'-ACUAGGUAAGCACACGUAAGAAGUGAC-5' | (SEQ ID NO: 2112) |  |
| βc-m3048 Target: | 5'-TGATCCATTCGTGTGCATTCTTCACTG-3' | (SEQ ID NO: 3221) |  |
|  | 5'-GAUCCAUUCGUGUGCAUUCUUCAct-3' | (SEQ ID NO: 1004) |  |
|  | 3'-CACUAGGUAAGCACACGUAAGAAGUGA-5' | (SEQ ID NO: 2113) |  |
| βc-m3049 Target: | 5'-GTGATCCATTCGTGTGCATTCTTCACT-3' | (SEQ ID NO: 3222) |  |
|  | 5'-AAACAAAGAACAAGCAAGGCUAGgg-3' | (SEQ ID NO: 1005) |  |
|  | 3'-AUUUUGUUUCUUGUUCGUUCCGAUCCC-5' | (SEQ ID NO: 2114) |  |
| βc-m3093 Target: | 5'-TAAAACAAAGAACAAGCAAGGCTAGGG-3' | (SEQ ID NO: 3223) |  |
|  | 5'-ACCACUACAGAUAUUAAAACAAAga-3' | (SEQ ID NO: 1006) |  |
|  | 3'-CGUGGUGAUGUCUAUAAUUUUGUUUCU-5' | (SEQ ID NO: 2115) |  |
| βc-m3109 Target: | 5'-GCACCACTACAGATATTAAAACAAAGA-3' | (SEQ ID NO: 3224) |  |
|  | 5'-GCACCACUACAGAUAUUAAAACAaa-3' | (SEQ ID NO: 1007) |  |
|  | 3'-GUCGUGGUGAUGUCUAUAAUUUUGUUU-5' | (SEQ ID NO: 2116) |  |
| βc-m3111 Target: | 5'-CAGCACCACTACAGATATTAAAACAAA-3' | (SEQ ID NO: 3225) |  |

TABLE 9-continued

Additional Selected Anti-β-catenin DsiRNAs, 25/27mer Duplexes

|  |  |  |  |
|---|---|---|---|
|  | 5'-AGCACCACUACAGAUAUUAAAACaa-3' | (SEQ ID NO: 1008) |  |
|  | 3'-<u>AGU</u>CGUGGUGAUGUCUAUAAUUUUGUU-5' | (SEQ ID NO: 2117) |  |
| βc-m3112 Target: | 5'-TCAGCACCACTACAGATATTAAAACAA-3' | (SEQ ID NO: 3226) |  |
|  | 5'-AAAAUAAAAGCAAGCAAAGUCAGca-3' | (SEQ ID NO: 1009) |  |
|  | 3'-<u>UUU</u>UUUAUUUUCGUUCGUUUCAGUCGU-5' | (SEQ ID NO: 2118) |  |
| βc-m3133 Target: | 5'-AAAAAATAAAAGCAAGCAAAGTCAGCA-3' | (SEQ ID NO: 3227) |  |
|  | 5'-GCAAAAAAUAAAAGCAAGCAAAGtc-3' | (SEQ ID NO: 1010) |  |
|  | 3'-<u>GAC</u>GUUUUUUAUUUUCGUUCGUUUCAG-5' | (SEQ ID NO: 2119) |  |
| βc-m3137 Target: | 5'-CTGCAAAAAATAAAGCAAGCAAAGTC-3' | (SEQ ID NO: 3228) |  |
|  | 5'-UUACUGCAAAAAAUAAAAGCAAGca-3' | (SEQ ID NO: 1011) |  |
|  | 3'-<u>UCA</u>AUGACGUUUUUUAUUUUCGUUCGU-5' | (SEQ ID NO: 2120) |  |
| βc-m3142 Target: | 5'-AGTTACTGCAAAAAATAAAGCAAGCA-3' | (SEQ ID NO: 3229) |  |
|  | 5'-UAACAGUUACUGCAAAAAAUAAAag-3' | (SEQ ID NO: 1012) |  |
|  | 3'-<u>UGA</u>UUGUCAAUGACGUUUUUUAUUUUC-5' | (SEQ ID NO: 2121) |  |
| βc-m3148 Target: | 5'-ACTAACAGTTACTGCAAAAAATAAAG-3' | (SEQ ID NO: 3230) |  |
|  | 5'-ACUAACAGUUACUGCAAAAAAUAaa-3' | (SEQ ID NO: 1013) |  |
|  | 3'-<u>UUU</u>GAUUGUCAAUGACGUUUUUUAUUU-5' | (SEQ ID NO: 2122) |  |
| βc-m3150 Target: | 5'-AAACTAACAGTTACTGCAAAAAATAAA-3' | (SEQ ID NO: 3231) |  |
|  | 5'-AAACUAACAGUUACUGCAAAAAAta-3' | (SEQ ID NO: 1014) |  |
|  | 3'-<u>UUU</u>UUGAUUGUCAAUGACGUUUUUUAU-5' | (SEQ ID NO: 2123) |  |
| βc-m3152 Target: | 5'-AAAAACTAACAGTTACTGCAAAAAATA-3' | (SEQ ID NO: 3232) |  |
|  | 5'-AAAACUAACAGUUACUGCAAAAAat-3' | (SEQ ID NO: 1015) |  |
|  | 3'-<u>AUU</u>UUUGAUUGUCAAUGACGUUUUUUA-5' | (SEQ ID NO: 2124) |  |
| βc-m3153 Target: | 5'-TAAAAACTAACAGTTACTGCAAAAAAT-3' | (SEQ ID NO: 3233) |  |
|  | 5'-UAAAAACUAACAGUUACUGCAAAaa-3' | (SEQ ID NO: 1016) |  |
|  | 3'-<u>GAA</u>UUUUUGAUUGUCAAUGACGUUUUU-5' | (SEQ ID NO: 2125) |  |
| βc-m3155 Target: | 5'-CTTAAAAACTAACAGTTACTGCAAAAA-3' | (SEQ ID NO: 3234) |  |
|  | 5'-UACUUAAAAACUAACAGUUACUGca-3' | (SEQ ID NO: 1017) |  |
|  | 3'-<u>UGA</u>UGAAUUUUUGAUUGUCAAUGACGU-5' | (SEQ ID NO: 2126) |  |
| βc-m3159 Target: | 5'-ACTACTTAAAAACTAACAGTTACTGCA-3' | (SEQ ID NO: 3235) |  |
|  | 5'-ACUACUUAAAAACUAACAGUUACtg-3' | (SEQ ID NO: 1018) |  |
|  | 3'-<u>UGU</u>GAUGAAUUUUUGAUUGUCAAUGAC-5' | (SEQ ID NO: 2127) |  |
| βc-m3161 Target: | 5'-ACACTACTTAAAAACTAACAGTTACTG-3' | (SEQ ID NO: 3236) |  |
|  | 5'-UAACACUACUUAAAAACUAACAGtt-3' | (SEQ ID NO: 1019) |  |
|  | 3'-<u>GUA</u>UUGUGAUGAAUUUUUGAUUGUCAA-5' | (SEQ ID NO: 2128) |  |
| βc-m3165 Target: | 5'-CATAACACTACTTAAAAACTAACAGTT-3' | (SEQ ID NO: 3237) |  |
|  | 5'-AUAACACUACUUAAAAACUAACAgt-3' | (SEQ ID NO: 1020) |  |
|  | 3'-<u>UGU</u>AUUGUGAUGAAUUUUUGAUUGUCA-5' | (SEQ ID NO: 2129) |  |
| βc-m3166 Target: | 5'-ACATAACACTACTTAAAAACTAACAGT-3' | (SEQ ID NO: 3238) |  |

TABLE 9-continued

Additional Selected Anti-β-catenin DsiRNAs, 25/27mer Duplexes

|  |  |  |  |
|---|---|---|---|
|  | 5'-ACAUAACACUACUUAAAAACUAAca-3' | (SEQ ID NO: 1021) |  |
|  | 3'-CUUGUAUUGUGAUGAAUUUUUGAUUGU-5' | (SEQ ID NO: 2130) |  |
| βc-m3168 Target: | 5'-GAACATAACACTACTTAAAAACTAACA-3' | (SEQ ID NO: 3239) |  |
|  | 5'-AACAUAACACUACUUAAAAACUAac-3' | (SEQ ID NO: 1022) |  |
|  | 3'-UCUUGUAUUGUGAUGAAUUUUUGAUUG-5' | (SEQ ID NO: 2131) |  |
| βc-m3169 Target: | 5'-AGAACATAACACTACTTAAAAACTAAC-3' | (SEQ ID NO: 3240) |  |
|  | 5'-GAACAUAACACUACUUAAAAACUaa-3' | (SEQ ID NO: 1023) |  |
|  | 3'-AUCUUGUAUUGUGAUGAAUUUUUGAUU-5' | (SEQ ID NO: 2132) |  |
| βc-m3170 Target: | 5'-TAGAACATAACACTACTTAAAAACTAA-3' | (SEQ ID NO: 3241) |  |
|  | 5'-AGAACAUAACACUACUUAAAAACta-3' | (SEQ ID NO: 1024) |  |
|  | 3'-GAUCUUGUAUUGUGAUGAAUUUUUGAU-5' | (SEQ ID NO: 2133) |  |
| βc-m3171 Target: | 5'-CTAGAACATAACACTACTTAAAAACTA-3' | (SEQ ID NO: 3242) |  |
|  | 5'-UCACUAGAACAUAACACUACUUAaa-3' | (SEQ ID NO: 1025) |  |
|  | 3'-CAAGUGAUCUUGUAUUGUGAUGAAUUU-5' | (SEQ ID NO: 2134) |  |
| βc-m3176 Target: | 5'-GTTCACTAGAACATAACACTACTTAAA-3' | (SEQ ID NO: 3243) |  |
|  | 5'-GUUCACUAGAACAUAACACUACUta-3' | (SEQ ID NO: 1026) |  |
|  | 3'-UCCAAGUGAUCUUGUAUUGUGAUGAAU-5' | (SEQ ID NO: 2135) |  |
| βc-m3178 Target: | 5'-AGGTTCACTAGAACATAACACTACTTA-3' | (SEQ ID NO: 3244) |  |
|  | 5'-GGUUCACUAGAACAUAACACUACtt-3' | (SEQ ID NO: 1027) |  |
|  | 3'-GUCCAAGUGAUCUUGUAUUGUGAUGAA-5' | (SEQ ID NO: 2136) |  |
| βc-m3179 Target: | 5'-CAGGTTCACTAGAACATAACACTACTT-3' | (SEQ ID NO: 3245) |  |
|  | 5'-AUUACUCGGUUCUUAGAAAUCAGaa-3' | (SEQ ID NO: 1028) |  |
|  | 3'-GGUAAUGAGCCAAGAAUCUUUAGUCUU-5' | (SEQ ID NO: 2137) |  |
| βc-m3216 Target: | 5'-CCATTACTCGGTTCTTAGAAATCAGAA-3' | (SEQ ID NO: 3246) |  |
|  | 5'-ACCAUUACUCGGUUCUUAGAAAUca-3' | (SEQ ID NO: 1029) |  |
|  | 3'-UGUGGUAAUGAGCCAAGAAUCUUUAGU-5' | (SEQ ID NO: 2138) |  |
| βc-m3219 Target: | 5'-ACACCATTACTCGGTTCTTAGAAATCA-3' | (SEQ ID NO: 3247) |  |
|  | 5'-UCUACACCAUUACUCGGUUCUUAga-3' | (SEQ ID NO: 1030) |  |
|  | 3'-CAAGAUGUGGUAAUGAGCCAAGAAUCU-5' | (SEQ ID NO: 2139) |  |
| βc-m3224 Target: | 5'-GTTCTACACCATTACTCGGTTCTTAGA-3' | (SEQ ID NO: 3248) |  |
|  | 5'-GAAUUAGUGUUCUACACCAUUACtc-3' | (SEQ ID NO: 1031) |  |
|  | 3'-UACUUAAUCACAAGAUGUGGUAAUGAG-5' | (SEQ ID NO: 2140) |  |
| βc-m3234 Target: | 5'-ATGAATTAGTGTTCTACACCATTACTC-3' | (SEQ ID NO: 3249) |  |
|  | 5'-AUUAUGAAUUAGUGUUCUACACCat-3' | (SEQ ID NO: 1032) |  |
|  | 3'-ACUAAUACUUAAUCACAAGAUGUGGUA-5' | (SEQ ID NO: 2141) |  |
| βc-m3239 Target: | 5'-TGATTATGAATTAGTGTTCTACACC-3' | (SEQ ID NO: 3250) |  |
|  | 5'-GAUUAUGAAUUAGUGUUCUACACca-3' | (SEQ ID NO: 1033) |  |
|  | 3'-CACUAAUACUUAAUCACAAGAUGUGGU-5' | (SEQ ID NO: 2142) |  |
| βc-m3240 Target: | 5'-GTGATTATGAATTAGTGTTCTACACCA-3' | (SEQ ID NO: 3251) |  |

TABLE 9-continued

Additional Selected Anti-β-catenin DsiRNAs, 25/27mer Duplexes

|  |  |  |  |
|---|---|---|---|
|  | 5'-UGAUUAUGAAUUAGUGUUCUACAcc-3' | (SEQ ID NO: 1034) |  |
|  | 3'-GCACUAAUACUUAAUCACAAGAUGUGG-5' | (SEQ ID NO: 2143) |  |
| βc-m3241 Target: | 5'-CGTGATTATGAATTAGTGTTCTACACC-3' | (SEQ ID NO: 3252) |  |
|  | 5'-ACAAUUAGCGUGAUUAUGAAUUAgt-3' | (SEQ ID NO: 1035) |  |
|  | 3'-AAUGUUAAUCGCACUAAUACUUAAUCA-5' | (SEQ ID NO: 2144) |  |
| βc-m3251 Target: | 5'-TTACAATTAGCGTGATTATGAATTAGT-3' | (SEQ ID NO: 3253) |  |
|  | 5'-UACAAUUAGCGUGAUUAUGAAUUag-3' | (SEQ ID NO: 1036) |  |
|  | 3'-UAAUGUUAAUCGCACUAAUACUUAAUC-5' | (SEQ ID NO: 2145) |  |
| βc-m3252 Target: | 5'-ATTACAATTAGCGTGATTATGAATTAG-3' | (SEQ ID NO: 3254) |  |
|  | 5'-AGAUUACAAUUAGCGUGAUUAUGaa-3' | (SEQ ID NO: 1037) |  |
|  | 3'-GGUCUAAUGUUAAUCGCACUAAUACUU-5' | (SEQ ID NO: 2146) |  |
| βc-m3256 Target: | 5'-CCAGATTACAATTAGCGTGATTATGAA-3' | (SEQ ID NO: 3255) |  |
|  | 5'-UACACGUCUCCAGAUUACAAUUAgc-3' | (SEQ ID NO: 1038) |  |
|  | 3'-CAAUGUGCAGAGGUCUAAUGUUAAUCG-5' | (SEQ ID NO: 2147) |  |
| βc-m3267 Target: | 5'-GTTACACGTCTCCAGATTACAATTAGC-3' | (SEQ ID NO: 3256) |  |
|  | 5'-GUUACACGUCUCCAGAUUACAAUta-3' | (SEQ ID NO: 1039) |  |
|  | 3'-UACAAUGUGCAGAGGUCUAAUGUUAAU-5' | (SEQ ID NO: 2148) |  |
| βc-m3269 Target: | 5'-ATGTTACACGTCTCCAGATTACAATTA-3' | (SEQ ID NO: 3257) |  |
|  | 5'-UACACAAUGUUACACGUCUCCAGat-3' | (SEQ ID NO: 1040) |  |
|  | 3'-CGAUGUGUUACAAUGUGCAGAGGUCUA-5' | (SEQ ID NO: 2149) |  |
| βc-m3277 Target: | 5'-GCTACACAATGTTACACGTCTCCAGAT-3' | (SEQ ID NO: 3258) |  |
|  | 5'-GCUACACAAUGUUACACGUCUCCag-3' | (SEQ ID NO: 1041) |  |
|  | 3'-UCCGAUGUGUUACAAUGUGCAGAGGUC-5' | (SEQ ID NO: 2150) |  |
| βc-m3279 Target: | 5'-AGGCTACACAATGTTACACGTCTCCAG-3' | (SEQ ID NO: 3259) |  |
|  | 5'-ACAAAAGGCUACACAAUGUUACAcg-3' | (SEQ ID NO: 1042) |  |
|  | 3'-UAUGUUUUCCGAUGUGUUACAAUGUGC-5' | (SEQ ID NO: 2151) |  |
| βc-m3286 Target: | 5'-ATACAAAAGGCTACACAATGTTACACG-3' | (SEQ ID NO: 3260) |  |
|  | 5'-UACAAAAGGCUACACAAUGUUACac-3' | (SEQ ID NO: 1043) |  |
|  | 3'-AUAUGUUUUCCGAUGUGUUACAAUGUG-5' | (SEQ ID NO: 2152) |  |
| βc-m3287 Target: | 5'-TATACAAAAGGCTACACAATGTTACAC-3' | (SEQ ID NO: 3261) |  |
|  | 5'-UUUAUACAAAAGGCUACACAAUGtt-3' | (SEQ ID NO: 1044) |  |
|  | 3'-AUAAAUAUGUUUUCCGAUGUGUUACAA-5' | (SEQ ID NO: 2153) |  |
| βc-m3291 Target: | 5'-TATTTATACAAAAGGCTACACAATGTT-3' | (SEQ ID NO: 3262) |  |
|  | 5'-AUUUAUACAAAAGGCUACACAAUgt-3' | (SEQ ID NO: 1045) |  |
|  | 3'-GAUAAAUAUGUUUUCCGAUGUGUUACA-5' | (SEQ ID NO: 2154) |  |
| βc-m3292 Target: | 5'-CTATTTATACAAAAGGCTACACAATGT-3' | (SEQ ID NO: 3263) |  |
|  | 5'-UCUAUUUAUACAAAAGGCUACACaa-3' | (SEQ ID NO: 1046) |  |
|  | 3'-ACAGAUAAAUAUGUUUUCCGAUGUGUU-5' | (SEQ ID NO: 2155) |  |
| βc-m3295 Target: | 5'-TGTCTATTTATACAAAAGGCTACACAA-3' | (SEQ ID NO: 3264) |  |

TABLE 9-continued

Additional Selected Anti-β-catenin DsiRNAs, 25/27mer Duplexes

|  |  |  |  |
|---|---|---|---|
|  | 5'-GUCUAUUUAUACAAAAGGCUACAca-3' | (SEQ ID NO: 1047) |
|  | 3'-GACAGAUAAAUAUGUUUUCCGAUGUGU-5' | (SEQ ID NO: 2156) |
| βc-m3296 Target: | 5'-CTGTCTATTTATACAAAAGGCTACACA-3' | (SEQ ID NO: 3265) |
|  | 5'-UGUCUAUUUAUACAAAAGGCUACac-3' | (SEQ ID NO: 1048) |
|  | 3'-AGACAGAUAAAUAUGUUUUCCGAUGUG-5' | (SEQ ID NO: 2157) |
| βc-m3297 Target: | 5'-TCTGTCTATTTATACAAAAGGCTACAC-3' | (SEQ ID NO: 3266) |
|  | 5'-UCUAUCUGUCUAUUUAUACAAAgg-3' | (SEQ ID NO: 1049) |
|  | 3'-AAAGAUAGACAGAUAAAUAUGUUUUCC-5' | (SEQ ID NO: 2158) |
| βc-m3303 Target: | 5'-TTTCTATCTGTCTATTTATACAAAGG-3' | (SEQ ID NO: 3267) |
|  | 5'-UUCUAUCUGUCUAUUUAUACAAAag-3' | (SEQ ID NO: 1050) |
|  | 3'-UAAAGAUAGACAGAUAAAUAUGUUUUC-5' | (SEQ ID NO: 2159) |
| βc-m3304 Target: | 5'-ATTTCTATCTGTCTATTTATACAAAG-3' | (SEQ ID NO: 3268) |
|  | 5'-UUUCUAUCUGUCUAUUUAUACAAaa-3' | (SEQ ID NO: 1051) |
|  | 3'-GUAAAGAUAGACAGAUAAAUAUGUUUU-5' | (SEQ ID NO: 2160) |
| βc-m3305 Target: | 5'-CATTTCTATCTGTCTATTTATACAAAA-3' | (SEQ ID NO: 3269) |
|  | 5'-AUUUCUAUCUGUCUAUUUAUACAaa-3' | (SEQ ID NO: 1052) |
|  | 3'-GGUAAAGAUAGACAGAUAAAUAUGUUU-5' | (SEQ ID NO: 2161) |
| βc-m3306 Target: | 5'-CCATTTCTATCTGTCTATTTATACAAA-3' | (SEQ ID NO: 3270) |
|  | 5'-GACCAUUUCUAUCUGUCUAUUUAta-3' | (SEQ ID NO: 1053) |
|  | 3'-GCCUGGUAAAGAUAGACAGAUAAAUAU-5' | (SEQ ID NO: 2162) |
| βc-m3310 Target: | 5'-CGGACCATTTCTATCTGTCTATTTATA-3' | (SEQ ID NO: 3271) |
|  | 5'-GGACCAUUUCUAUCUGUCUAUUUat-3' | (SEQ ID NO: 1054) |
|  | 3'-AGCCUGGUAAAGAUAGACAGAUAAAUA-5' | (SEQ ID NO: 2163) |
| βc-m3311 Target: | 5'-TCGGACCATTTCTATCTGTCTATTTAT-3' | (SEQ ID NO: 3272) |
|  | 5'-ACUAAUCGGACCAUUUCUAUCUGtc-3' | (SEQ ID NO: 1055) |
|  | 3'-UUUGAUUAGCCUGGUAAAGAUAGACAG-5' | (SEQ ID NO: 2164) |
| βc-m3318 Target: | 5'-AAACTAATCGGACCATTTCTATCTGTC-3' | (SEQ ID NO: 3273) |
|  | 5'-AACUAAUCGGACCAUUUCUAUCUgt-3' | (SEQ ID NO: 1056) |
|  | 3'-CUUUGAUUAGCCUGGUAAAGAUAGACA-5' | (SEQ ID NO: 2165) |
| βc-m3319 Target: | 5'-GAAACTAATCGGACCATTTCTATCTGT-3' | (SEQ ID NO: 3274) |
|  | 5'-AAACUAAUCGGACCAUUUCUAUCtg-3' | (SEQ ID NO: 1057) |
|  | 3'-CCUUUGAUUAGCCUGGUAAAGAUAGAC-5' | (SEQ ID NO: 2166) |
| βc-m3320 Target: | 5'-GGAAACTAATCGGACCATTTCTATCTG-3' | (SEQ ID NO: 3275) |
|  | 5'-GAAACUAAUCGGACCAUUUCUAUct-3' | (SEQ ID NO: 1058) |
|  | 3'-UCCUUUGAUUAGCCUGGUAAAGAUAGA-5' | (SEQ ID NO: 2167) |
| βc-m3321 Target: | 5'-AGGAAACTAATCGGACCATTTCTATCT-3' | (SEQ ID NO: 3276) |
|  | 5'-UAAAAAGGAAACUAAUCGGACCAtt-3' | (SEQ ID NO: 1059) |
|  | 3'-UAAUUUUUCCUUUGAUUAGCCUGGUAA-5' | (SEQ ID NO: 2168) |
| βc-m3328 Target: | 5'-ATTAAAAAGGAAACTAATCGGACCATT-3' | (SEQ ID NO: 3277) |

TABLE 9-continued

Additional Selected Anti-β-catenin DsiRNAs, 25/27mer Duplexes

|  |  |  |  |
|---|---|---|---|
|  | 5'-GCAUAUUAAAAGGAAACUAAUCgg-3' | (SEQ ID NO: 1060) |  |
|  | 3'-UUCGUAUAAUUUUUCCUUUGAUUAGCC-5' | (SEQ ID NO: 2169) |  |
| βc-m3334 Target: | 5'-AAGCATATTAAAAGGAAACTAATCGG-3' | (SEQ ID NO: 3278) |  |
|  | 5'-AGCAUAUUAAAAGGAAACUAAUcg-3' | (SEQ ID NO: 1061) |  |
|  | 3'-AUUCGUAUAAUUUUUCCUUUGAUUAGC-5' | (SEQ ID NO: 2170) |  |
| βc-m3335 Target: | 5'-TAAGCATATTAAAAGGAAACTAATCG-3' | (SEQ ID NO: 3279) |  |
|  | 5'-UUUAAGCAUAUUAAAAGGAAACUa-3' | (SEQ ID NO: 1062) |  |
|  | 3'-UAAAAUUCGUAUAAUUUUUCCUUUGAU-5' | (SEQ ID NO: 2171) |  |
| βc-m3339 Target: | 5'-ATTTTAAGCATATTAAAAGGAAACTA-3' | (SEQ ID NO: 3280) |  |
|  | 5'-GCUUAUUUUAAGCAUAUUAAAAgg-3' | (SEQ ID NO: 1063) |  |
|  | 3'-GACGAAUAAAAUUCGUAUAAUUUUUCC-5' | (SEQ ID NO: 2172) |  |
| βc-m3345 Target: | 5'-CTGCTTATTTTAAGCATATTAAAAGG-3' | (SEQ ID NO: 3281) |  |
|  | 5'-UGCUUAUUUUAAGCAUAUUAAAAag-3' | (SEQ ID NO: 1064) |  |
|  | 3'-GGACGAAUAAAAUUCGUAUAAUUUUUC-5' | (SEQ ID NO: 2173) |  |
| βc-m3346 Target: | 5'-CCTGCTTATTTTAAGCATATTAAAAG-3' | (SEQ ID NO: 3282) |  |
|  | 5'-UCCACCUGCUUAUUUUAAGCAUAtt-3' | (SEQ ID NO: 1065) |  |
|  | 3'-CUAGGUGGACGAAUAAAAUUCGUAUAA-5' | (SEQ ID NO: 2174) |  |
| βc-m3352 Target: | 5'-GATCCACCTGCTTATTTTAAGCATATT-3' | (SEQ ID NO: 3283) |  |
|  | 5'-AAAACAUGAAAUAGAUCCACCUGct-3' | (SEQ ID NO: 1066) |  |
|  | 3'-GUUUUUGUACUUUAUCUAGGUGGACGA-5' | (SEQ ID NO: 2175) |  |
| βc-m3367 Target: | 5'-CAAAAACATGAAATAGATCCACCTGCT-3' | (SEQ ID NO: 3284) |  |
|  | 5'-AAAACAUGAAAUAGAUCCACCUgc-3' | (SEQ ID NO: 1067) |  |
|  | 3'-AGUUUUUGUACUUUAUCUAGGUGGACG-5' | (SEQ ID NO: 2176) |  |
| βc-m3368 Target: | 5'-TCAAAAACATGAAATAGATCCACCTGC-3' | (SEQ ID NO: 3285) |  |
|  | 5'-UCAAAAACAUGAAAUAGAUCCACct-3' | (SEQ ID NO: 1068) |  |
|  | 3'-CAAGUUUUUGUACUUUAUCUAGGUGGA-5' | (SEQ ID NO: 2177) |  |
| βc-m3370 Target: | 5'-GTTCAAAAACATGAAATAGATCCACCT-3' | (SEQ ID NO: 3286) |  |
|  | 5'-UUCAAAAACAUGAAAUAGAUCCAcc-3' | (SEQ ID NO: 1069) |  |
|  | 3'-ACAAGUUUUUGUACUUUAUCUAGGUGG-5' | (SEQ ID NO: 2178) |  |
| βc-m3371 Target: | 5'-TGTTCAAAAACATGAAATAGATCCACC-3' | (SEQ ID NO: 3287) |  |
|  | 5'-GUUCAAAAACAUGAAAUAGAUCCac-3' | (SEQ ID NO: 1070) |  |
|  | 3'-AACAAGUUUUUGUACUUUAUCUAGGUG-5' | (SEQ ID NO: 2179) |  |
| βc-m3372 Target: | 5'-TTGTTCAAAAACATGAAATAGATCCAC-3' | (SEQ ID NO: 3288) |  |
|  | 5'-UUUUUGUUCAAAAACAUGAAAUAga-3' | (SEQ ID NO: 1071) |  |
|  | 3'-UCAAAAACAAGUUUUUGUACUUUAUCU-5' | (SEQ ID NO: 2180) |  |
| βc-m3377 Target: | 5'-AGTTTTTGTTCAAAAACATGAAATAGA-3' | (SEQ ID NO: 3289) |  |
|  | 5'-AUAAAGUUUUUGUUCAAAAACAUga-3' | (SEQ ID NO: 1072) |  |
|  | 3'-GCUAUUUCAAAAACAAGUUUUUGUACU-5' | (SEQ ID NO: 2181) |  |
| βc-m3383 Target: | 5'-CGATAAAGTTTTTGTTCAAAAACATGA-3' | (SEQ ID NO: 3290) |  |

TABLE 9-continued

Additional Selected Anti-β-catenin DsiRNAs, 25/27mer Duplexes

|  |  |  |  |
|---|---|---|---|
|  | 5'-UCCCCGAUAAAGUUUUGUUCAAaa-3' | (SEQ ID NO: 1073) |  |
|  | 3'-AUAGGGGCUAUUUCAAAAACAAGUUUU-5' | (SEQ ID NO: 2182) |  |
| βc-m3389 Target: | 5'-TATCCCCGATAAAGTTTTGTTCAAAA-3' | (SEQ ID NO: 3291) |  |
|  | 5'-AUCCCCGAUAAAGUUUUUGUUCAaa-3' | (SEQ ID NO: 1074) |  |
|  | 3'-CAUAGGGGCUAUUUCAAAAACAAGUUU-5' | (SEQ ID NO: 2183) |  |
| βc-m3390 Target: | 5'-GTATCCCCGATAAAGTTTTGTTCAAA-3' | (SEQ ID NO: 3292) |  |
|  | 5'-ACCUCUUACUGAUUUACCCUACCgc-3' | (SEQ ID NO: 1075) |  |
|  | 3'-UGUGGAGAAUGACUAAAUGGGAUGGCG-5' | (SEQ ID NO: 2184) |  |
| βc-m3419 Target: | 5'-ACACCTCTTACTGATTTACCCTACCGC-3' | (SEQ ID NO: 3293) |  |
|  | 5'-ACACCUCUUACUGAUUUACCCUAcc-3' | (SEQ ID NO: 1076) |  |
|  | 3'-AUUGUGGAGAAUGACUAAAUGGGAUGG-5' | (SEQ ID NO: 2185) |  |
| βc-m3421 Target: | 5'-TAACACCTCTTACTGATTTACCCTACC-3' | (SEQ ID NO: 3294) |  |
|  | 5'-AACACCUCUUACUGAUUUACCCUac-3' | (SEQ ID NO: 1077) |  |
|  | 3'-UAUUGUGGAGAAUGACUAAAUGGGAUG-5' | (SEQ ID NO: 2186) |  |
| βc-m3422 Target: | 5'-ATAACACCTCTTACTGATTTACCCTAC-3' | (SEQ ID NO: 3295) |  |
|  | 5'-UAACACCUCUUACUGAUUUACCCta-3' | (SEQ ID NO: 1078) |  |
|  | 3'-UUAUUGUGGAGAAUGACUAAAUGGGAU-5' | (SEQ ID NO: 2187) |  |
| βc-m3423 Target: | 5'-AATAACACCTCTTACTGATTTACCCTA-3' | (SEQ ID NO: 3296) |  |
|  | 5'-AUAACACCUCUUACUGAUUUACCct-3' | (SEQ ID NO: 1079) |  |
|  | 3'-UUUAUUGUGGAGAAUGACUAAAUGGGA-5' | (SEQ ID NO: 2188) |  |
| βc-m3424 Target: | 5'-AAATAACACCTCTTACTGATTTACCCT-3' | (SEQ ID NO: 3297) |  |
|  | 5'-AAUAACACCUCUUACUGAUUUACcc-3' | (SEQ ID NO: 1080) |  |
|  | 3'-GUUUAUUGUGGAGAAUGACUAAAUGGG-5' | (SEQ ID NO: 2189) |  |
| βc-m3425 Target: | 5'-CAAATAACACCTCTTACTGATTTACCC-3' | (SEQ ID NO: 3298) |  |
|  | 5'-GGCUCAAAUAACACCUCUUACUGat-3' | (SEQ ID NO: 1081) |  |
|  | 3'-UUCCGAGUUUAUUGUGGAGAAUGACUA-5' | (SEQ ID NO: 2190) |  |
| βc-m3431 Target: | 5'-AAGGCTCAAATAACACCTCTTACTGAT-3' | (SEQ ID NO: 3299) |  |
|  | 5'-AACAAGGCUCAAAUAACACCUCUta-3' | (SEQ ID NO: 1082) |  |
|  | 3'-UUUUGUUCCGAGUUUAUUGUGGAGAAU-5' | (SEQ ID NO: 2191) |  |
| βc-m3436 Target: | 5'-AAAACAAGGCTCAAATAACACCTCTTA-3' | (SEQ ID NO: 3300) |  |
|  | 5'-AAACAAGGCUCAAAUAACACCUCtt-3' | (SEQ ID NO: 1083) |  |
|  | 3'-GUUUUGUUCCGAGUUUAUUGUGGAGAA-5' | (SEQ ID NO: 2192) |  |
| βc-m3437 Target: | 5'-CAAAACAAGGCTCAAATAACACCTCTT-3' | (SEQ ID NO: 3301) |  |
|  | 5'-AAAACAAGGCUCAAAUAACACCUct-3' | (SEQ ID NO: 1084) |  |
|  | 3'-GGUUUUGUUCCGAGUUUAUUGUGGAGA-5' | (SEQ ID NO: 2193) |  |
| βc-m3438 Target: | 5'-CCAAAACAAGGCTCAAATAACACCTCT-3' | (SEQ ID NO: 3302) |  |
|  | 5'-UCCAAAACAAGGCUCAAAUAACAcc-3' | (SEQ ID NO: 1085) |  |
|  | 3'-ACAGGUUUUGUUCCGAGUUUAUUGUGG-5' | (SEQ ID NO: 2194) |  |
| βc-m3441 Target: | 5'-TGTCCAAAACAAGGCTCAAATAACACC-3' | (SEQ ID NO: 3303) |  |

TABLE 9-continued

Additional Selected Anti-β-catenin DsiRNAs, 25/27mer Duplexes

|  |  |  |
|---|---|---|
|  | 5'-UGUCCAAAACAAGGCUCAAAUAAca-3' | (SEQ ID NO: 1086) |
|  | 3'-UGACAGGUUUUGUUCCGAGUUUAUUGU-5' | (SEQ ID NO: 2195) |
| βc-m3443 Target: | 5'-ACTGTCCAAAACAAGGCTCAAATAACA-3' | (SEQ ID NO: 3304) |
|  | 5'-UAUACUGUCCAAAACAAGGCUCAaa-3' | (SEQ ID NO: 1087) |
|  | 3'-CCAUAUGACAGGUUUUGUUCCGAGUUU-5' | (SEQ ID NO: 2196) |
| βc-m3448 Target: | 5'-GGTATACTGTCCAAAACAAGGCTCAAA-3' | (SEQ ID NO: 3305) |
|  | 5'-GCAACUGGUAUACUGUCCAAAACaa-3' | (SEQ ID NO: 1088) |
|  | 3'-UCCGUUGACCAUAUGACAGGUUUUGUU-5' | (SEQ ID NO: 2197) |
| βc-m3456 Target: | 5'-AGGCAACTGGTATACTGTCCAAAACAA-3' | (SEQ ID NO: 3306) |
|  | 5'-GAUAAAAGGCAACUGGUAUACUGtc-3' | (SEQ ID NO: 1089) |
|  | 3'-CCCUAUUUUCCGUUGACCAUAUGACAG-5' | (SEQ ID NO: 2198) |
| βc-m3464 Target: | 5'-GGGATAAAAGGCAACTGGTATACTGTC-3' | (SEQ ID NO: 3307) |
|  | 5'-GGAUAAAAGGCAACUGGUAUACUgt-3' | (SEQ ID NO: 1090) |
|  | 3'-ACCCUAUUUUCCGUUGACCAUAUGACA-5' | (SEQ ID NO: 2199) |
| βc-m3465 Target: | 5'-TGGGATAAAAGGCAACTGGTATACTGT-3' | (SEQ ID NO: 3308) |
|  | 5'-AACUUUGGGAUAAAAGGCAACUGgt-3' | (SEQ ID NO: 1091) |
|  | 3'-UGUUGAAACCCUAUUUUCCGUUGACCA-5' | (SEQ ID NO: 2200) |
| βc-m3472 Target: | 5'-ACAACTTTGGGATAAAAGGCAACTGGT-3' | (SEQ ID NO: 3309) |
|  | 5'-ACAACUUUGGGAUAAAAGGCAACtg-3' | (SEQ ID NO: 1092) |
|  | 3'-GUUGUUGAAACCCUAUUUUCCGUUGAC-5' | (SEQ ID NO: 2201) |
| βc-m3474 Target: | 5'-CAACAACTTTGGGATAAAAGGCAACTG-3' | (SEQ ID NO: 3310) |
|  | 5'-UUACAACAACUUUGGGAUAAAAGgc-3' | (SEQ ID NO: 1093) |
|  | 3'-CCAAUGUUGUUGAAACCCUAUUUUCCG-5' | (SEQ ID NO: 2202) |
| βc-m3479 Target: | 5'-GGTTACAACAACTTTGGGATAAAAGGC-3' | (SEQ ID NO: 3311) |
|  | 5'-GUUACAACAACUUUGGGAUAAAAgg-3' | (SEQ ID NO: 1094) |
|  | 3'-UCCAAUGUUGUUGAAACCCUAUUUUCC-5' | (SEQ ID NO: 2203) |
| βc-m3480 Target: | 5'-AGGTTACAACAACTTTGGGATAAAAGG-3' | (SEQ ID NO: 3312) |
|  | 5'-GGUUACAACAACUUUGGGAUAAAag-3' | (SEQ ID NO: 1095) |
|  | 3'-GUCCAAUGUUGUUGAAACCCUAUUUUC-5' | (SEQ ID NO: 2204) |
| βc-m3481 Target: | 5'-CAGGTTACAACAACTTTGGGATAAAAG-3' | (SEQ ID NO: 3313) |
|  | 5'-UCACAGCAGGUUACAACAACUUUgg-3' | (SEQ ID NO: 1096) |
|  | 3'-AUAGUGUCGUCCAAUGUUGUUGAAACC-5' | (SEQ ID NO: 2205) |
| βc-m3489 Target: | 5'-TATCACAGCAGGTTACAACAACTTTGG-3' | (SEQ ID NO: 3314) |
|  | 5'-AUCACAGCAGGUUACAACAACUUtg-3' | (SEQ ID NO: 1097) |
|  | 3'-CAUAGUGUCGUCCAAUGUUGUUGAAAC-5' | (SEQ ID NO: 2206) |
| βc-m3490 Target: | 5'-GTATCACAGCAGGTTACAACAACTTTG-3' | (SEQ ID NO: 3315) |
|  | 5'-GUAUCACAGCAGGUUACAACAACtt-3' | (SEQ ID NO: 1098) |
|  | 3'-AACAUAGUGUCGUCCAAUGUUGUUGAA-5' | (SEQ ID NO: 2207) |
| βc-m3492 Target: | 5'-TTGTATCACAGCAGGTTACAACAACTT-3' | (SEQ ID NO: 3316) |

TABLE 9-continued

Additional Selected Anti-β-catenin DsiRNAs, 25/27mer Duplexes

|  |  |  |  |
|---|---|---|---|
|  | 5'-GCAUCUGUUGAAGCAUUGUAUCAca-3' | (SEQ ID NO: 1099) |  |
|  | 3'-GGCGUAGACAACUUCGUAACAUAGUGU-5' | (SEQ ID NO: 2208) |  |
| βc-m3509 Target: | 5'-CCGCATCTGTTGAAGCATTGTATCACA-3' | (SEQ ID NO: 3317) |  |
|  | 5'-UGAACCAUUUCUAUAACCGCAUCtg-3' | (SEQ ID NO: 1100) |  |
|  | 3'-AGACUUGGUAAAGAUAUUGGCGUAGAC-5' | (SEQ ID NO: 2209) |  |
| βc-m3527 Target: | 5'-TCTGAACCATTTCTATAACCGCATCTG-3' | (SEQ ID NO: 3318) |  |
|  | 5'-AUUCUGAACCAUUUCUAUAACCGca-3' | (SEQ ID NO: 1101) |  |
|  | 3'-AUUAAGACUUGGUAAAGAUAUUGGCGU-5' | (SEQ ID NO: 2210) |  |
| βc-m3531 Target: | 5'-TAATTCTGAACCATTTCTATAACCGCA-3' | (SEQ ID NO: 3319) |  |
|  | 5'-UAAUUCUGAACCAUUUCUAUAACcg-3' | (SEQ ID NO: 1102) |  |
|  | 3'-AAAUUAAGACUUGGUAAAGAUAUUGGC-5' | (SEQ ID NO: 2211) |  |
| βc-m3533 Target: | 5'-TTTAATTCTGAACCATTTCTATAACCG-3' | (SEQ ID NO: 3320) |  |
|  | 5'-UUAAUUCUGAACCAUUUCUAUAAcc-3' | (SEQ ID NO: 1103) |  |
|  | 3'-CAAAUUAAGACUUGGUAAAGAUAUUGG-5' | (SEQ ID NO: 2212) |  |
| βc-m3534 Target: | 5'-GTTTAATTCTGAACCATTTCTATAACC-3' | (SEQ ID NO: 3321) |  |
|  | 5'-UUUAAUUCUGAACCAUUUCUAUAac-3' | (SEQ ID NO: 1104) |  |
|  | 3'-UCAAAUUAAGACUUGGUAAAGAUAUUG-5' | (SEQ ID NO: 2213) |  |
| βc-m3535 Target: | 5'-AGTTTAATTCTGAACCATTTCTATAAC-3' | (SEQ ID NO: 3322) |  |
|  | 5'-GUUUAAUUCUGAACCAUUUCUAUaa-3' | (SEQ ID NO: 1105) |  |
|  | 3'-UUCAAAUUAAGACUUGGUAAAGAUAUU-5' | (SEQ ID NO: 2214) |  |
| βc-m3536 Target: | 5'-AAGTTTAATTCTGAACCATTTCTATAA-3' | (SEQ ID NO: 3323) |  |
|  | 5'-UAAAGUUUAAUUCUGAACCAUUtc-3' | (SEQ ID NO: 1106) |  |
|  | 3'-UAAUUUUCAAAUUAAGACUUGGUAAAG-5' | (SEQ ID NO: 2215) |  |
| βc-m3541 Target: | 5'-ATTAAAAGTTTAATTCTGAACCATTTC-3' | (SEQ ID NO: 3324) |  |
|  | 5'-UUAAAAGUUUAAUUCUGAACCAUtt-3' | (SEQ ID NO: 1107) |  |
|  | 3'-UUAAUUUUCAAAUUAAGACUUGGUAAA-5' | (SEQ ID NO: 2216) |  |
| βc-m3542 Target: | 5'-AATTAAAAGTTTAATTCTGAACCATTT-3' | (SEQ ID NO: 3325) |  |
|  | 5'-AAUUAAAAGUUUAAUUCUGAACCat-3' | (SEQ ID NO: 1108) |  |
|  | 3'-ACUUAAUUUUCAAAUUAAGACUUGGUA-5' | (SEQ ID NO: 2217) |  |
| βc-m3544 Target: | 5'-TGAATTAAAAGTTTAATTCTGAACC-3' | (SEQ ID NO: 3326) |  |
|  | 5'-UGAAUGAAUUAAAAGUUUAAUUCtg-3' | (SEQ ID NO: 1109) |  |
|  | 3'-AAACUUACUUAAUUUUCAAAUUAAGAC-5' | (SEQ ID NO: 2218) |  |
| βc-m3550 Target: | 5'-TTTGAATGAATTAAAAGTTTAATTCTG-3' | (SEQ ID NO: 3327) |  |
|  | 5'-UUUUUGAAUGAAUUAAAAGUUUAat-3' | (SEQ ID NO: 1110) |  |
|  | 3'-AAAAAAACUUACUUAAUUUUCAAAUUA-5' | (SEQ ID NO: 2219) |  |
| βc-m3554 Target: | 5'-TTTTTTTGAATGAATTAAAAGTTTAAT-3' | (SEQ ID NO: 3328) |  |
|  | 5'-UUUUUUUUUGAAUGAAUUAAAAGtt-3' | (SEQ ID NO: 1111) |  |
|  | 3'-AAAAAAAAAAACUUACUUAAUUUUCAA-5' | (SEQ ID NO: 2220) |  |
| βc-m3558 Target: | 5'-TTTTTTTTTTGAATGAATTAAAAGTT-3' | (SEQ ID NO: 3329) |  |

TABLE 9-continued

Additional Selected Anti-β-catenin DsiRNAs, 25/27mer Duplexes

|  |  |  |
|---|---|---|
|  | 5'-UUUUUUUUUUGAAUGAAUUAAAAgt-3' | (SEQ ID NO: 1112) |
|  | 3'-AAAAAAAAAAACUUACUUAAUUUUCA-5' | (SEQ ID NO: 2221) |
| βc-m3559 Target: | 5'-TTTTTTTTTTTGAATGAATTAAAAGT-3' | (SEQ ID NO: 3330) |
|  | 5'-UUUUUUUUUUUGAAUGAAUUAAAag-3' | (SEQ ID NO: 1113) |
|  | 3'-AAAAAAAAAAACUUACUUAAUUUUC-5' | (SEQ ID NO: 2222) |
| βc-m3560 Target: | 5'-TTTTTTTTTTTTGAATGAATTAAAAG-3' | (SEQ ID NO: 3331) |
|  | 5'-UUUUUUUUUUUUGAAUGAAUUAAaa-3' | (SEQ ID NO: 1114) |
|  | 3'-AAAAAAAAAAAAACUUACUUAAUUUU-5' | (SEQ ID NO: 2223) |
| βc-m3561 Target: | 5'-TTTTTTTTTTTTTGAATGAATTAAAA-3' | (SEQ ID NO: 3332) |
|  | 5'-UUUUUUUUUUUUUGAAUGAAUUAaa-3' | (SEQ ID NO: 1115) |
|  | 3'-AAAAAAAAAAAAAACUUACUUAAUUU-5' | (SEQ ID NO: 2224) |
| βc-m3562 Target: | 5'-TTTTTTTTTTTTTTGAATGAATTAAA-3' | (SEQ ID NO: 3333) |
|  | 5'-UUUUUUUUUUUUUUGAAUGAAUUaa-3' | (SEQ ID NO: 1116) |
|  | 3'-AAAAAAAAAAAAAAACUUACUUAAUU-5' | (SEQ ID NO: 2225) |
| βc-m3563 Target: | 5'-TTTTTTTTTTTTTTTGAATGAATTAA-3' | (SEQ ID NO: 3334) |

Projected 21 nucleotide target sequences for each DsiRNA of Table 9 above and of Tables 11-13 below are presented in Table 10.

TABLE 10

21 Nucleotide Target Sequences of Additional Selected DsiRNAs

| βc-244 21 nt Target: | 5'-GTTGTATGGTATACTTCAAAT-3' | (SEQ ID NO: 4932) |
|---|---|---|
| βc-251 21 nt Target: | 5'-CAAAACAGTTGTATGGTATAC-3' | (SEQ ID NO: 4933) |
| βc-252 21 nt Target: | 5'-TCAAAACAGTTGTATGGTATA-3' | (SEQ ID NO: 4934) |
| βc-254 21 nt Target: | 5'-TTTCAAAACAGTTGTATGGTA-3' | (SEQ ID NO: 4935) |
| βc-255 21 nt Target: | 5'-TTTTCAAAACAGTTGTATGGT-3' | (SEQ ID NO: 4936) |
| βc-256 21 nt Target: | 5'-ATTTTCAAAACAGTTGTATGG-3' | (SEQ ID NO: 4937) |
| βc-269 21 nt Target: | 5'-TTGTCCACGCTGGATTTTCAA-3' | (SEQ ID NO: 4938) |
| βc-270 21 nt Target: | 5'-ATTGTCCACGCTGGATTTTCA-3' | (SEQ ID NO: 4939) |
| βc-293 21 nt Target: | 5'-CCATCAAATCAGCTTGAGTAG-3' | (SEQ ID NO: 4940) |
| βc-302 21 nt Target: | 5'-TGTCCAACTCCATCAAATCAG-3' | (SEQ ID NO: 4941) |
| βc-431 21 nt Target: | 5'-CTTCCTCAGGATTGCCTTTAC-3' | (SEQ ID NO: 4942) |
| βc-432 21 nt Target: | 5'-TCTTCCTCAGGATTGCCTTTA-3' | (SEQ ID NO: 4943) |
| βc-518 21 nt Target: | 5'-CATCAATATCAGCTACTTGTT-3' | (SEQ ID NO: 4944) |
| βc-519 21 nt Target: | 5'-CCATCAATATCAGCTACTTGT-3' | (SEQ ID NO: 4945) |
| βc-524 21 nt Target: | 5'-ACTGTCCATCAATATCAGCTA-3' | (SEQ ID NO: 4946) |
| βc-531 21 nt Target: | 5'-ATTGCATACTGTCCATCAATA-3' | (SEQ ID NO: 4947) |
| βc-537 21 nt Target: | 5'-CGAGTCATTGCATACTGTCCA-3' | (SEQ ID NO: 4948) |
| βc-584 21 nt Target: | 5'-CCTCATCTAATGTCTCAGGGA-3' | (SEQ ID NO: 4949) |
| βc-680 21 nt Target: | 5'-TTACAACTGCATGTTTCAGCA-3' | (SEQ ID NO: 4950) |

TABLE 10-continued

21 Nucleotide Target Sequences of Additional Selected DsiRNAs

| | | |
|---|---|---|
| βc-682 21 nt Target: | 5'-GTTTACAACTGCATGTTTCAG-3' | (SEQ ID NO: 4951) |
| βc-692 21 nt Target: | 5'-AGTTAATCAAGTTTACAACTG-3' | (SEQ ID NO: 4952) |
| βc-698 21 nt Target: | 5'-CTTGATAGTTAATCAAGTTTA-3' | (SEQ ID NO: 4953) |
| βc-707 21 nt Target: | 5'-CTGCATCATCTTGATAGTTAA-3' | (SEQ ID NO: 4954) |
| βc-708 21 nt Target: | 5'-TCTGCATCATCTTGATAGTTA-3' | (SEQ ID NO: 4955) |
| βc-763 21 nt Target: | 5'-CTGGTCCTCGTCATTTAGCAG-3' | (SEQ ID NO: 4956) |
| βc-790 21 nt Target: | 5'-CATAACTGCAGCCTTATTAAC-3' | (SEQ ID NO: 4957) |
| βc-791 21 nt Target: | 5'-CCATAACTGCAGCCTTATTAA-3' | (SEQ ID NO: 4958) |
| βc-794 21 nt Target: | 5'-GGACCATAACTGCAGCCTTAT-3' | (SEQ ID NO: 4959) |
| βc-812 21 nt Target: | 5'-CCTTTTTAGAAAGCTGATGGA-3' | (SEQ ID NO: 4960) |
| βc-873 21 nt Target: | 5'-ATGGTACGTACAATAGCAGAC-3' | (SEQ ID NO: 4961) |
| βc-890 21 nt Target: | 5'-CATCATTTGTATTCTGCATGG-3' | (SEQ ID NO: 4962) |
| βc-899 21 nt Target: | 5'-CTGTTTCTACATCATTTGTAT-3' | (SEQ ID NO: 4963) |
| βc-900 21 nt Target: | 5'-GCTGTTTCTACATCATTTGTA-3' | (SEQ ID NO: 4964) |
| βc-909 21 nt Target: | 5'-GTACAACGAGCTGTTTCTACA-3' | (SEQ ID NO: 4965) |
| βc-911 21 nt Target: | 5'-CGGTACAACGAGCTGTTTCTA-3' | (SEQ ID NO: 4966) |
| βc-912 21 nt Target: | 5'-GCGGTACAACGAGCTGTTTCT-3' | (SEQ ID NO: 4967) |
| βc-1032 21 nt Target: | 5'-GCATAAAACAACACAGAATCC-3' | (SEQ ID NO: 4968) |
| βc-1034 21 nt Target: | 5'-TGGCATAAAACAACACAGAAT-3' | (SEQ ID NO: 4969) |
| βc-1035 21 nt Target: | 5'-ATGGCATAAAACAACACAGAA-3' | (SEQ ID NO: 4970) |
| βc-1076 21 nt Target: | 5'-TAGCTCCTTCTTGATGTAATA-3' | (SEQ ID NO: 4971) |
| βc-1077 21 nt Target: | 5'-TTAGCTCCTTCTTGATGTAAT-3' | (SEQ ID NO: 4972) |
| βc-1144 21 nt Target: | 5'-TTTAACATTTGTTTTGTTGAG-3' | (SEQ ID NO: 4973) |
| βc-1154 21 nt Target: | 5'-TAGCCAAGAATTTAACATTTG-3' | (SEQ ID NO: 4974) |
| βc-1159 21 nt Target: | 5'-CGTAATAGCCAAGAATTTAAC-3' | (SEQ ID NO: 4975) |
| βc-1160 21 nt Target: | 5'-TCGTAATAGCCAAGAATTTAA-3' | (SEQ ID NO: 4976) |
| βc-1185 21 nt Target: | 5'-TAAGCTAAAATTTGAAGGCAG-3' | (SEQ ID NO: 4977) |
| βc-1260 21 nt Target: | 5'-TAGGTCCTCATTATATTTACT-3' | (SEQ ID NO: 4978) |
| βc-1265 21 nt Target: | 5'-AAGTATAGGTCCTCATTATAT-3' | (SEQ ID NO: 4979) |
| βc-1266 21 nt Target: | 5'-TAAGTATAGGTCCTCATTATA-3' | (SEQ ID NO: 4980) |
| βc-1274 21 nt Target: | 5'-GTTTTTCGTAAGTATAGGTCC-3' | (SEQ ID NO: 4981) |
| βc-1275 21 nt Target: | 5'-AGTTTTTCGTAAGTATAGGTC-3' | (SEQ ID NO: 4982) |
| βc-1276 21 nt Target: | 5'-TAGTTTTTCGTAAGTATAGGT-3' | (SEQ ID NO: 4983) |
| βc-1277 21 nt Target: | 5'-GTAGTTTTTCGTAAGTATAGG-3' | (SEQ ID NO: 4984) |
| βc-1287 21 nt Target: | 5'-GTGGTCCACAGTAGTTTTTCG-3' | (SEQ ID NO: 4985) |
| βc-1344 21 nt Target: | 5'-TCTACAATAGCCGGCTTATTA-3' | (SEQ ID NO: 4986) |
| βc-1346 21 nt Target: | 5'-CTTCTACAATAGCCGGCTTAT-3' | (SEQ ID NO: 4987) |
| βc-1371 21 nt Target: | 5'-AGTCCTAAAGCTTGCATTCCA-3' | (SEQ ID NO: 4988) |
| βc-1372 21 nt Target: | 5'-AAGTCCTAAAGCTTGCATTCC-3' | (SEQ ID NO: 4989) |

TABLE 10-continued

21 Nucleotide Target Sequences of Additional Selected DsiRNAs

| | | |
|---|---|---|
| βc-1373 21 nt Target: | 5'-GAAGTCCTAAAGCTTGCATTC-3' | (SEQ ID NO: 4990) |
| βc-1410 21 nt Target: | 5'-CAGTTCTGAACAAGACGTTGA-3' | (SEQ ID NO: 4991) |
| βc-1411 21 nt Target: | 5'-ACAGTTCTGAACAAGACGTTG-3' | (SEQ ID NO: 4992) |
| βc-1421 21 nt Target: | 5'-GAGTCCAAAGACAGTTCTGAA-3' | (SEQ ID NO: 4993) |
| βc-1458 21 nt Target: | 5'-CCTTCCTGTTTAGTTGCAGCA-3' | (SEQ ID NO: 4994) |
| βc-1517 21 nt Target: | 5'-CCACATTTATATCATCTGAAC-3' | (SEQ ID NO: 4995) |
| βc-1520 21 nt Target: | 5'-TGACCACATTTATATCATCTG-3' | (SEQ ID NO: 4996) |
| βc-1529 21 nt Target: | 5'-CTGCACAGGTGACCACATTTA-3' | (SEQ ID NO: 4997) |
| βc-1530 21 nt Target: | 5'-GCTGCACAGGTGACCACATTT-3' | (SEQ ID NO: 4998) |
| βc-1558 21 nt Target: | 5'-ATTGCAAGTGAGGTTAGAAAG-3' | (SEQ ID NO: 4999) |
| βc-1566 21 nt Target: | 5'-TTATAATTATTGCAAGTGAGG-3' | (SEQ ID NO: 5000) |
| βc-1579 21 nt Target: | 5'-CATCATCTTGTTCTTATAATT-3' | (SEQ ID NO: 5001) |
| βc-1580 21 nt Target: | 5'-CCATCATCTTGTTCTTATAAT-3' | (SEQ ID NO: 5002) |
| βc-1583 21 nt Target: | 5'-AGACCATCATCTTGTTCTTAT-3' | (SEQ ID NO: 5003) |
| βc-1585 21 nt Target: | 5'-GCAGACCATCATCTTGTTCTT-3' | (SEQ ID NO: 5004) |
| βc-1808 21 nt Target: | 5'-TCAATCCAACAGTAGCCTTTA-3' | (SEQ ID NO: 5005) |
| βc-1813 21 nt Target: | 5'-TCGAATCAATCCAACAGTAGC-3' | (SEQ ID NO: 5006) |
| βc-1955 21 nt Target: | 5'-CCTCCACAAATTGCTGCTGTG-3' | (SEQ ID NO: 5007) |
| βc-1989 21 nt Target: | 5'-GTACAACCTTCAACTATTTCT-3' | (SEQ ID NO: 5008) |
| βc-1990 21 nt Target: | 5'-GGTACAACCTTCAACTATTTC-3' | (SEQ ID NO: 5009) |
| βc-1991 21 nt Target: | 5'-CGGTACAACCTTCAACTATTT-3' | (SEQ ID NO: 5010) |
| βc-1992 21 nt Target: | 5'-CCGGTACAACCTTCAACTATT-3' | (SEQ ID NO: 5011) |
| βc-1997 21 nt Target: | 5'-GGGCTCCGGTACAACCTTCAA-3' | (SEQ ID NO: 5012) |
| βc-2036 21 nt Target: | 5'-TAACAATTCGGTTGTGAACAT-3' | (SEQ ID NO: 5013) |
| βc-2037 21 nt Target: | 5'-ATAACAATTCGGTTGTGAACA-3' | (SEQ ID NO: 5014) |
| βc-2038 21 nt Target: | 5'-GATAACAATTCGGTTGTGAAC-3' | (SEQ ID NO: 5015) |
| βc-2039 21 nt Target: | 5'-TGATAACAATTCGGTTGTGAA-3' | (SEQ ID NO: 5016) |
| βc-2040 21 nt Target: | 5'-CTGATAACAATTCGGTTGTGA-3' | (SEQ ID NO: 5017) |
| βc-2041 21 nt Target: | 5'-TCTGATAACAATTCGGTTGTG-3' | (SEQ ID NO: 5018) |
| βc-2052 21 nt Target: | 5'-GTATTTAGTCCTCTGATAACA-3' | (SEQ ID NO: 5019) |
| βc-2053 21 nt Target: | 5'-GGTATTTAGTCCTCTGATAAC-3' | (SEQ ID NO: 5020) |
| βc-2054 21 nt Target: | 5'-TGGTATTTAGTCCTCTGATAA-3' | (SEQ ID NO: 5021) |
| βc-2055 21 nt Target: | 5'-ATGGTATTTAGTCCTCTGATA-3' | (SEQ ID NO: 5022) |
| βc-2065 21 nt Target: | 5'-AAACAATGGAATGGTATTTAG-3' | (SEQ ID NO: 5023) |
| βc-2069 21 nt Target: | 5'-GCACAAACAATGGAATGGTAT-3' | (SEQ ID NO: 5024) |
| βc-2071 21 nt Target: | 5'-CTGCACAAACAATGGAATGGT-3' | (SEQ ID NO: 5025) |
| βc-2072 21 nt Target: | 5'-GCTGCACAAACAATGGAATGG-3' | (SEQ ID NO: 5026) |
| βc-2111 21 nt Target: | 5'-CAGCTACTCTTTGGATGTTTT-3' | (SEQ ID NO: 5027) |
| βc-2112 21 nt Target: | 5'-GCAGCTACTCTTTGGATGTTT-3' | (SEQ ID NO: 5028) |

TABLE 10-continued

21 Nucleotide Target Sequences of Additional Selected DsiRNAs

| | | |
|---|---|---|
| βc-2168 21 nt Target: | 5'-CAGCTTCAATAGCTTCTGCAG-3' | (SEQ ID NO: 5029) |
| βc-2175 21 nt Target: | 5'-GCTCCCTCAGCTTCAATAGCT-3' | (SEQ ID NO: 5030) |
| βc-2177 21 nt Target: | 5'-TGGCTCCCTCAGCTTCAATAG-3' | (SEQ ID NO: 5031) |
| βc-2214 21 nt Target: | 5'-TCATTCCTAGAGTGAAGTAAC-3' | (SEQ ID NO: 5032) |
| βc-2216 21 nt Target: | 5'-CTTCATTCCTAGAGTGAAGTA-3' | (SEQ ID NO: 5033) |
| βc-2217 21 nt Target: | 5'-CCTTCATTCCTAGAGTGAAGT-3' | (SEQ ID NO: 5034) |
| βc-2264 21 nt Target: | 5'-TGTCCTCAGACATTCGGAACA-3' | (SEQ ID NO: 5035) |
| βc-2266 21 nt Target: | 5'-CTTGTCCTCAGACATTCGGAA-3' | (SEQ ID NO: 5036) |
| βc-2287 21 nt Target: | 5'-CCGTTTCTTGTAATCTTGTGG-3' | (SEQ ID NO: 5037) |
| βc-2295 21 nt Target: | 5'-ACTGAAAGCCGTTTCTTGTAA-3' | (SEQ ID NO: 5038) |
| βc-2302 21 nt Target: | 5'-CAGCTCAACTGAAAGCCGTTT-3' | (SEQ ID NO: 5039) |
| βc-2363 21 nt Target: | 5'-CAAGTCCAAGATCAGCAGTCT-3' | (SEQ ID NO: 5040) |
| βc-2373 21 nt Target: | 5'-GCACCAATATCAAGTCCAAGA-3' | (SEQ ID NO: 5041) |
| βc-2424 21 nt Target: | 5'-AAAGAACGATAGCTAGGATCA-3' | (SEQ ID NO: 5042) |
| βc-2441 21 nt Target: | 5'-CATATCCACCAGAGTGAAAAG-3' | (SEQ ID NO: 5043) |
| βc-2618 21 nt Target: | 5'-TGATTTACAGGTCAGTATCAA-3' | (SEQ ID NO: 5044) |
| βc-2619 21 nt Target: | 5'-ATGATTTACAGGTCAGTATCA-3' | (SEQ ID NO: 5045) |
| βc-2620 21 nt Target: | 5'-GATGATTTACAGGTCAGTATC-3' | (SEQ ID NO: 5046) |
| βc-2634 21 nt Target: | 5'-CTTCTTACCTAAAGGATGATT-3' | (SEQ ID NO: 5047) |
| βc-2635 21 nt Target: | 5'-ACTTCTTACCTAAAGGATGAT-3' | (SEQ ID NO: 5048) |
| βc-2637 21 nt Target: | 5'-AAACTTCTTACCTAAAGGATG-3' | (SEQ ID NO: 5049) |
| βc-2645 21 nt Target: | 5'-GCTTTTTAAAACTTCTTACCT-3' | (SEQ ID NO: 5050) |
| βc-2647 21 nt Target: | 5'-TGGCTTTTTAAAACTTCTTAC-3' | (SEQ ID NO: 5051) |
| βc-2653 21 nt Target: | 5'-CCAAACTGGCTTTTTAAAACT-3' | (SEQ ID NO: 5052) |
| βc-2657 21 nt Target: | 5'-TTACCCAAACTGGCTTTTTAA-3' | (SEQ ID NO: 5053) |
| βc-2658 21 nt Target: | 5'-TTTACCCAAACTGGCTTTTTA-3' | (SEQ ID NO: 5054) |
| βc-2659 21 nt Target: | 5'-TTTTACCCAAACTGGCTTTTT-3' | (SEQ ID NO: 5055) |
| βc-2660 21 nt Target: | 5'-ATTTTACCCAAACTGGCTTTT-3' | (SEQ ID NO: 5056) |
| βc-2701 21 nt Target: | 5'-CCAACCAAGTCTTTCTGAAGT-3' | (SEQ ID NO: 5057) |
| βc-2709 21 nt Target: | 5'-CCACCCTACCAACCAAGTCTT-3' | (SEQ ID NO: 5058) |
| βc-2733 21 nt Target: | 5'-ATTTACAAATAGCCTAAACCA-3' | (SEQ ID NO: 5059) |
| βc-2734 21 nt Target: | 5'-GATTTACAAATAGCCTAAACC-3' | (SEQ ID NO: 5060) |
| βc-2735 21 nt Target: | 5'-AGATTTACAAATAGCCTAAAC-3' | (SEQ ID NO: 5061) |
| βc-2736 21 nt Target: | 5'-CAGATTTACAAATAGCCTAAA-3' | (SEQ ID NO: 5062) |
| βc-2747 21 nt Target: | 5'-TGTTTTTGTGGCAGATTTACA-3' | (SEQ ID NO: 5063) |
| βc-2748 21 nt Target: | 5'-CTGTTTTTGTGGCAGATTTAC-3' | (SEQ ID NO: 5064) |
| βc-2749 21 nt Target: | 5'-CCTGTTTTTGTGGCAGATTTA-3' | (SEQ ID NO: 5065) |
| βc-2754 21 nt Target: | 5'-ATATACCTGTTTTTGTGGCAG-3' | (SEQ ID NO: 5066) |
| βc-2764 21 nt Target: | 5'-CTTTCAAAGTATATACCTGTT-3' | (SEQ ID NO: 5067) |

TABLE 10-continued

21 Nucleotide Target Sequences of Additional Selected DsiRNAs

| | | |
|---|---|---|
| βc-2770 21 nt Target: | 5'-CATCTCCTTTCAAAGTATATA-3' | (SEQ ID NO: 5068) |
| βc-2771 21 nt Target: | 5'-ACATCTCCTTTCAAAGTATAT-3' | (SEQ ID NO: 5069) |
| βc-2773 21 nt Target: | 5'-AGACATCTCCTTTCAAAGTAT-3' | (SEQ ID NO: 5070) |
| βc-2774 21 nt Target: | 5'-AAGACATCTCCTTTCAAAGTA-3' | (SEQ ID NO: 5071) |
| βc-2775 21 nt Target: | 5'-CAAGACATCTCCTTTCAAAGT-3' | (SEQ ID NO: 5072) |
| βc-2780 21 nt Target: | 5'-TGTTCCAAGACATCTCCTTTC-3' | (SEQ ID NO: 5073) |
| βc-2788 21 nt Target: | 5'-CATTCCAATGTTCCAAGACAT-3' | (SEQ ID NO: 5074) |
| βc-2789 21 nt Target: | 5'-ACATTCCAATGTTCCAAGACA-3' | (SEQ ID NO: 5075) |
| βc-2791 21 nt Target: | 5'-GAACATTCCAATGTTCCAAGA-3' | (SEQ ID NO: 5076) |
| βc-2803 21 nt Target: | 5'-CCAGAAATCTGAGAACATTCC-3' | (SEQ ID NO: 5077) |
| βc-2807 21 nt Target: | 5'-ACAACCAGAAATCTGAGAACA-3' | (SEQ ID NO: 5078) |
| βc-2809 21 nt Target: | 5'-TAACAACCAGAAATCTGAGAA-3' | (SEQ ID NO: 5079) |
| βc-2810 21 nt Target: | 5'-ATAACAACCAGAAATCTGAGA-3' | (SEQ ID NO: 5080) |
| βc-2811 21 nt Target: | 5'-CATAACAACCAGAAATCTGAG-3' | (SEQ ID NO: 5081) |
| βc-2817 21 nt Target: | 5'-TGATCACATAACAACCAGAAA-3' | (SEQ ID NO: 5082) |
| βc-2818 21 nt Target: | 5'-ATGATCACATAACAACCAGAA-3' | (SEQ ID NO: 5083) |
| βc-2824 21 nt Target: | 5'-CCACACATGATCACATAACAA-3' | (SEQ ID NO: 5084) |
| βc-2827 21 nt Target: | 5'-CTTCCACACATGATCACATAA-3' | (SEQ ID NO: 5085) |
| βc-2832 21 nt Target: | 5'-AATAACTTCCACACATGATCA-3' | (SEQ ID NO: 5086) |
| βc-2833 21 nt Target: | 5'-TAATAACTTCCACACATGATC-3' | (SEQ ID NO: 5087) |
| βc-2834 21 nt Target: | 5'-TTAATAACTTCCACACATGAT-3' | (SEQ ID NO: 5088) |
| βc-2835 21 nt Target: | 5'-GTTAATAACTTCCACACATGA-3' | (SEQ ID NO: 5089) |
| βc-2842 21 nt Target: | 5'-CATTAAAGTTAATAACTTCCA-3' | (SEQ ID NO: 5090) |
| βc-2843 21 nt Target: | 5'-ACATTAAAGTTAATAACTTCC-3' | (SEQ ID NO: 5091) |
| βc-2845 21 nt Target: | 5'-AAACATTAAAGTTAATAACTT-3' | (SEQ ID NO: 5092) |
| βc-2846 21 nt Target: | 5'-AAAACATTAAAGTTAATAACT-3' | (SEQ ID NO: 5093) |
| βc-2847 21 nt Target: | 5'-AAAAACATTAAAGTTAATAAC-3' | (SEQ ID NO: 5094) |
| βc-2848 21 nt Target: | 5'-AAAAAACATTAAAGTTAATAA-3' | (SEQ ID NO: 5095) |
| βc-2849 21 nt Target: | 5'-CAAAAAACATTAAAGTTAATA-3' | (SEQ ID NO: 5096) |
| βc-2850 21 nt Target: | 5'-GCAAAAAACATTAAAGTTAAT-3' | (SEQ ID NO: 5097) |
| βc-2852 21 nt Target: | 5'-TGGCAAAAAACATTAAAGTTA-3' | (SEQ ID NO: 5098) |
| βc-2853 21 nt Target: | 5'-GTGGCAAAAAACATTAAAGTT-3' | (SEQ ID NO: 5099) |
| βc-2864 21 nt Target: | 5'-TTGCAAAAGCTGTGGCAAAAA-3' | (SEQ ID NO: 5100) |
| βc-2865 21 nt Target: | 5'-GTTGCAAAAGCTGTGGCAAAA-3' | (SEQ ID NO: 5101) |
| βc-2882 21 nt Target: | 5'-ACTCATTTGAGTATTAAGTTG-3' | (SEQ ID NO: 5102) |
| βc-2899 21 nt Target: | 5'-TTAAAACAGCAAATGTTACTC-3' | (SEQ ID NO: 5103) |
| βc-2900 21 nt Target: | 5'-TTTAAAACAGCAAATGTTACT-3' | (SEQ ID NO: 5104) |
| βc-2901 21 nt Target: | 5'-GTTTAAAACAGCAAATGTTAC-3' | (SEQ ID NO: 5105) |
| βc-2902 21 nt Target: | 5'-TGTTTAAAACAGCAAATGTTA-3' | (SEQ ID NO: 5106) |

TABLE 10-continued

21 Nucleotide Target Sequences of Additional Selected DsiRNAs

| | | |
|---|---|---|
| βc-2903 21 nt Target: | 5'-ATGTTTAAAACAGCAAATGTT-3' | (SEQ ID NO: 5107) |
| βc-2904 21 nt Target: | 5'-AATGTTTAAAACAGCAAATGT-3' | (SEQ ID NO: 5108) |
| βc-2909 21 nt Target: | 5'-CTATTAATGTTTAAAACAGCA-3' | (SEQ ID NO: 5109) |
| βc-2921 21 nt Target: | 5'-AGAGAAAGGCTGCTATTAATG-3' | (SEQ ID NO: 5110) |
| βc-2949 21 nt Target: | 5'-CAAGTTCAGACAATACAGCTG-3' | (SEQ ID NO: 5111) |
| βc-2957 21 nt Target: | 5'-TCACAATGCAAGTTCAGACAA-3' | (SEQ ID NO: 5112) |
| βc-2959 21 nt Target: | 5'-AATCACAATGCAAGTTCAGAC-3' | (SEQ ID NO: 5113) |
| βc-2961 21 nt Target: | 5'-CCAATCACAATGCAAGTTCAG-3' | (SEQ ID NO: 5114) |
| βc-2965 21 nt Target: | 5'-CAGGCCAATCACAATGCAAGT-3' | (SEQ ID NO: 5115) |
| βc-3052 21 nt Target: | 5'-TTGTTCCCATAGGAAACTCAG-3' | (SEQ ID NO: 5116) |
| βc-3058 21 nt Target: | 5'-CTTCAATTGTTCCCATAGGAA-3' | (SEQ ID NO: 5117) |
| βc-3059 21 nt Target: | 5'-ACTTCAATTGTTCCCATAGGA-3' | (SEQ ID NO: 5118) |
| βc-3065 21 nt Target: | 5'-AAGTTTACTTCAATTGTTCCC-3' | (SEQ ID NO: 5119) |
| βc-3066 21 nt Target: | 5'-AAAGTTTACTTCAATTGTTCC-3' | (SEQ ID NO: 5120) |
| βc-3070 21 nt Target: | 5'-ACAAAAGTTTACTTCAATTG-3' | (SEQ ID NO: 5121) |
| βc-3074 21 nt Target: | 5'-CAGAACAAAAGTTTACTTCA-3' | (SEQ ID NO: 5122) |
| βc-3079 21 nt Target: | 5'-AGGACCAGAACAAAAAGTTTA-3' | (SEQ ID NO: 5123) |
| βc-3080 21 nt Target: | 5'-AAGGACCAGAACAAAAAGTTT-3' | (SEQ ID NO: 5124) |
| βc-3088 21 nt Target: | 5'-CGACCAAAAAGGACCAGAACA-3' | (SEQ ID NO: 5125) |
| βc-3089 21 nt Target: | 5'-TCGACCAAAAAGGACCAGAAC-3' | (SEQ ID NO: 5126) |
| βc-3096 21 nt Target: | 5'-TTACTCCTCGACCAAAAAGGA-3' | (SEQ ID NO: 5127) |
| βc-3111 21 nt Target: | 5'-AATCCATTTGTATTGTTACTC-3' | (SEQ ID NO: 5128) |
| βc-3112 21 nt Target: | 5'-AAATCCATTTGTATTGTTACT-3' | (SEQ ID NO: 5129) |
| βc-3113 21 nt Target: | 5'-AAAATCCATTTGTATTGTTAC-3' | (SEQ ID NO: 5130) |
| βc-3114 21 nt Target: | 5'-CAAAATCCATTTGTATTGTTA-3' | (SEQ ID NO: 5131) |
| βc-3115 21 nt Target: | 5'-CCAAAATCCATTTGTATTGTT-3' | (SEQ ID NO: 5132) |
| βc-3121 21 nt Target: | 5'-TCACTCCCAAAATCCATTTGT-3' | (SEQ ID NO: 5133) |
| βc-3136 21 nt Target: | 5'-TCTTCACTTCTTGAGTCACTC-3' | (SEQ ID NO: 5134) |
| βc-3138 21 nt Target: | 5'-ATTCTTCACTTCTTGAGTCAC-3' | (SEQ ID NO: 5135) |
| βc-3139 21 nt Target: | 5'-CATTCTTCACTTCTTGAGTCA-3' | (SEQ ID NO: 5136) |
| βc-3140 21 nt Target: | 5'-GCATTCTTCACTTCTTGAGTC-3' | (SEQ ID NO: 5137) |
| βc-3142 21 nt Target: | 5'-GTGCATTCTTCACTTCTTGAG-3' | (SEQ ID NO: 5138) |
| βc-3150 21 nt Target: | 5'-CCATTCTTGTGCATTCTTCAC-3' | (SEQ ID NO: 5139) |
| βc-3153 21 nt Target: | 5'-GATCCATTCTTGTGCATTCTT-3' | (SEQ ID NO: 5140) |
| βc-3154 21 nt Target: | 5'-TGATCCATTCTTGTGCATTCT-3' | (SEQ ID NO: 5141) |
| βc-3155 21 nt Target: | 5'-GTGATCCATTCTTGTGCATTC-3' | (SEQ ID NO: 5142) |
| βc-3168 21 nt Target: | 5'-TAAATTCCATCTTGTGATCCA-3' | (SEQ ID NO: 5143) |
| βc-3170 21 nt Target: | 5'-GATAAATTCCATCTTGTGATC-3' | (SEQ ID NO: 5144) |
| βc-3171 21 nt Target: | 5'-TGATAAATTCCATCTTGTGAT-3' | (SEQ ID NO: 5145) |

TABLE 10-continued

21 Nucleotide Target Sequences of Additional Selected DsiRNAs

| | | |
|---|---|---|
| βc-3172 21 nt Target: | 5'-TTGATAAATTCCATCTTGTGA-3' | (SEQ ID NO: 5146) |
| βc-3173 21 nt Target: | 5'-TTTGATAAATTCCATCTTGTG-3' | (SEQ ID NO: 5147) |
| βc-3183 21 nt Target: | 5'-AAGGCTAGGGTTTGATAAATT-3' | (SEQ ID NO: 5148) |
| βc-3200 21 nt Target: | 5'-AAAAAAATTTAACAAGCAAGG-3' | (SEQ ID NO: 5149) |
| βc-3209 21 nt Target: | 5'-AAAAAAAAAAAAAAATTTAA-3' | (SEQ ID NO: 5150) |
| βc-3210 21 nt Target: | 5'-AAAAAAAAAAAAAAAATTTA-3' | (SEQ ID NO: 5151) |
| βc-3211 21 nt Target: | 5'-AAAAAAAAAAAAAAAAATTT-3' | (SEQ ID NO: 5152) |
| βc-3212 21 nt Target: | 5'-AAAAAAAAAAAAAAAAAATT-3' | (SEQ ID NO: 5153) |
| βc-3213 21 nt Target: | 5'-TAAAAAAAAAAAAAAAAAAT-3' | (SEQ ID NO: 5154) |
| βc-3214 21 nt Target: | 5'-TTAAAAAAAAAAAAAAAAAA-3' | (SEQ ID NO: 5155) |
| βc-3215 21 nt Target: | 5'-CTTAAAAAAAAAAAAAAAAA-3' | (SEQ ID NO: 5156) |
| βc-3216 21 nt Target: | 5'-TCTTAAAAAAAAAAAAAAAA-3' | (SEQ ID NO: 5157) |
| βc-3218 21 nt Target: | 5'-ATTCTTAAAAAAAAAAAAAA-3' | (SEQ ID NO: 5158) |
| βc-3219 21 nt Target: | 5'-TATTCTTAAAAAAAAAAAAA-3' | (SEQ ID NO: 5159) |
| βc-3220 21 nt Target: | 5'-ATATTCTTAAAAAAAAAAAA-3' | (SEQ ID NO: 5160) |
| βc-3221 21 nt Target: | 5'-GATATTCTTAAAAAAAAAAA-3' | (SEQ ID NO: 5161) |
| βc-3222 21 nt Target: | 5'-AGATATTCTTAAAAAAAAAA-3' | (SEQ ID NO: 5162) |
| βc-3223 21 nt Target: | 5'-CAGATATTCTTAAAAAAAAA-3' | (SEQ ID NO: 5163) |
| βc-3224 21 nt Target: | 5'-ACAGATATTCTTAAAAAAAA-3' | (SEQ ID NO: 5164) |
| βc-3228 21 nt Target: | 5'-CATTACAGATATTCTTAAAAA-3' | (SEQ ID NO: 5165) |
| βc-3229 21 nt Target: | 5'-CCATTACAGATATTCTTAAAA-3' | (SEQ ID NO: 5166) |
| βc-3233 21 nt Target: | 5'-AGTACCATTACAGATATTCTT-3' | (SEQ ID NO: 5167) |
| βc-3234 21 nt Target: | 5'-CAGTACCATTACAGATATTCT-3' | (SEQ ID NO: 5168) |
| βc-3235 21 nt Target: | 5'-TCAGTACCATTACAGATATTC-3' | (SEQ ID NO: 5169) |
| βc-3239 21 nt Target: | 5'-AAAGTCAGTACCATTACAGAT-3' | (SEQ ID NO: 5170) |
| βc-3256 21 nt Target: | 5'-GCTACTTCAAAGCAAGCAAAG-3' | (SEQ ID NO: 5171) |
| βc-3265 21 nt Target: | 5'-AAAAAAGAGCTACTTCAAAG-3' | (SEQ ID NO: 5172) |
| βc-3270 21 nt Target: | 5'-AAAAAAAAAAAGAGCTACTT-3' | (SEQ ID NO: 5173) |
| βc-3271 21 nt Target: | 5'-AAAAAAAAAAAAGAGCTACT-3' | (SEQ ID NO: 5174) |
| βc-3273 21 nt Target: | 5'-AAAAAAAAAAAAAAGAGCTA-3' | (SEQ ID NO: 5175) |
| βc-3274 21 nt Target: | 5'-AAAAAAAAAAAAAAAGAGCT-3' | (SEQ ID NO: 5176) |
| βc-3275 21 nt Target: | 5'-AAAAAAAAAAAAAAAAGAGC-3' | (SEQ ID NO: 5177) |
| βc-3276 21 nt Target: | 5'-AAAAAAAAAAAAAAAAAGAG-3' | (SEQ ID NO: 5178) |
| βc-3282 21 nt Target: | 5'-AAAAAAAAAAAAAAAAAAAA-3' | (SEQ ID NO: 5179) |
| βc-3283 21 nt Target: | 5'-AAAAAAAAAAAAAAAAAAAA-3' | (SEQ ID NO: 5180) |
| βc-3284 21 nt Target: | 5'-CAAAAAAAAAAAAAAAAAAA-3' | (SEQ ID NO: 5181) |
| βc-3285 21 nt Target: | 5'-GCAAAAAAAAAAAAAAAAAA-3' | (SEQ ID NO: 5182) |
| βc-3287 21 nt Target: | 5'-CTGCAAAAAAAAAAAAAAAA-3' | (SEQ ID NO: 5183) |
| βc-3288 21 nt Target: | 5'-ACTGCAAAAAAAAAAAAAAA-3' | (SEQ ID NO: 5184) |

TABLE 10-continued

21 Nucleotide Target Sequences of Additional Selected DsiRNAs

| | | |
|---|---|---|
| βc-3292 21 nt Target: | 5'-AGTTACTGCAAAAAAAAAAA-3' | (SEQ ID NO: 5185) |
| βc-3293 21 nt Target: | 5'-CAGTTACTGCAAAAAAAAAA-3' | (SEQ ID NO: 5186) |
| βc-3294 21 nt Target: | 5'-ACAGTTACTGCAAAAAAAAA-3' | (SEQ ID NO: 5187) |
| βc-3298 21 nt Target: | 5'-AAAAACAGTTACTGCAAAAA-3' | (SEQ ID NO: 5188) |
| βc-3299 21 nt Target: | 5'-AAAAAACAGTTACTGCAAAA-3' | (SEQ ID NO: 5189) |
| βc-3300 21 nt Target: | 5'-TAAAAAACAGTTACTGCAAA-3' | (SEQ ID NO: 5190) |
| βc-3302 21 nt Target: | 5'-CTTAAAAAACAGTTACTGCAA-3' | (SEQ ID NO: 5191) |
| βc-3303 21 nt Target: | 5'-ACTTAAAAAACAGTTACTGCA-3' | (SEQ ID NO: 5192) |
| βc-3305 21 nt Target: | 5'-AGACTTAAAAAACAGTTACTG-3' | (SEQ ID NO: 5193) |
| βc-3315 21 nt Target: | 5'-ACACTACGAGAGACTTAAAAA-3' | (SEQ ID NO: 5194) |
| βc-3317 21 nt Target: | 5'-TAACACTACGAGAGACTTAAA-3' | (SEQ ID NO: 5195) |
| βc-3318 21 nt Target: | 5'-TTAACACTACGAGAGACTTAA-3' | (SEQ ID NO: 5196) |
| βc-3320 21 nt Target: | 5'-ACTTAACACTACGAGAGACTT-3' | (SEQ ID NO: 5197) |
| βc-3323 21 nt Target: | 5'-ATAACTTAACACTACGAGAGA-3' | (SEQ ID NO: 5198) |
| βc-3324 21 nt Target: | 5'-TATAACTTAACACTACGAGAG-3' | (SEQ ID NO: 5199) |
| βc-3332 21 nt Target: | 5'-GTATTCACTATAACTTAACAC-3' | (SEQ ID NO: 5200) |
| βc-3333 21 nt Target: | 5'-AGTATTCACTATAACTTAACA-3' | (SEQ ID NO: 5201) |
| βc-3334 21 nt Target: | 5'-CAGTATTCACTATAACTTAAC-3' | (SEQ ID NO: 5202) |
| βc-3335 21 nt Target: | 5'-GCAGTATTCACTATAACTTAA-3' | (SEQ ID NO: 5203) |
| βc-3348 21 nt Target: | 5'-AGAAATTGCTGTAGCAGTATT-3' | (SEQ ID NO: 5204) |
| βc-3349 21 nt Target: | 5'-TAGAAATTGCTGTAGCAGTAT-3' | (SEQ ID NO: 5205) |
| βc-3350 21 nt Target: | 5'-TTAGAAATTGCTGTAGCAGTA-3' | (SEQ ID NO: 5206) |
| βc-3366 21 nt Target: | 5'-ACTCAATTCTTAAAAATTAGA-3' | (SEQ ID NO: 5207) |
| βc-3371 21 nt Target: | 5'-CCATTACTCAATTCTTAAAAA-3' | (SEQ ID NO: 5208) |
| βc-3374 21 nt Target: | 5'-ACACCATTACTCAATTCTTAA-3' | (SEQ ID NO: 5209) |
| βc-3376 21 nt Target: | 5'-CTACACCATTACTCAATTCTT-3' | (SEQ ID NO: 5210) |
| βc-3377 21 nt Target: | 5'-TCTACACCATTACTCAATTCT-3' | (SEQ ID NO: 5211) |
| βc-3379 21 nt Target: | 5'-GTTCTACACCATTACTCAATT-3' | (SEQ ID NO: 5212) |
| βc-3381 21 nt Target: | 5'-GTGTTCTACACCATTACTCAA-3' | (SEQ ID NO: 5213) |
| βc-3389 21 nt Target: | 5'-ATGAATTAGTGTTCTACACCA-3' | (SEQ ID NO: 5214) |
| βc-3394 21 nt Target: | 5'-TGATTATGAATTAGTGTTCTA-3' | (SEQ ID NO: 5215) |
| βc-3395 21 nt Target: | 5'-GTGATTATGAATTAGTGTTCT-3' | (SEQ ID NO: 5216) |
| βc-3396 21 nt Target: | 5'-AGTGATTATGAATTAGTGTTC-3' | (SEQ ID NO: 5217) |
| βc-3405 21 nt Target: | 5'-ATTAATTAGAGTGATTATGAA-3' | (SEQ ID NO: 5218) |
| βc-3406 21 nt Target: | 5'-AATTAATTAGAGTGATTATGA-3' | (SEQ ID NO: 5219) |
| βc-3407 21 nt Target: | 5'-CAATTAATTAGAGTGATTATG-3' | (SEQ ID NO: 5220) |
| βc-3411 21 nt Target: | 5'-ATTACAATTAATTAGAGTGAT-3' | (SEQ ID NO: 5221) |
| βc-3412 21 nt Target: | 5'-GATTACAATTAATTAGAGTGA-3' | (SEQ ID NO: 5222) |
| βc-3413 21 nt Target: | 5'-AGATTACAATTAATTAGAGTG-3' | (SEQ ID NO: 5223) |

TABLE 10-continued

21 Nucleotide Target Sequences of Additional Selected DsiRNAs

| | | |
|---|---|---|
| βc-3421 21 nt Target: | 5'-CTTTATTCAGATTACAATTAA-3' | (SEQ ID NO: 5224) |
| βc-3422 21 nt Target: | 5'-ACTTTATTCAGATTACAATTA-3' | (SEQ ID NO: 5225) |
| βc-3426 21 nt Target: | 5'-TTACACTTTATTCAGATTACA-3' | (SEQ ID NO: 5226) |
| βc-3427 21 nt Target: | 5'-GTTACACTTTATTCAGATTAC-3' | (SEQ ID NO: 5227) |
| βc-3428 21 nt Target: | 5'-TGTTACACTTTATTCAGATTA-3' | (SEQ ID NO: 5228) |
| βc-3429 21 nt Target: | 5'-TTGTTACACTTTATTCAGATT-3' | (SEQ ID NO: 5229) |
| βc-3430 21 nt Target: | 5'-ATTGTTACACTTTATTCAGAT-3' | (SEQ ID NO: 5230) |
| βc-3437 21 nt Target: | 5'-CTACACAATTGTTACACTTTA-3' | (SEQ ID NO: 5231) |
| βc-3441 21 nt Target: | 5'-AAGGCTACACAATTGTTACAC-3' | (SEQ ID NO: 5232) |
| βc-3446 21 nt Target: | 5'-ACAAAAAGGCTACACAATTGT-3' | (SEQ ID NO: 5233) |
| βc-3452 21 nt Target: | 5'-TTTTATACAAAAGGCTACAC-3' | (SEQ ID NO: 5234) |
| βc-3453 21 nt Target: | 5'-ATTTTATACAAAAGGCTACA-3' | (SEQ ID NO: 5235) |
| βc-3455 21 nt Target: | 5'-CTATTTTATACAAAAGGCTA-3' | (SEQ ID NO: 5236) |
| βc-3456 21 nt Target: | 5'-TCTATTTTATACAAAAGGCT-3' | (SEQ ID NO: 5237) |
| βc-3458 21 nt Target: | 5'-TGTCTATTTTATACAAAAGG-3' | (SEQ ID NO: 5238) |
| βc-3464 21 nt Target: | 5'-TCTATTTGTCTATTTTATACA-3' | (SEQ ID NO: 5239) |
| βc-3466 21 nt Target: | 5'-TTTCTATTTGTCTATTTTATA-3' | (SEQ ID NO: 5240) |
| βc-3467 21 nt Target: | 5'-TTTTCTATTTGTCTATTTTAT-3' | (SEQ ID NO: 5241) |
| βc-3468 21 nt Target: | 5'-ATTTTCTATTTGTCTATTTTA-3' | (SEQ ID NO: 5242) |
| βc-3469 21 nt Target: | 5'-CATTTTCTATTTGTCTATTTT-3' | (SEQ ID NO: 5243) |
| βc-3470 21 nt Target: | 5'-CCATTTTCTATTTGTCTATTT-3' | (SEQ ID NO: 5244) |
| βc-3473 21 nt Target: | 5'-GGACCATTTTCTATTTGTCTA-3' | (SEQ ID NO: 5245) |
| βc-3474 21 nt Target: | 5'-TGGACCATTTTCTATTTGTCT-3' | (SEQ ID NO: 5246) |
| βc-3475 21 nt Target: | 5'-TTGGACCATTTTCTATTTGTC-3' | (SEQ ID NO: 5247) |
| βc-3482 21 nt Target: | 5'-AAACTAATTGGACCATTTTCT-3' | (SEQ ID NO: 5248) |
| βc-3483 21 nt Target: | 5'-GAAACTAATTGGACCATTTTC-3' | (SEQ ID NO: 5249) |
| βc-3484 21 nt Target: | 5'-GGAAACTAATTGGACCATTTT-3' | (SEQ ID NO: 5250) |
| βc-3485 21 nt Target: | 5'-AGGAAACTAATTGGACCATTT-3' | (SEQ ID NO: 5251) |
| βc-3491 21 nt Target: | 5'-TTAAAAGGAAACTAATTGGA-3' | (SEQ ID NO: 5252) |
| βc-3492 21 nt Target: | 5'-ATTAAAAGGAAACTAATTGG-3' | (SEQ ID NO: 5253) |
| βc-3498 21 nt Target: | 5'-AAGCATATTAAAAGGAAACT-3' | (SEQ ID NO: 5254) |
| βc-3499 21 nt Target: | 5'-TAAGCATATTAAAAGGAAAC-3' | (SEQ ID NO: 5255) |
| βc-3503 21 nt Target: | 5'-ATTTTAAGCATATTAAAAGG-3' | (SEQ ID NO: 5256) |
| βc-3509 21 nt Target: | 5'-CTGCTTATTTTAAGCATATTA-3' | (SEQ ID NO: 5257) |
| βc-3510 21 nt Target: | 5'-CCTGCTTATTTTAAGCATATT-3' | (SEQ ID NO: 5258) |
| βc-3516 21 nt Target: | 5'-GATCCACCTGCTTATTTTAAG-3' | (SEQ ID NO: 5259) |
| βc-3531 21 nt Target: | 5'-CAAAAACATGAAATAGATCCA-3' | (SEQ ID NO: 5260) |
| βc-3532 21 nt Target: | 5'-TCAAAAACATGAAATAGATCC-3' | (SEQ ID NO: 5261) |
| βc-3534 21 nt Target: | 5'-GATCAAAAACATGAAATAGAT-3' | (SEQ ID NO: 5262) |

TABLE 10-continued

21 Nucleotide Target Sequences of Additional Selected DsiRNAs

| | | |
|---|---|---|
| βc-3535 21 nt Target: | 5'-TGATCAAAAACATGAAATAGA-3' | (SEQ ID NO: 5263) |
| βc-3536 21 nt Target: | 5'-TTGATCAAAAACATGAAATAG-3' | (SEQ ID NO: 5264) |
| βc-3541 21 nt Target: | 5'-AGTTTTTGATCAAAAACATGA-3' | (SEQ ID NO: 5265) |
| βc-3547 21 nt Target: | 5'-CCAAATAGTTTTTGATCAAAA-3' | (SEQ ID NO: 5266) |
| βc-3551 21 nt Target: | 5'-TATCCCAAATAGTTTTTGATC-3' | (SEQ ID NO: 5267) |
| βc-3552 21 nt Target: | 5'-ATATCCCAAATAGTTTTTGAT-3' | (SEQ ID NO: 5268) |
| βc-3553 21 nt Target: | 5'-CATATCCCAAATAGTTTTTGA-3' | (SEQ ID NO: 5269) |
| βc-3554 21 nt Target: | 5'-ACATATCCCAAATAGTTTTTG-3' | (SEQ ID NO: 5270) |
| βc-3558 21 nt Target: | 5'-CCATACATATCCCAAATAGTT-3' | (SEQ ID NO: 5271) |
| βc-3567 21 nt Target: | 5'-TTACCCTACCCATACATATCC-3' | (SEQ ID NO: 5272) |
| βc-3568 21 nt Target: | 5'-TTTACCCTACCCATACATATC-3' | (SEQ ID NO: 5273) |
| βc-3569 21 nt Target: | 5'-ATTTACCCTACCCATACATAT-3' | (SEQ ID NO: 5274) |
| βc-3582 21 nt Target: | 5'-ACACCTCTTACTGATTTACCC-3' | (SEQ ID NO: 5275) |
| βc-3584 21 nt Target: | 5'-TAACACCTCTTACTGATTTAC-3' | (SEQ ID NO: 5276) |
| βc-3585 21 nt Target: | 5'-ATAACACCTCTTACTGATTTA-3' | (SEQ ID NO: 5277) |
| βc-3586 21 nt Target: | 5'-AATAACACCTCTTACTGATTT-3' | (SEQ ID NO: 5278) |
| βc-3587 21 nt Target: | 5'-AAATAACACCTCTTACTGATT-3' | (SEQ ID NO: 5279) |
| βc-3588 21 nt Target: | 5'-CAAATAACACCTCTTACTGAT-3' | (SEQ ID NO: 5280) |
| βc-3594 21 nt Target: | 5'-AGGTTCCAAATAACACCTCTT-3' | (SEQ ID NO: 5281) |
| βc-3600 21 nt Target: | 5'-AAAACAAGGTTCCAAATAACA-3' | (SEQ ID NO: 5282) |
| βc-3601 21 nt Target: | 5'-CAAAACAAGGTTCCAAATAAC-3' | (SEQ ID NO: 5283) |
| βc-3602 21 nt Target: | 5'-CCAAAACAAGGTTCCAAATAA-3' | (SEQ ID NO: 5284) |
| βc-3607 21 nt Target: | 5'-ACTGTCCAAAACAAGGTTCCA-3' | (SEQ ID NO: 5285) |
| βc-3611 21 nt Target: | 5'-GTAAACTGTCCAAAACAAGGT-3' | (SEQ ID NO: 5286) |
| βc-3612 21 nt Target: | 5'-GGTAAACTGTCCAAAACAAGG-3' | (SEQ ID NO: 5287) |
| βc-3620 21 nt Target: | 5'-AGGCAACTGGTAAACTGTCCA-3' | (SEQ ID NO: 5288) |
| βc-3628 21 nt Target: | 5'-GGGATAAAAGGCAACTGGTAA-3' | (SEQ ID NO: 5289) |
| βc-3629 21 nt Target: | 5'-TGGGATAAAAGGCAACTGGTA-3' | (SEQ ID NO: 5290) |
| βc-3636 21 nt Target: | 5'-ACAACTTTGGGATAAAAGGCA-3' | (SEQ ID NO: 5291) |
| βc-3638 21 nt Target: | 5'-CAACAACTTTGGGATAAAAGG-3' | (SEQ ID NO: 5292) |
| βc-3643 21 nt Target: | 5'-GGTTACAACAACTTTGGGATA-3' | (SEQ ID NO: 5293) |
| βc-3644 21 nt Target: | 5'-AGGTTACAACAACTTTGGGAT-3' | (SEQ ID NO: 5294) |
| βc-3645 21 nt Target: | 5'-CAGGTTACAACAACTTTGGGA-3' | (SEQ ID NO: 5295) |
| βc-3653 21 nt Target: | 5'-TATCACAGCAGGTTACAACAA-3' | (SEQ ID NO: 5296) |
| βc-3654 21 nt Target: | 5'-GTATCACAGCAGGTTACAACA-3' | (SEQ ID NO: 5297) |
| βc-3656 21 nt Target: | 5'-TCGTATCACAGCAGGTTACAA-3' | (SEQ ID NO: 5298) |
| βc-3670 21 nt Target: | 5'-TTTCTCTTGAAGCATCGTATC-3' | (SEQ ID NO: 5299) |
| βc-3671 21 nt Target: | 5'-TTTTCTCTTGAAGCATCGTAT-3' | (SEQ ID NO: 5300) |
| βc-3673 21 nt Target: | 5'-CATTTTCTCTTGAAGCATCGT-3' | (SEQ ID NO: 5301) |

TABLE 10-continued

21 Nucleotide Target Sequences of Additional Selected DsiRNAs

| | | |
|---|---|---|
| βc-3686 21 nt Target: | 5'-TTTTTTATAACCGCATTTTCT-3' | (SEQ ID NO: 5302) |
| βc-3687 21 nt Target: | 5'-ATTTTTTATAACCGCATTTTC-3' | (SEQ ID NO: 5303) |
| βc-3688 21 nt Target: | 5'-CATTTTTTATAACCGCATTTT-3' | (SEQ ID NO: 5304) |
| βc-3689 21 nt Target: | 5'-CCATTTTTTATAACCGCATTT-3' | (SEQ ID NO: 5305) |
| βc-3694 21 nt Target: | 5'-CTGAACCATTTTTTATAACCG-3' | (SEQ ID NO: 5306) |
| βc-3699 21 nt Target: | 5'-TAATTCTGAACCATTTTTTAT-3' | (SEQ ID NO: 5307) |
| βc-3700 21 nt Target: | 5'-TTAATTCTGAACCATTTTTTA-3' | (SEQ ID NO: 5308) |
| βc-3701 21 nt Target: | 5'-TTTAATTCTGAACCATTTTTT-3' | (SEQ ID NO: 5309) |
| βc-3702 21 nt Target: | 5'-GTTTAATTCTGAACCATTTTT-3' | (SEQ ID NO: 5310) |
| βc-3703 21 nt Target: | 5'-AGTTTAATTCTGAACCATTTT-3' | (SEQ ID NO: 5311) |
| βc-3704 21 nt Target: | 5'-AAGTTTAATTCTGAACCATTT-3' | (SEQ ID NO: 5312) |
| βc-3709 21 nt Target: | 5'-ATTAAAAGTTTAATTCTGAAC-3' | (SEQ ID NO: 5313) |
| βc-3710 21 nt Target: | 5'-AATTAAAAGTTTAATTCTGAA-3' | (SEQ ID NO: 5314) |
| βc-3712 21 nt Target: | 5'-TGAATTAAAAGTTTAATTCTG-3' | (SEQ ID NO: 5315) |
| βc-2634t2 21 nt Target: | 5'-CAATACAGCTAAAGGATGATT-3' | (SEQ ID NO: 5316) |
| βc-2635t2 21 nt Target: | 5'-ACAATACAGCTAAAGGATGAT-3' | (SEQ ID NO: 5317) |
| βc-2637t2 21 nt Target: | 5'-AGACAATACAGCTAAAGGATG-3' | (SEQ ID NO: 5318) |
| βc-2633t3 21 nt Target: | 5'-GTTACTCCTAAAGGATGATTT-3' | (SEQ ID NO: 5319) |
| βc-2634t3 21 nt Target: | 5'-TGTTACTCCTAAAGGATGATT-3' | (SEQ ID NO: 5320) |
| βc-2635t3 21 nt Target: | 5'-TTGTTACTCCTAAAGGATGAT-3' | (SEQ ID NO: 5321) |
| βc-2636t3 21 nt Target: | 5'-ATTGTTACTCCTAAAGGATGA-3' | (SEQ ID NO: 5322) |
| βc-m318 21 nt Target: | 5'-GGATTCCAGAATCCAAGTAAG-3' | (SEQ ID NO: 5323) |
| βc-m417 21 nt Target: | 5'-CTTGCTCCCATTCATAAAGGA-3' | (SEQ ID NO: 5324) |
| βc-m462 21 nt Target: | 5'-CGTCAATATCAGCTACTTGCT-3' | (SEQ ID NO: 5325) |
| βc-m463 21 nt Target: | 5'-CCGTCAATATCAGCTACTTGC-3' | (SEQ ID NO: 5326) |
| βc-m468 21 nt Target: | 5'-ACTGCCCGTCAATATCAGCTA-3' | (SEQ ID NO: 5327) |
| βc-m613 21 nt Target: | 5'-TGTTTCAACATCTGTGATGGT-3' | (SEQ ID NO: 5328) |
| βc-m614 21 nt Target: | 5'-ATGTTTCAACATCTGTGATGG-3' | (SEQ ID NO: 5329) |
| βc-m624 21 nt Target: | 5'-TGACAACTGCATGTTTCAACA-3' | (SEQ ID NO: 5330) |
| βc-m626 21 nt Target: | 5'-ATTGACAACTGCATGTTTCAA-3' | (SEQ ID NO: 5331) |
| βc-m630 21 nt Target: | 5'-TCAAATTGACAACTGCATGTT-3' | (SEQ ID NO: 5332) |
| βc-m636 21 nt Target: | 5'-AGTTAATCAAATTGACAACTG-3' | (SEQ ID NO: 5333) |
| βc-m642 21 nt Target: | 5'-CCTGATAGTTAATCAAATTGA-3' | (SEQ ID NO: 5334) |
| βc-m648 21 nt Target: | 5'-CGTCATCCTGATAGTTAATCA-3' | (SEQ ID NO: 5335) |
| βc-m649 21 nt Target: | 5'-GCGTCATCCTGATAGTTAATC-3' | (SEQ ID NO: 5336) |
| βc-m702 21 nt Target: | 5'-CCTCATCGTTTAGCAGTTTTG-3' | (SEQ ID NO: 5337) |
| βc-m707 21 nt Target: | 5'-CTGGTCCTCATCGTTTAGCAG-3' | (SEQ ID NO: 5338) |
| βc-m734 21 nt Target: | 5'-CATAACAGCAGCTTTATTAAC-3' | (SEQ ID NO: 5339) |
| βc-m735 21 nt Target: | 5'-CCATAACAGCAGCTTTATTAA-3' | (SEQ ID NO: 5340) |

TABLE 10-continued

21 Nucleotide Target Sequences of Additional Selected DsiRNAs

| | | |
|---|---|---|
| βc-m738 21 nt Target: | 5'-GGACCATAACAGCAGCTTTAT-3' | (SEQ ID NO: 5341) |
| βc-m739 21 nt Target: | 5'-TGGACCATAACAGCAGCTTTA-3' | (SEQ ID NO: 5342) |
| βc-m843 21 nt Target: | 5'-CTGTCTCTACATCATTTGTAT-3' | (SEQ ID NO: 5343) |
| βc-m844 21 nt Target: | 5'-GCTGTCTCTACATCATTTGTA-3' | (SEQ ID NO: 5344) |
| βc-m1063 21 nt Target: | 5'-GCAACCATTTTCTGCAGTCCA-3' | (SEQ ID NO: 5345) |
| βc-m1065 21 nt Target: | 5'-AAGCAACCATTTTCTGCAGTC-3' | (SEQ ID NO: 5346) |
| βc-m1080 21 nt Target: | 5'-TTGTTTTGTTGAGCAAAGCAA-3' | (SEQ ID NO: 5347) |
| βc-m1081 21 nt Target: | 5'-TTTGTTTTGTTGAGCAAAGCA-3' | (SEQ ID NO: 5348) |
| βc-m1098 21 nt Target: | 5'-TAGCCAAGAATTTCACGTTTG-3' | (SEQ ID NO: 5349) |
| βc-m1140 21 nt Target: | 5'-CTTGATTGCCATAAGCTAAGA-3' | (SEQ ID NO: 5350) |
| βc-m1145 21 nt Target: | 5'-GCTCTCTTGATTGCCATAAGC-3' | (SEQ ID NO: 5351) |
| βc-m1217 21 nt Target: | 5'-CTTCTCATAAGTGTAGGTCCT-3' | (SEQ ID NO: 5352) |
| βc-m1218 21 nt Target: | 5'-GCTTCTCATAAGTGTAGGTCC-3' | (SEQ ID NO: 5353) |
| βc-m1220 21 nt Target: | 5'-AAGCTTCTCATAAGTGTAGGT-3' | (SEQ ID NO: 5354) |
| βc-m1221 21 nt Target: | 5'-GAAGCTTCTCATAAGTGTAGG-3' | (SEQ ID NO: 5355) |
| βc-m1365 21 nt Target: | 5'-GAGTCCAAAGACAGTTTTGAA-3' | (SEQ ID NO: 5356) |
| βc-m1366 21 nt Target: | 5'-AGAGTCCAAAGACAGTTTTGA-3' | (SEQ ID NO: 5357) |
| βc-m1461 21 nt Target: | 5'-CCACATTTATATCATCGGAAC-3' | (SEQ ID NO: 5358) |
| βc-m1464 21 nt Target: | 5'-TGACCACATTTATATCATCGG-3' | (SEQ ID NO: 5359) |
| βc-m1473 21 nt Target: | 5'-CTGCACAGGTGACCACATTTA-3' | (SEQ ID NO: 5360) |
| βc-m1474 21 nt Target: | 5'-GCTGCACAGGTGACCACATTT-3' | (SEQ ID NO: 5361) |
| βc-m1510 21 nt Target: | 5'-TTGTAATTATTGCAAGTGAGG-3' | (SEQ ID NO: 5362) |
| βc-m1523 21 nt Target: | 5'-CATCATCTTGTTTTTGTAATT-3' | (SEQ ID NO: 5363) |
| βc-m1524 21 nt Target: | 5'-CCATCATCTTGTTTTTGTAAT-3' | (SEQ ID NO: 5364) |
| βc-m1527 21 nt Target: | 5'-ACACCATCATCTTGTTTTTGT-3' | (SEQ ID NO: 5365) |
| βc-m1532 21 nt Target: | 5'-TTGGCACACCATCATCTTGTT-3' | (SEQ ID NO: 5366) |
| βc-m1752 21 nt Target: | 5'-TCAATCCAACAGTTGCCTTTA-3' | (SEQ ID NO: 5367) |
| βc-m1757 21 nt Target: | 5'-TCGAATCAATCCAACAGTTGC-3' | (SEQ ID NO: 5368) |
| βc-m1827 21 nt Target: | 5'-GCTGAACTAGTCGTGGAATAG-3' | (SEQ ID NO: 5369) |
| βc-m1934 21 nt Target: | 5'-AGTACACCCTTCTACTATCTC-3' | (SEQ ID NO: 5370) |
| βc-m1935 21 nt Target: | 5'-CAGTACACCCTTCTACTATCT-3' | (SEQ ID NO: 5371) |
| βc-m1936 21 nt Target: | 5'-CCAGTACACCCTTCTACTATC-3' | (SEQ ID NO: 5372) |
| βc-m1941 21 nt Target: | 5'-GAGCTCCAGTACACCCTTCTA-3' | (SEQ ID NO: 5373) |
| βc-m2009 21 nt Target: | 5'-AAACAATGGAATGGTATTGAG-3' | (SEQ ID NO: 5374) |
| βc-m2015 21 nt Target: | 5'-CTGCACAAACAATGGAATGGT-3' | (SEQ ID NO: 5375) |
| βc-m2016 21 nt Target: | 5'-ACTGCACAAACAATGGAATGG-3' | (SEQ ID NO: 5376) |
| βc-m2021 21 nt Target: | 5'-AAGCAACTGCACAAACAATGG-3' | (SEQ ID NO: 5377) |
| βc-m2028 21 nt Target: | 5'-GAGAATAAAGCAACTGCACAA-3' | (SEQ ID NO: 5378) |
| βc-m2037 21 nt Target: | 5'-TTTCAATGGGAGAATAAAGCA-3' | (SEQ ID NO: 5379) |

TABLE 10-continued

21 Nucleotide Target Sequences of Additional Selected DsiRNAs

| | | |
|---|---|---|
| βc-m2038 21 nt Target: | 5'-TTTTCAATGGGAGAATAAAGC-3' | (SEQ ID NO: 5380) |
| βc-m2039 21 nt Target: | 5'-ATTTTCAATGGGAGAATAAAG-3' | (SEQ ID NO: 5381) |
| βc-m2043 21 nt Target: | 5'-GGATATTTTCAATGGGAGAAT-3' | (SEQ ID NO: 5382) |
| βc-m2044 21 nt Target: | 5'-TGGATATTTTCAATGGGAGAA-3' | (SEQ ID NO: 5383) |
| βc-m2045 21 nt Target: | 5'-TTGGATATTTTCAATGGGAGA-3' | (SEQ ID NO: 5384) |
| βc-m2055 21 nt Target: | 5'-CAGCTACTCTTTGGATATTTT-3' | (SEQ ID NO: 5385) |
| βc-m2056 21 nt Target: | 5'-GCAGCTACTCTTTGGATATTT-3' | (SEQ ID NO: 5386) |
| βc-m2231 21 nt Target: | 5'-CCGCTTCTTGTAATCCTGTGG-3' | (SEQ ID NO: 5387) |
| βc-m2307 21 nt Target: | 5'-CCAGTCCAAGATCTGCAGTCT-3' | (SEQ ID NO: 5388) |
| βc-m2385 21 nt Target: | 5'-CGTATCCACCAGAGTGAAAAG-3' | (SEQ ID NO: 5389) |
| βc-m2539 21 nt Target: | 5'-CAGGCCAGCTGATTGCTATCA-3' | (SEQ ID NO: 5390) |
| βc-m2562 21 nt Target: | 5'-CGATTTACAGGTCAGTATCAA-3' | (SEQ ID NO: 5391) |
| βc-m2563 21 nt Target: | 5'-ACGATTTACAGGTCAGTATCA-3' | (SEQ ID NO: 5392) |
| βc-m2578 21 nt Target: | 5'-TTTCTTACCTAAAGGACGATT-3' | (SEQ ID NO: 5393) |
| βc-m2580 21 nt Target: | 5'-GCTTTCTTACCTAAAGGACGA-3' | (SEQ ID NO: 5394) |
| βc-m2589 21 nt Target: | 5'-CTTTTATAAGCTTTCTTACCT-3' | (SEQ ID NO: 5395) |
| βc-m2590 21 nt Target: | 5'-GCTTTTATAAGCTTTCTTACC-3' | (SEQ ID NO: 5396) |
| βc-m2593 21 nt Target: | 5'-CTGGCTTTTATAAGCTTTCTT-3' | (SEQ ID NO: 5397) |
| βc-m2598 21 nt Target: | 5'-CCACACTGGCTTTTATAAGCT-3' | (SEQ ID NO: 5398) |
| βc-m2604 21 nt Target: | 5'-ATTCACCCACACTGGCTTTTA-3' | (SEQ ID NO: 5399) |
| βc-m2644 21 nt Target: | 5'-CCTACCAAGTCTTTCTGGAGT-3' | (SEQ ID NO: 5400) |
| βc-m2674 21 nt Target: | 5'-ATTTACAAACAGGCCTAAAAC-3' | (SEQ ID NO: 5401) |
| βc-m2675 21 nt Target: | 5'-GATTTACAAACAGGCCTAAAA-3' | (SEQ ID NO: 5402) |
| βc-m2676 21 nt Target: | 5'-AGATTTACAAACAGGCCTAAA-3' | (SEQ ID NO: 5403) |
| βc-m2710 21 nt Target: | 5'-CATCTCCTTCCAAGGTATGTA-3' | (SEQ ID NO: 5404) |
| βc-m2711 21 nt Target: | 5'-ACATCTCCTTCCAAGGTATGT-3' | (SEQ ID NO: 5405) |
| βc-m2725 21 nt Target: | 5'-ACTTCCACACATGAACATCTC-3' | (SEQ ID NO: 5406) |
| βc-m2728 21 nt Target: | 5'-GAAACTTCCACACATGAACAT-3' | (SEQ ID NO: 5407) |
| βc-m2729 21 nt Target: | 5'-AGAAACTTCCACACATGAACA-3' | (SEQ ID NO: 5408) |
| βc-m2730 21 nt Target: | 5'-GAGAAACTTCCACACATGAAC-3' | (SEQ ID NO: 5409) |
| βc-m2731 21 nt Target: | 5'-TGAGAAACTTCCACACATGAA-3' | (SEQ ID NO: 5410) |
| βc-m2739 21 nt Target: | 5'-CATCAACGTGAGAAACTTCCA-3' | (SEQ ID NO: 5411) |
| βc-m2742 21 nt Target: | 5'-AAACATCAACGTGAGAAACTT-3' | (SEQ ID NO: 5412) |
| βc-m2743 21 nt Target: | 5'-AAAACATCAACGTGAGAAACT-3' | (SEQ ID NO: 5413) |
| βc-m2744 21 nt Target: | 5'-AAAAACATCAACGTGAGAAAC-3' | (SEQ ID NO: 5414) |
| βc-m2745 21 nt Target: | 5'-CAAAAACATCAACGTGAGAAA-3' | (SEQ ID NO: 5415) |
| βc-m2746 21 nt Target: | 5'-GCAAAAACATCAACGTGAGAA-3' | (SEQ ID NO: 5416) |
| βc-m2748 21 nt Target: | 5'-TGGCAAAAACATCAACGTGAG-3' | (SEQ ID NO: 5417) |
| βc-m2760 21 nt Target: | 5'-CTGCAAAAGCTGTGGCAAAAA-3' | (SEQ ID NO: 5418) |

TABLE 10-continued

21 Nucleotide Target Sequences of Additional Selected DsiRNAs

| | | |
|---|---|---|
| βc-m2761 21 nt Target: | 5'-GCTGCAAAAGCTGTGGCAAAA-3' | (SEQ ID NO: 5419) |
| βc-m2778 21 nt Target: | 5'-ACTCATCTGAGTATAACGCTG-3' | (SEQ ID NO: 5420) |
| βc-m2795 21 nt Target: | 5'-TGAAAACAGCAAATGTTACTC-3' | (SEQ ID NO: 5421) |
| βc-m2796 21 nt Target: | 5'-TTGAAAACAGCAAATGTTACT-3' | (SEQ ID NO: 5422) |
| βc-m2797 21 nt Target: | 5'-GTTGAAAACAGCAAATGTTAC-3' | (SEQ ID NO: 5423) |
| βc-m2805 21 nt Target: | 5'-CTATTAATGTTGAAAACAGCA-3' | (SEQ ID NO: 5424) |
| βc-m2834 21 nt Target: | 5'-ACACTACAGCTGTATAGAGAG-3' | (SEQ ID NO: 5425) |
| βc-m2859 21 nt Target: | 5'-CAGGCCAATCACAATGCACGT-3' | (SEQ ID NO: 5426) |
| βc-m2946 21 nt Target: | 5'-CTGTTCCCATAGGAAACTCAG-3' | (SEQ ID NO: 5427) |
| βc-m2968 21 nt Target: | 5'-CAGAACAAAAGCGTACTTCG-3' | (SEQ ID NO: 5428) |
| βc-m2974 21 nt Target: | 5'-AAGGACCAGAACAAAAGCGT-3' | (SEQ ID NO: 5429) |
| βc-m2982 21 nt Target: | 5'-CGACCAAAAGGACCAGAACA-3' | (SEQ ID NO: 5430) |
| βc-m2983 21 nt Target: | 5'-TCGACCAAAAGGACCAGAAC-3' | (SEQ ID NO: 5431) |
| βc-m2990 21 nt Target: | 5'-TTACTCCTCGACCAAAAAGGA-3' | (SEQ ID NO: 5432) |
| βc-m3005 21 nt Target: | 5'-AATCCATTTGTATTGTTACTC-3' | (SEQ ID NO: 5433) |
| βc-m3006 21 nt Target: | 5'-AAATCCATTTGTATTGTTACT-3' | (SEQ ID NO: 5434) |
| βc-m3007 21 nt Target: | 5'-CAAATCCATTTGTATTGTTAC-3' | (SEQ ID NO: 5435) |
| βc-m3008 21 nt Target: | 5'-CCAAATCCATTTGTATTGTTA-3' | (SEQ ID NO: 5436) |
| βc-m3015 21 nt Target: | 5'-TCACTCCCCAAATCCATTTGT-3' | (SEQ ID NO: 5437) |
| βc-m3047 21 nt Target: | 5'-GATCCATTCGTGTGCATTCTT-3' | (SEQ ID NO: 5438) |
| βc-m3048 21 nt Target: | 5'-TGATCCATTCGTGTGCATTCT-3' | (SEQ ID NO: 5439) |
| βc-m3049 21 nt Target: | 5'-GTGATCCATTCGTGTGCATTC-3' | (SEQ ID NO: 5440) |
| βc-m3093 21 nt Target: | 5'-TAAAACAAAGAACAAGCAAGG-3' | (SEQ ID NO: 5441) |
| βc-m3109 21 nt Target: | 5'-GCACCACTACAGATATTAAAA-3' | (SEQ ID NO: 5442) |
| βc-m3111 21 nt Target: | 5'-CAGCACCACTACAGATATTAA-3' | (SEQ ID NO: 5443) |
| βc-m3112 21 nt Target: | 5'-TCAGCACCACTACAGATATTA-3' | (SEQ ID NO: 5444) |
| βc-m3133 21 nt Target: | 5'-AAAAAATAAAGCAAGCAAAG-3' | (SEQ ID NO: 5445) |
| βc-m3137 21 nt Target: | 5'-CTGCAAAAAATAAAGCAAGC-3' | (SEQ ID NO: 5446) |
| βc-m3142 21 nt Target: | 5'-AGTTACTGCAAAAAATAAAG-3' | (SEQ ID NO: 5447) |
| βc-m3148 21 nt Target: | 5'-ACTAACAGTTACTGCAAAAAA-3' | (SEQ ID NO: 5448) |
| βc-m3150 21 nt Target: | 5'-AAACTAACAGTTACTGCAAAA-3' | (SEQ ID NO: 5449) |
| βc-m3152 21 nt Target: | 5'-AAAAACTAACAGTTACTGCAA-3' | (SEQ ID NO: 5450) |
| βc-m3153 21 nt Target: | 5'-TAAAAACTAACAGTTACTGCA-3' | (SEQ ID NO: 5451) |
| βc-m3155 21 nt Target: | 5'-CTTAAAAACTAACAGTTACTG-3' | (SEQ ID NO: 5452) |
| βc-m3159 21 nt Target: | 5'-ACTACTTAAAAACTAACAGTT-3' | (SEQ ID NO: 5453) |
| βc-m3161 21 nt Target: | 5'-ACACTACTTAAAAACTAACAG-3' | (SEQ ID NO: 5454) |
| βc-m3165 21 nt Target: | 5'-CATAACACTACTTAAAAACTA-3' | (SEQ ID NO: 5455) |
| βc-m3166 21 nt Target: | 5'-ACATAACACTACTTAAAAACT-3' | (SEQ ID NO: 5456) |
| βc-m3168 21 nt Target: | 5'-GAACATAACACTACTTAAAAA-3' | (SEQ ID NO: 5457) |

TABLE 10-continued

21 Nucleotide Target Sequences of Additional Selected DsiRNAs

| | | |
|---|---|---|
| βc-m3169 21 nt Target: | 5'-AGAACATAACACTACTTAAAA-3' | (SEQ ID NO: 5458) |
| βc-m3170 21 nt Target: | 5'-TAGAACATAACACTACTTAAA-3' | (SEQ ID NO: 5459) |
| βc-m3171 21 nt Target: | 5'-CTAGAACATAACACTACTTAA-3' | (SEQ ID NO: 5460) |
| βc-m3176 21 nt Target: | 5'-GTTCACTAGAACATAACACTA-3' | (SEQ ID NO: 5461) |
| βc-m3178 21 nt Target: | 5'-AGGTTCACTAGAACATAACAC-3' | (SEQ ID NO: 5462) |
| βc-m3179 21 nt Target: | 5'-CAGGTTCACTAGAACATAACA-3' | (SEQ ID NO: 5463) |
| βc-m3216 21 nt Target: | 5'-CCATTACTCGGTTCTTAGAAA-3' | (SEQ ID NO: 5464) |
| βc-m3219 21 nt Target: | 5'-ACACCATTACTCGGTTCTTAG-3' | (SEQ ID NO: 5465) |
| βc-m3224 21 nt Target: | 5'-GTTCTACACCATTACTCGGTT-3' | (SEQ ID NO: 5466) |
| βc-m3234 21 nt Target: | 5'-ATGAATTAGTGTTCTACACCA-3' | (SEQ ID NO: 5467) |
| βc-m3239 21 nt Target: | 5'-TGATTATGAATTAGTGTTCTA-3' | (SEQ ID NO: 5468) |
| βc-m3240 21 nt Target: | 5'-GTGATTATGAATTAGTGTTCT-3' | (SEQ ID NO: 5469) |
| βc-m3241 21 nt Target: | 5'-CGTGATTATGAATTAGTGTTC-3' | (SEQ ID NO: 5470) |
| βc-m3251 21 nt Target: | 5'-TTACAATTAGCGTGATTATGA-3' | (SEQ ID NO: 5471) |
| βc-m3252 21 nt Target: | 5'-ATTACAATTAGCGTGATTATG-3' | (SEQ ID NO: 5472) |
| βc-m3256 21 nt Target: | 5'-CCAGATTACAATTAGCGTGAT-3' | (SEQ ID NO: 5473) |
| βc-m3267 21 nt Target: | 5'-GTTACACGTCTCCAGATTACA-3' | (SEQ ID NO: 5474) |
| βc-m3269 21 nt Target: | 5'-ATGTTACACGTCTCCAGATTA-3' | (SEQ ID NO: 5475) |
| βc-m3277 21 nt Target: | 5'-GCTACACAATGTTACACGTCT-3' | (SEQ ID NO: 5476) |
| βc-m3279 21 nt Target: | 5'-AGGCTACACAATGTTACACGT-3' | (SEQ ID NO: 5477) |
| βc-m3286 21 nt Target: | 5'-ATACAAAAGGCTACACAATGT-3' | (SEQ ID NO: 5478) |
| βc-m3287 21 nt Target: | 5'-TATACAAAAGGCTACACAATG-3' | (SEQ ID NO: 5479) |
| βc-m3291 21 nt Target: | 5'-TATTTATACAAAAGGCTACAC-3' | (SEQ ID NO: 5480) |
| βc-m3292 21 nt Target: | 5'-CTATTTATACAAAAGGCTACA-3' | (SEQ ID NO: 5481) |
| βc-m3295 21 nt Target: | 5'-TGTCTATTTATACAAAAGGCT-3' | (SEQ ID NO: 5482) |
| βc-m3296 21 nt Target: | 5'-CTGTCTATTTATACAAAAGGC-3' | (SEQ ID NO: 5483) |
| βc-m3297 21 nt Target: | 5'-TCTGTCTATTTATACAAAAGG-3' | (SEQ ID NO: 5484) |
| βc-m3303 21 nt Target: | 5'-TTTCTATCTGTCTATTTATAC-3' | (SEQ ID NO: 5485) |
| βc-m3304 21 nt Target: | 5'-ATTTCTATCTGTCTATTTATA-3' | (SEQ ID NO: 5486) |
| βc-m3305 21 nt Target: | 5'-CATTTCTATCTGTCTATTTAT-3' | (SEQ ID NO: 5487) |
| βc-m3306 21 nt Target: | 5'-CCATTTCTATCTGTCTATTTA-3' | (SEQ ID NO: 5488) |
| βc-m3310 21 nt Target: | 5'-CGGACCATTTCTATCTGTCTA-3' | (SEQ ID NO: 5489) |
| βc-m3311 21 nt Target: | 5'-TCGGACCATTTCTATCTGTCT-3' | (SEQ ID NO: 5490) |
| βc-m3318 21 nt Target: | 5'-AAACTAATCGGACCATTTCTA-3' | (SEQ ID NO: 5491) |
| βc-m3319 21 nt Target: | 5'-GAAACTAATCGGACCATTTCT-3' | (SEQ ID NO: 5492) |
| βc-m3320 21 nt Target: | 5'-GGAAACTAATCGGACCATTTC-3' | (SEQ ID NO: 5493) |
| βc-m3321 21 nt Target: | 5'-AGGAAACTAATCGGACCATTT-3' | (SEQ ID NO: 5494) |
| βc-m3328 21 nt Target: | 5'-ATTAAAAGGAAACTAATCGG-3' | (SEQ ID NO: 5495) |
| βc-m3334 21 nt Target: | 5'-AAGCATATTAAAAGGAAACT-3' | (SEQ ID NO: 5496) |

TABLE 10-continued

21 Nucleotide Target Sequences of Additional Selected DsiRNAs

| | | |
|---|---|---|
| βc-m3335 21 nt Target: | 5'-TAAGCATATTAAAAAGGAAAC-3' | (SEQ ID NO: 5497) |
| βc-m3339 21 nt Target: | 5'-ATTTTAAGCATATTAAAAAGG-3' | (SEQ ID NO: 5498) |
| βc-m3345 21 nt Target: | 5'-CTGCTTATTTTAAGCATATTA-3' | (SEQ ID NO: 5499) |
| βc-m3346 21 nt Target: | 5'-CCTGCTTATTTTAAGCATATT-3' | (SEQ ID NO: 5500) |
| βc-m3352 21 nt Target: | 5'-GATCCACCTGCTTATTTTAAG-3' | (SEQ ID NO: 5501) |
| βc-m3367 21 nt Target: | 5'-CAAAAACATGAAATAGATCCA-3' | (SEQ ID NO: 5502) |
| βc-m3368 21 nt Target: | 5'-TCAAAAACATGAAATAGATCC-3' | (SEQ ID NO: 5503) |
| βc-m3370 21 nt Target: | 5'-GTTCAAAAACATGAAATAGAT-3' | (SEQ ID NO: 5504) |
| βc-m3371 21 nt Target: | 5'-TGTTCAAAAACATGAAATAGA-3' | (SEQ ID NO: 5505) |
| βc-m3372 21 nt Target: | 5'-TTGTTCAAAAACATGAAATAG-3' | (SEQ ID NO: 5506) |
| βc-m3377 21 nt Target: | 5'-AGTTTTGTTCAAAAACATGA-3' | (SEQ ID NO: 5507) |
| βc-m3383 21 nt Target: | 5'-CGATAAAGTTTTGTTCAAAA-3' | (SEQ ID NO: 5508) |
| βc-m3389 21 nt Target: | 5'-TATCCCCGATAAAGTTTTGT-3' | (SEQ ID NO: 5509) |
| βc-m3390 21 nt Target: | 5'-GTATCCCCGATAAAGTTTTG-3' | (SEQ ID NO: 5510) |
| βc-m3419 21 nt Target: | 5'-ACACCTCTTACTGATTTACCC-3' | (SEQ ID NO: 5511) |
| βc-m3421 21 nt Target: | 5'-TAACACCTCTTACTGATTTAC-3' | (SEQ ID NO: 5512) |
| βc-m3422 21 nt Target: | 5'-ATAACACCTCTTACTGATTTA-3' | (SEQ ID NO: 5513) |
| βc-m3423 21 nt Target: | 5'-AATAACACCTCTTACTGATTT-3' | (SEQ ID NO: 5514) |
| βc-m3424 21 nt Target: | 5'-AAATAACACCTCTTACTGATT-3' | (SEQ ID NO: 5515) |
| βc-m3425 21 nt Target: | 5'-CAAATAACACCTCTTACTGAT-3' | (SEQ ID NO: 5516) |
| βc-m3431 21 nt Target: | 5'-AAGGCTCAAATAACACCTCTT-3' | (SEQ ID NO: 5517) |
| βc-m3436 21 nt Target: | 5'-AAAACAAGGCTCAAATAACAC-3' | (SEQ ID NO: 5518) |
| βc-m3437 21 nt Target: | 5'-CAAAACAAGGCTCAAATAACA-3' | (SEQ ID NO: 5519) |
| βc-m3438 21 nt Target: | 5'-CCAAAACAAGGCTCAAATAAC-3' | (SEQ ID NO: 5520) |
| βc-m3441 21 nt Target: | 5'-TGTCCAAAACAAGGCTCAAAT-3' | (SEQ ID NO: 5521) |
| βc-m3443 21 nt Target: | 5'-ACTGTCCAAAACAAGGCTCAA-3' | (SEQ ID NO: 5522) |
| βc-m3448 21 nt Target: | 5'-GGTATACTGTCCAAAACAAGG-3' | (SEQ ID NO: 5523) |
| βc-m3456 21 nt Target: | 5'-AGGCAACTGGTATACTGTCCA-3' | (SEQ ID NO: 5524) |
| βc-m3464 21 nt Target: | 5'-GGGATAAAAGGCAACTGGTAT-3' | (SEQ ID NO: 5525) |
| βc-m3465 21 nt Target: | 5'-TGGGATAAAAGGCAACTGGTA-3' | (SEQ ID NO: 5526) |
| βc-m3472 21 nt Target: | 5'-ACAACTTTGGGATAAAAGGCA-3' | (SEQ ID NO: 5527) |
| βc-m3474 21 nt Target: | 5'-CAACAACTTTGGGATAAAAGG-3' | (SEQ ID NO: 5528) |
| βc-m3479 21 nt Target: | 5'-GGTTACAACAACTTTGGGATA-3' | (SEQ ID NO: 5529) |
| βc-m3480 21 nt Target: | 5'-AGGTTACAACAACTTTGGGAT-3' | (SEQ ID NO: 5530) |
| βc-m3481 21 nt Target: | 5'-CAGGTTACAACAACTTTGGGA-3' | (SEQ ID NO: 5531) |
| βc-m3489 21 nt Target: | 5'-TATCACAGCAGGTTACAACAA-3' | (SEQ ID NO: 5532) |
| βc-m3490 21 nt Target: | 5'-GTATCACAGCAGGTTACAACA-3' | (SEQ ID NO: 5533) |
| βc-m3492 21 nt Target: | 5'-TTGTATCACAGCAGGTTACAA-3' | (SEQ ID NO: 5534) |
| βc-m3509 21 nt Target: | 5'-CCGCATCTGTTGAAGCATTGT-3' | (SEQ ID NO: 5535) |

TABLE 10-continued

21 Nucleotide Target Sequences of Additional Selected DsiRNAs

| | | |
|---|---|---|
| βc-m3527 21 nt Target: | 5'-TCTGAACCATTTCTATAACCG-3' | (SEQ ID NO: 5536) |
| βc-m3531 21 nt Target: | 5'-TAATTCTGAACCATTTCTATA-3' | (SEQ ID NO: 5537) |
| βc-m3533 21 nt Target: | 5'-TTTAATTCTGAACCATTTCTA-3' | (SEQ ID NO: 5538) |
| βc-m3534 21 nt Target: | 5'-GTTTAATTCTGAACCATTTCT-3' | (SEQ ID NO: 5539) |
| βc-m3535 21 nt Target: | 5'-AGTTTAATTCTGAACCATTTC-3' | (SEQ ID NO: 5540) |
| βc-m3536 21 nt Target: | 5'-AAGTTTAATTCTGAACCATTT-3' | (SEQ ID NO: 5541) |
| βc-m3541 21 nt Target: | 5'-ATTAAAAGTTTAATTCTGAAC-3' | (SEQ ID NO: 5542) |
| βc-m3542 21 nt Target: | 5'-AATTAAAAGTTTAATTCTGAA-3' | (SEQ ID NO: 5543) |
| βc-m3544 21 nt Target: | 5'-TGAATTAAAAGTTTAATTCTG-3' | (SEQ ID NO: 5544) |
| βc-m3550 21 nt Target: | 5'-TTTGAATGAATTAAAAGTTTA-3' | (SEQ ID NO: 5545) |
| βc-m3554 21 nt Target: | 5'-TTTTTTTGAATGAATTAAAAG-3' | (SEQ ID NO: 5546) |
| βc-m3558 21 nt Target: | 5'-TTTTTTTTTTTGAATGAATTA-3' | (SEQ ID NO: 5547) |
| βc-m3559 21 nt Target: | 5'-TTTTTTTTTTTTGAATGAATT-3' | (SEQ ID NO: 5548) |
| βc-m3560 21 nt Target: | 5'-TTTTTTTTTTTTTGAATGAAT-3' | (SEQ ID NO: 5549) |
| βc-m3561 21 nt Target: | 5'-TTTTTTTTTTTTTTGAATGAA-3' | (SEQ ID NO: 5550) |
| βc-m3562 21 nt Target: | 5'-TTTTTTTTTTTTTTTGAATGA-3' | (SEQ ID NO: 5551) |
| βc-m3563 21 nt Target: | 5'-TTTTTTTTTTTTTTTTGAATG-3' | (SEQ ID NO: 5552) |

TABLE 11

Additional Selected Anti-β-catenin DsiRNAs, 25/27mer Duplexes, Unmodified

| | | |
|---|---|---|
| | 5'-UGUAUGGUAUACUUCAAAUACCCUC-3' | (SEQ ID NO: 3823) |
| | 3'-CAACAUACCAUAUGAAGUUUAUGGGAG-5' | (SEQ ID NO: 1605) |
| βc-244 Target: | 5'-GTTGTATGGTATACTTCAAATACCCTC-3' | (SEQ ID NO: 2714) |
| | 5'-AAACAGUUGUAUGGUAUACUUCAAA-3' | (SEQ ID NO: 3824) |
| | 3'-GUUUUGUCAACAUACCAUAUGAAGUUU-5' | (SEQ ID NO: 1606) |
| βc-251 Target: | 5'-CAAAACAGTTGTATGGTATACTTCAAA-3' | (SEQ ID NO: 2715) |
| | 5'-AAAACAGUUGUAUGGUAUACUUCAA-3' | (SEQ ID NO: 3825) |
| | 3'-AGUUUUGUCAACAUACCAUAUGAAGUU-5' | (SEQ ID NO: 1607) |
| βc-252 Target: | 5'-TCAAAACAGTTGTATGGTATACTTCAA-3' | (SEQ ID NO: 2716) |
| | 5'-UCAAAACAGUUGUAUGGUAUACUUC-3' | (SEQ ID NO: 3826) |
| | 3'-AAAGUUUUGUCAACAUACCAUAUGAAG-5' | (SEQ ID NO: 1608) |
| βc-254 Target: | 5'-TTTCAAAACAGTTGTATGGTATACTTC-3' | (SEQ ID NO: 2717) |
| | 5'-UUCAAAACAGUUGUAUGGUAUACUU-3' | (SEQ ID NO: 3827) |
| | 3'-AAAAGUUUUGUCAACAUACCAUAUGAA-5' | (SEQ ID NO: 1609) |
| βc-255 Target: | 5'-TTTTCAAAACAGTTGTATGGTATACTT-3' | (SEQ ID NO: 2718) |
| | 5'-UUUCAAAACAGUUGUAUGGUAUACU-3' | (SEQ ID NO: 3828) |
| | 3'-UAAAAGUUUUGUCAACAUACCAUAUGA-5' | (SEQ ID NO: 1610) |
| βc-256 Target: | 5'-ATTTTCAAAACAGTTGTATGGTATACT-3' | (SEQ ID NO: 2719) |
| | 5'-GUCCACGCUGGAUUUUCAAAACAGU-3' | (SEQ ID NO: 3829) |
| | 3'-AACAGGUGCGACCUAAAAGUUUUGUCA-5' | (SEQ ID NO: 1611) |
| βc-269 Target: | 5'-TTGTCCACGCTGGATTTTCAAAACAGT-3' | (SEQ ID NO: 2720) |

TABLE 11-continued

Additional Selected Anti-β-catenin DsiRNAs, 25/27mer Duplexes, Unmodified

| | | |
|---|---|---|
| | 5'-UGUCCACGCUGGAUUUUCAAAACAG-3' | (SEQ ID NO: 3830) |
| | 3'-UAACAGGUGCGACCUAAAAGUUUUGUC-5' | (SEQ ID NO: 1612) |
| βc-270 Target: | 5'-ATTGTCCACGCTGGATTTTCAAAACAG-3' | (SEQ ID NO: 2721) |
| | 5'-AUCAAAUCAGCUUGAGUAGCCAUUG-3' | (SEQ ID NO: 3831) |
| | 3'-GGUAGUUUAGUCGAACUCAUCGGUAAC-5' | (SEQ ID NO: 1613) |
| βc-293 Target: | 5'-CCATCAAATCAGCTTGAGTAGCCATTG-3' | (SEQ ID NO: 2722) |
| | 5'-UCCAACUCCAUCAAAUCAGCUUGAG-3' | (SEQ ID NO: 3832) |
| | 3'-ACAGGUUGAGGUAGUUUAGUCGAACUC-5' | (SEQ ID NO: 1614) |
| βc-302 Target: | 5'-TGTCCAACTCCATCAAATCAGCTTGAG-3' | (SEQ ID NO: 2723) |
| | 5'-UCCUCAGGAUUGCCUUUACCACUCA-3' | (SEQ ID NO: 3833) |
| | 3'-GAAGGAGUCCUAACGGAAAUGGUGAGU-5' | (SEQ ID NO: 1615) |
| βc-431 Target: | 5'-CTTCCTCAGGATTGCCTTTACCACTCA-3' | (SEQ ID NO: 2724) |
| | 5'-UUCCUCAGGAUUGCCUUUACCACUC-3' | (SEQ ID NO: 3834) |
| | 3'-AGAAGGAGUCCUAACGGAAAUGGUGAG-5' | (SEQ ID NO: 1616) |
| βc-432 Target: | 5'-TCTTCCTCAGGATTGCCTTTACCACTC-3' | (SEQ ID NO: 2725) |
| | 5'-UCAAUAUCAGCUACUUGUUCUUGAG-3' | (SEQ ID NO: 3835) |
| | 3'-GUAGUUAUAGUCGAUGAACAAGAACUC-5' | (SEQ ID NO: 1617) |
| βc-518 Target: | 5'-CATCAATATCAGCTACTTGTTCTTGAG-3' | (SEQ ID NO: 2726) |
| | 5'-AUCAAUAUCAGCUACUUGUUCUUGA-3' | (SEQ ID NO: 3836) |
| | 3'-GGUAGUUAUAGUCGAUGAACAAGAACU-5' | (SEQ ID NO: 1618) |
| βc-519 Target: | 5'-CCATCAATATCAGCTACTTGTTCTTGA-3' | (SEQ ID NO: 2727) |
| | 5'-UGUCCAUCAAUAUCAGCUACUUGUU-3' | (SEQ ID NO: 3837) |
| | 3'-UGACAGGUAGUUAUAGUCGAUGAACAA-5' | (SEQ ID NO: 1619) |
| βc-524 Target: | 5'-ACTGTCCATCAATATCAGCTACTTGTT-3' | (SEQ ID NO: 2728) |
| | 5'-UGCAUACUGUCCAUCAAUAUCAGCU-3' | (SEQ ID NO: 3838) |
| | 3'-UAACGUAUGACAGGUAGUUAUAGUCGA-5' | (SEQ ID NO: 1620) |
| βc-531 Target: | 5'-ATTGCATACTGTCCATCAATATCAGCT-3' | (SEQ ID NO: 2729) |
| | 5'-AGUCAUUGCAUACUGUCCAUCAAUA-3' | (SEQ ID NO: 3839) |
| | 3'-GCUCAGUAACGUAUGACAGGUAGUUAU-5' | (SEQ ID NO: 1621) |
| βc-537 Target: | 5'-CGAGTCATTGCATACTGTCCATCAATA-3' | (SEQ ID NO: 2730) |
| | 5'-UCAUCUAAUGUCUCAGGGAACAUAG-3' | (SEQ ID NO: 3840) |
| | 3'-GGAGUAGAUUACAGAGUCCCUUGUAUC-5' | (SEQ ID NO: 1622) |
| βc-584 Target: | 5'-CCTCATCTAATGTCTCAGGGAACATAG-3' | (SEQ ID NO: 2731) |
| | 5'-ACAACUGCAUGUUUCAGCAUCUGUG-3' | (SEQ ID NO: 3841) |
| | 3'-AAUGUUGACGUACAAAGUCGUAGACAC-5' | (SEQ ID NO: 1623) |
| βc-680 Target: | 5'-TTACAACTGCATGTTTCAGCATCTGTG-3' | (SEQ ID NO: 2732) |
| | 5'-UUACAACUGCAUGUUUCAGCAUCUG-3' | (SEQ ID NO: 3842) |
| | 3'-CAAAUGUUGACGUACAAAGUCGUAGAC-5' | (SEQ ID NO: 1624) |
| βc-682 Target: | 5'-GTTTACAACTGCATGTTTCAGCATCTG-3' | (SEQ ID NO: 2733) |
| | 5'-UUAAUCAAGUUUACAACUGCAUGUU-3' | (SEQ ID NO: 3843) |
| | 3'-UCAAUUAGUUCAAAUGUUGACGUACAA-5' | (SEQ ID NO: 1625) |
| βc-692 Target: | 5'-AGTTAATCAAGTTTACAACTGCATGTT-3' | (SEQ ID NO: 2734) |
| | 5'-UGAUAGUUAAUCAAGUUUACAACUG-3' | (SEQ ID NO: 3844) |
| | 3'-GAACUAUCAAUUAGUUCAAAUGUUGAC-5' | (SEQ ID NO: 1626) |
| βc-698 Target: | 5'-CTTGATAGTTAATCAAGTTTACAACTG-3' | (SEQ ID NO: 2735) |

TABLE 11-continued

Additional Selected Anti-β-catenin DsiRNAs, 25/27mer Duplexes, Unmodified

|  |  |  |  |
|---|---|---|---|
|  | 5'-GCAUCAUCUUGAUAGUUAAUCAAGU-3' | (SEQ ID NO: 3845) |  |
|  | 3'-GACGUAGUAGAACUAUCAAUUAGUUCA-5' | (SEQ ID NO: 1627) |  |
| βc-707 Target: | 5'-CTGCATCATCTTGATAGTTAATCAAGT-3' | (SEQ ID NO: 2736) |  |
|  | 5'-UGCAUCAUCUUGAUAGUUAAUCAAG-3' | (SEQ ID NO: 3846) |  |
|  | 3'-AGACGUAGUAGAACUAUCAAUUAGUUC-5' | (SEQ ID NO: 1628) |  |
| βc-708 Target: | 5'-TCTGCATCATCTTGATAGTTAATCAAG-3' | (SEQ ID NO: 2737) |  |
|  | 5'-GGUCCUCGUCAUUUAGCAGUUUUGU-3' | (SEQ ID NO: 3847) |  |
|  | 3'-GACCAGGAGCAGUAAAUCGUCAAAACA-5' | (SEQ ID NO: 1629) |  |
| βc-763 Target: | 5'-CTGGTCCTCGTCATTTAGCAGTTTTGT-3' | (SEQ ID NO: 2738) |  |
|  | 5'-UAACUGCAGCCUUAUUAACCACCAC-3' | (SEQ ID NO: 3848) |  |
|  | 3'-GUAUUGACGUCGGAAUAAUUGGUGGUG-5' | (SEQ ID NO: 1630) |  |
| βc-790 Target: | 5'-CATAACTGCAGCCTTATTAACCACCAC-3' | (SEQ ID NO: 2739) |  |
|  | 5'-AUAACUGCAGCCUUAUUAACCACCA-3' | (SEQ ID NO: 3849) |  |
|  | 3'-GGUAUUGACGUCGGAAUAAUUGGUGGU-5' | (SEQ ID NO: 1631) |  |
| βc-791 Target: | 5'-CCATAACTGCAGCCTTATTAACCACCA-3' | (SEQ ID NO: 2740) |  |
|  | 5'-ACCAUAACUGCAGCCUUAUUAACCA-3' | (SEQ ID NO: 3850) |  |
|  | 3'-CCUGGUAUUGACGUCGGAAUAAUUGGU-5' | (SEQ ID NO: 1632) |  |
| βc-794 Target: | 5'-GGACCATAACTGCAGCCTTATTAACCA-3' | (SEQ ID NO: 2741) |  |
|  | 5'-UUUUUAGAAAGCUGAUGGACCAUAA-3' | (SEQ ID NO: 3851) |  |
|  | 3'-GGAAAAAUCUUUCGACUACCUGGUAUU-5' | (SEQ ID NO: 1633) |  |
| βc-812 Target: | 5'-CCTTTTTAGAAAGCTGATGGACCATAA-3' | (SEQ ID NO: 2742) |  |
|  | 5'-GGUACGUACAAUAGCAGACACCAUC-3' | (SEQ ID NO: 3852) |  |
|  | 3'-UACCAUGCAUGUUAUCGUCUGUGGUAG-5' | (SEQ ID NO: 1634) |  |
| βc-873 Target: | 5'-ATGGTACGTACAATAGCAGACACCATC-3' | (SEQ ID NO: 2743) |  |
|  | 5'-UCAUUUGUAUUCUGCAUGGUACGUA-3' | (SEQ ID NO: 3853) |  |
|  | 3'-GUAGUAAACAUAAGACGUACCAUGCAU-5' | (SEQ ID NO: 1635) |  |
| βc-890 Target: | 5'-CATCATTTGTATTCTGCATGGTACGTA-3' | (SEQ ID NO: 2744) |  |
|  | 5'-GUUUCUACAUCAUUUGUAUUCUGCA-3' | (SEQ ID NO: 3854) |  |
|  | 3'-GACAAAGAUGUAGUAAACAUAAGACGU-5' | (SEQ ID NO: 1636) |  |
| βc-899 Target: | 5'-CTGTTTCTACATCATTTGTATTCTGCA-3' | (SEQ ID NO: 2745) |  |
|  | 5'-UGUUUCUACAUCAUUUGUAUUCUGC-3' | (SEQ ID NO: 3855) |  |
|  | 3'-CGACAAAGAUGUAGUAAACAUAAGACG-5' | (SEQ ID NO: 1637) |  |
| βc-900 Target: | 5'-GCTGTTTCTACATCATTTGTATTCTGC-3' | (SEQ ID NO: 2746) |  |
|  | 5'-ACAACGAGCUGUUUCUACAUCAUUU-3' | (SEQ ID NO: 3856) |  |
|  | 3'-CAUGUUGCUCGACAAAGAUGUAGUAAA-5' | (SEQ ID NO: 1638) |  |
| βc-909 Target: | 5'-GTACAACGAGCTGTTTCTACATCATTT-3' | (SEQ ID NO: 2747) |  |
|  | 5'-GUACAACGAGCUGUUUCUACAUCAU-3' | (SEQ ID NO: 3857) |  |
|  | 3'-GCCAUGUUGCUCGACAAAGAUGUAGUA-5' | (SEQ ID NO: 1639) |  |
| βc-911 Target: | 5'-CGGTACAACGAGCTGTTTCTACATC-3' | (SEQ ID NO: 2748) |  |
|  | 5'-GGUACAACGAGCUGUUUCUACAUCA-3' | (SEQ ID NO: 3858) |  |
|  | 3'-CGCCAUGUUGCUCGACAAAGAUGUAGU-5' | (SEQ ID NO: 1640) |  |
| βc-912 Target: | 5'-GCGGTACAACGAGCTGTTTCTACATCA-3' | (SEQ ID NO: 2749) |  |
|  | 5'-AUAAAACAACACAGAAUCCACUGGU-3' | (SEQ ID NO: 3859) |  |
|  | 3'-CGUAUUUUGUUGUGUCUUAGGUGACCA-5' | (SEQ ID NO: 1641) |  |
| βc-1032 Target: | 5'-GCATAAAACAACACAGAATCCACTGGT-3' | (SEQ ID NO: 2750) |  |

TABLE 11-continued

Additional Selected Anti-β-catenin DsiRNAs,
25/27mer Duplexes, Unmodified

```
                   5'-GCAUAAAACAACACAGAAUCCACUG-3'    (SEQ ID NO: 3860)
                   3'-ACCGUAUUUUGUUGUGUCUUAGGUGAC-5'  (SEQ ID NO: 1642)

βc-1034 Target:    5'-TGGCATAAAACAACACAGAATCCACTG-3'  (SEQ ID NO: 2751)

5'-GGCAUAAAACAACACAGAAUCCACU-3'    (SEQ ID NO: 3861)
                   3'-UACCGUAUUUUGUUGUGUCUUAGGUGA-5'  (SEQ ID NO: 1643)

βc-1035 Target:    5'-ATGGCATAAAACAACACAGAATCCACT-3'  (SEQ ID NO: 2752)

5'-GCUCCUUCUUGAUGUAAUAAAAGGU-3'    (SEQ ID NO: 3862)
                   3'-AUCGAGGAAGAACUACAUUAUUUUCCA-5'  (SEQ ID NO: 1644)

βc-1076 Target:    5'-TAGCTCCTTCTTGATGTAATAAAAGGT-3'  (SEQ ID NO: 2753)

5'-AGCUCCUUCUUGAUGUAAUAAAAGG-3'    (SEQ ID NO: 3863)
                   3'-AAUCGAGGAAGAACUACAUUAUUUUCC-5'  (SEQ ID NO: 1645)

βc-1077 Target:    5'-TTAGCTCCTTCTTGATGTAATAAAAGG-3'  (SEQ ID NO: 2754)

5'-UAACAUUUGUUUUGUUGAGCAAGGC-3'    (SEQ ID NO: 3864)
                   3'-AAAUUGUAAACAAAACAACUCGUUCCG-5'  (SEQ ID NO: 1646)

βc-1144 Target:    5'-TTTAACATTTGTTTTGTTGAGCAAGGC-3'  (SEQ ID NO: 2755)

5'-GCCAAGAAUUUAACAUUUGUUUUGU-3'    (SEQ ID NO: 3865)
                   3'-AUCGGUUCUUAAAUUGUAAACAAAACA-5'  (SEQ ID NO: 1647)

βc-1154 Target:    5'-TAGCCAAGAATTTAACATTTGTTTTGT-3'  (SEQ ID NO: 2756)

5'-UAAUAGCCAAGAAUUUAACAUUUGU-3'    (SEQ ID NO: 3866)
                   3'-GCAUUAUCGGUUCUUAAAUUGUAAACA-5'  (SEQ ID NO: 1648)

βc-1159 Target:    5'-CGTAATAGCCAAGAATTTAACATTTGT-3'  (SEQ ID NO: 2757)

5'-GUAAUAGCCAAGAAUUUAACAUUUG-3'    (SEQ ID NO: 3867)
                   3'-AGCAUUAUCGGUUCUUAAAUUGUAAAC-5'  (SEQ ID NO: 1649)

βc-1160 Target:    5'-TCGTAATAGCCAAGAATTTAACATTTG-3'  (SEQ ID NO: 2758)

5'-AGCUAAAAUUUGAAGGCAGUCUGUC-3'    (SEQ ID NO: 3868)
                   3'-AUUCGAUUUUAAACUUCCGUCAGACAG-5'  (SEQ ID NO: 1650)

βc-1185 Target:    5'-TAAGCTAAAATTTGAAGGCAGTCTGTC-3'  (SEQ ID NO: 2759)

5'-GGUCCUCAUUAUAUUUACUAAAGCU-3'    (SEQ ID NO: 3869)
                   3'-AUCCAGGAGUAAUAUAAAUGAUUUCGA-5'  (SEQ ID NO: 1651)

βc-1260 Target:    5'-TAGGTCCTCATTATATTTACTAAAGCT-3'  (SEQ ID NO: 2760)

5'-GUAUAGGUCCUCAUUAUAUUUACUA-3'    (SEQ ID NO: 3870)
                   3'-UUCAUAUCCAGGAGUAAUAUAAAUGAU-5'  (SEQ ID NO: 1652)

βc-1265 Target:    5'-AAGTATAGGTCCTCATTATATTTACTA-3'  (SEQ ID NO: 2761)

5'-AGUAUAGGUCCUCAUUAUAUUUACU-3'    (SEQ ID NO: 3871)
                   3'-AUUCAUAUCCAGGAGUAAUAUAAAUGA-5'  (SEQ ID NO: 1653)

βc-1266 Target:    5'-TAAGTATAGGTCCTCATTATATTTACT-3'  (SEQ ID NO: 2762)

5'-UUUUCGUAAGUAUAGGUCCUCAUUA-3'    (SEQ ID NO: 3872)
                   3'-CAAAAAGCAUUCAUAUCCAGGAGUAAU-5'  (SEQ ID NO: 1654)

βc-1274 Target:    5'-GTTTTTCGTAAGTATAGGTCCTCATTA-3'  (SEQ ID NO: 2763)

5'-UUUUUCGUAAGUAUAGGUCCUCAUU-3'    (SEQ ID NO: 3873)
                   3'-UCAAAAAGCAUUCAUAUCCAGGAGUAA-5'  (SEQ ID NO: 1655)

βc-1275 Target:    5'-AGTTTTTCGTAAGTATAGGTCCTCATT-3'  (SEQ ID NO: 2764)

5'-GUUUUUCGUAAGUAUAGGUCCUCAU-3'    (SEQ ID NO: 3874)
                   3'-AUCAAAAAGCAUUCAUAUCCAGGAGUA-5'  (SEQ ID NO: 1656)

βc-1276 Target:    5'-TAGTTTTTCGTAAGTATAGGTCCTC-3'    (SEQ ID NO: 2765)
```

TABLE 11-continued

Additional Selected Anti-β-catenin DsiRNAs, 25/27mer Duplexes, Unmodified

|  |  |  |
|---|---|---|
|  | 5'-AGUUUUUCGUAAGUAUAGGUCCUCA-3'<br>3'-CAUCAAAAAGCAUUCAUAUCCAGGAGU-5' | (SEQ ID NO: 3875)<br>(SEQ ID NO: 1657) |
| βc-1277 Target: | 5'-GTAGTTTTTCGTAAGTATAGGTCCTCA-3' | (SEQ ID NO: 2766) |
|  | 5'-GGUCCACAGUAGUUUUUCGUAAGUA-3'<br>3'-CACCAGGUGUCAUCAAAAAGCAUUCAU-5' | (SEQ ID NO: 3876)<br>(SEQ ID NO: 1658) |
| βc-1287 Target: | 5'-GTGGTCCACAGTAGTTTTTCGTAAGTA-3' | (SEQ ID NO: 2767) |
|  | 5'-UACAAUAGCCGGCUUAUUACUAGAG-3'<br>3'-AGAUGUUAUCGGCCGAAUAAUGAUCUC-5' | (SEQ ID NO: 3877)<br>(SEQ ID NO: 1659) |
| βc-1344 Target: | 5'-TCTACAATAGCCGGCTTATTACTAGAG-3' | (SEQ ID NO: 2768) |
|  | 5'-UCUACAAUAGCCGGCUUAUUACUAG-3'<br>3'-GAAGAUGUUAUCGGCCGAAUAAUGAUC-5' | (SEQ ID NO: 3878)<br>(SEQ ID NO: 1660) |
| βc-1346 Target: | 5'-CTTCTACAATAGCCGGCTTATTACTAG-3' | (SEQ ID NO: 2769) |
|  | 5'-UCCUAAAGCUUGCAUUCCACCAGCU-3'<br>3'-UCAGGAUUUCGAACGUAAGGUGGUCGA-5' | (SEQ ID NO: 3879)<br>(SEQ ID NO: 1661) |
| βc-1371 Target: | 5'-AGTCCTAAAGCTTGCATTCCACCAGCT-3' | (SEQ ID NO: 2770) |
|  | 5'-GUCCUAAAGCUUGCAUUCCACCAGC-3'<br>3'-UUCAGGAUUUCGAACGUAAGGUGGUCG-5' | (SEQ ID NO: 3880)<br>(SEQ ID NO: 1662) |
| βc-1372 Target: | 5'-AAGTCCTAAAGCTTGCATTCCACCAGC-3' | (SEQ ID NO: 2771) |
|  | 5'-AGUCCUAAAGCUUGCAUUCCACCAG-3'<br>3'-CUUCAGGAUUUCGAACGUAAGGUGGUC-5' | (SEQ ID NO: 3881)<br>(SEQ ID NO: 1663) |
| βc-1373 Target: | 5'-GAAGTCCTAAAGCTTGCATTCCACCAG-3' | (SEQ ID NO: 2772) |
|  | 5'-GUUCUGAACAAGACGUUGACUUGGA-3'<br>3'-GUCAAGACUUGUUCUGCAACUGAACCU-5' | (SEQ ID NO: 3882)<br>(SEQ ID NO: 1664) |
| βc-1410 Target: | 5'-CAGTTCTGAACAAGACGTTGACTTGGA-3' | (SEQ ID NO: 2773) |
|  | 5'-AGUUCUGAACAAGACGUUGACUUGG-3'<br>3'-UGUCAAGACUUGUUCUGCAACUGAACC-5' | (SEQ ID NO: 3883)<br>(SEQ ID NO: 1665) |
| βc-1411 Target: | 5'-ACAGTTCTGAACAAGACGTTGACTTGG-3' | (SEQ ID NO: 2774) |
|  | 5'-GUCCAAAGACAGUUCUGAACAAGAC-3'<br>3'-CUCAGGUUUCUGUCAAGACUUGUUCUG-5' | (SEQ ID NO: 3884)<br>(SEQ ID NO: 1666) |
| βc-1421 Target: | 5'-GAGTCCAAAGACAGTTCTGAACAAGAC-3' | (SEQ ID NO: 2775) |
|  | 5'-UUCCUGUUUAGUUGCAGCAUCUGAA-3'<br>3'-GGAAGGACAAAUCAACGUCGUAGACUU-5' | (SEQ ID NO: 3885)<br>(SEQ ID NO: 1667) |
| βc-1458 Target: | 5'-CCTTCCTGTTTAGTTGCAGCATCTGAA-3' | (SEQ ID NO: 2776) |
|  | 5'-ACAUUUAUAUCAUCUGAACCCAGAA-3'<br>3'-GGUGUAAAUAUAGUAGACUUGGGUCUU-5' | (SEQ ID NO: 3886)<br>(SEQ ID NO: 1668) |
| βc-1517 Target: | 5'-CCACATTTATATCATCTGAACCCAGAA-3' | (SEQ ID NO: 2777) |
|  | 5'-ACCACAUUUAUAUCAUCUGAACCCA-3'<br>3'-ACUGGUGUAAAUAUAGUAGACUUGGGU-5' | (SEQ ID NO: 3887)<br>(SEQ ID NO: 1669) |
| βc-1520 Target: | 5'-TGACCACATTTATATCATCTGAACCCA-3' | (SEQ ID NO: 2778) |
|  | 5'-GCACAGGUGACCACAUUUAUAUCAU-3'<br>3'-GACGUGUCCACUGGUGUAAAUAUAGUA-5' | (SEQ ID NO: 3888)<br>(SEQ ID NO: 1670) |
| βc-1529 Target: | 5'-CTGCACAGGTGACCACATTTATATC-3' | (SEQ ID NO: 2779) |
|  | 5'-UGCACAGGUGACCACAUUUAUAUCA-3'<br>3'-CGACGUGUCCACUGGUGUAAAUAUAGU-5' | (SEQ ID NO: 3889)<br>(SEQ ID NO: 1671) |
| βc-1530 Target: | 5'-GCTGCACAGGTGACCACATTTATATCA-3' | (SEQ ID NO: 2780) |

TABLE 11-continued

Additional Selected Anti-β-catenin DsiRNAs, 25/27mer Duplexes, Unmodified

|  | 5'-UGCAAGUGAGGUUAGAAAGAAUUCC-3' | (SEQ ID NO: 3890) |
|  | 3'-UAACGUUCACUCCAAUCUUUCUUAAGG-5' | (SEQ ID NO: 1672) |

βc-1558 Target: 5'-ATTGCAAGTGAGGTTAGAAAGAATTCC-3' (SEQ ID NO: 2781)

|  | 5'-AUAAUUAUUGCAAGUGAGGUUAGAA-3' | (SEQ ID NO: 3891) |
|  | 3'-AAUAUUAAUAACGUUCACUCCAAUCUU-5' | (SEQ ID NO: 1673) |

βc-1566 Target: 5'-TTATAATTATTGCAAGTGAGGTTAGAA-3' (SEQ ID NO: 2782)

|  | 5'-UCAUCUUGUUCUUAUAAUUAUUGCA-3' | (SEQ ID NO: 3892) |
|  | 3'-GUAGUAGAACAAGAAUAUUAAUAACGU-5' | (SEQ ID NO: 1674) |

βc-1579 Target: 5'-CATCATCTTGTTCTTATAATTATTGCA-3' (SEQ ID NO: 2783)

|  | 5'-AUCAUCUUGUUCUUAUAAUUAUUGC-3' | (SEQ ID NO: 3893) |
|  | 3'-GGUAGUAGAACAAGAAUAUUAAUAACG-5' | (SEQ ID NO: 1675) |

βc-1580 Target: 5'-CCATCATCTTGTTCTTATAATTATTGC-3' (SEQ ID NO: 2784)

|  | 5'-ACCAUCAUCUUGUUCUUAUAAUUAU-3' | (SEQ ID NO: 3894) |
|  | 3'-UCUGGUAGUAGAACAAGAAUAUUAAUA-5' | (SEQ ID NO: 1676) |

βc-1583 Target: 5'-AGACCATCATCTTGTTCTTATAATTAT-3' (SEQ ID NO: 2785)

|  | 5'-AGACCAUCAUCUUGUUCUUAUAAUU-3' | (SEQ ID NO: 3895) |
|  | 3'-CGUCUGGUAGUAGAACAAGAAUAUUAA-5' | (SEQ ID NO: 1677) |

βc-1585 Target: 5'-GCAGACCATCATCTTGTTCTTATAATT-3' (SEQ ID NO: 2786)

|  | 5'-AAUCCAACAGUAGCCUUUAUCAGAG-3' | (SEQ ID NO: 3896) |
|  | 3'-AGUUAGGUUGUCAUCGGAAAUAGUCUC-5' | (SEQ ID NO: 1678) |

βc-1808 Target: 5'-TCAATCCAACAGTAGCCTTTATCAGAG-3' (SEQ ID NO: 2787)

|  | 5'-GAAUCAAUCCAACAGUAGCCUUUAU-3' | (SEQ ID NO: 3897) |
|  | 3'-AGCUUAGUUAGGUUGUCAUCGGAAAUA-5' | (SEQ ID NO: 1679) |

βc-1813 Target: 5'-TCGAATCAATCCAACAGTAGCCTTTAT-3' (SEQ ID NO: 2788)

|  | 5'-UCCACAAAUUGCUGCUGUGUCCCAC-3' | (SEQ ID NO: 3898) |
|  | 3'-GGAGGUGUUUAACGACGACACAGGGUG-5' | (SEQ ID NO: 1680) |

βc-1955 Target: 5'-CCTCCACAAATTGCTGCTGTGTCCCAC-3' (SEQ ID NO: 2789)

|  | 5'-ACAACCUUCAACUAUUUCUUCCAUG-3' | (SEQ ID NO: 3899) |
|  | 3'-CAUGUUGGAAGUUGAUAAAGAAGGUAC-5' | (SEQ ID NO: 1681) |

βc-1989 Target: 5'-GTACAACCTTCAACTATTTCTTCCATG-3' (SEQ ID NO: 2790)

|  | 5'-UACAACCUUCAACUAUUUCUUCCAU-3' | (SEQ ID NO: 3900) |
|  | 3'-CCAUGUUGGAAGUUGAUAAAGAAGGUA-5' | (SEQ ID NO: 1682) |

βc-1990 Target: 5'-GGTACAACCTTCAACTATTTCTTCC-3' (SEQ ID NO: 2791)

|  | 5'-GUACAACCUUCAACUAUUUCUUCCA-3' | (SEQ ID NO: 3901) |
|  | 3'-GCCAUGUUGGAAGUUGAUAAAGAAGGU-5' | (SEQ ID NO: 1683) |

βc-1991 Target: 5'-CGGTACAACCTTCAACTATTTCTTCCA-3' (SEQ ID NO: 2792)

|  | 5'-GGUACAACCUUCAACUAUUUCUUCC-3' | (SEQ ID NO: 3902) |
|  | 3'-GGCCAUGUUGGAAGUUGAUAAAGAAGG-5' | (SEQ ID NO: 1684) |

βc-1992 Target: 5'-CCGGTACAACCTTCAACTATTTCTTCC-3' (SEQ ID NO: 2793)

|  | 5'-GCUCCGGUACAACCUUCAACUAUUU-3' | (SEQ ID NO: 3903) |
|  | 3'-CCCGAGGCCAUGUUGGAAGUUGAUAAA-5' | (SEQ ID NO: 1685) |

βc-1997 Target: 5'-GGGCTCCGGTACAACCTTCAACTATTT-3' (SEQ ID NO: 2794)

|  | 5'-ACAAUUCGGUUGUGAACAUCCCGAG-3' | (SEQ ID NO: 3904) |
|  | 3'-AUUGUUAAGCCAACACUUGUAGGGCUC-5' | (SEQ ID NO: 1686) |

βc-2036 Target: 5'-TAACAATTCGGTTGTGAACATCCCGAG-3' (SEQ ID NO: 2795)

TABLE 11-continued

Additional Selected Anti-β-catenin DsiRNAs,
25/27mer Duplexes, Unmodified

```
                5'-AACAAUUCGGUUGUGAACAUCCCGA-3'    (SEQ ID NO: 3905)
                3'-UAUUGUUAAGCCAACACUUGUAGGGCU-5'  (SEQ ID NO: 1687)

βc-2037 Target: 5'-ATAACAATTCGGTTGTGAACATCCCGA-3'  (SEQ ID NO: 2796)

5'-UAACAAUUCGGUUGUGAACAUCCCG-3'    (SEQ ID NO: 3906)
                3'-CUAUUGUUAAGCCAACACUUGUAGGGC-5'  (SEQ ID NO: 1688)

βc-2038 Target: 5'-GATAACAATTCGGTTGTGAACATCCG-3'   (SEQ ID NO: 2797)

5'-AUAACAAUUCGGUUGUGAACAUCCC-3'    (SEQ ID NO: 3907)
                3'-ACUAUUGUUAAGCCAACACUUGUAGGG-5'  (SEQ ID NO: 1689)

βc-2039 Target: 5'-TGATAACAATTCGGTTGTGAACATCCC-3'  (SEQ ID NO: 2798)

5'-GAUAACAAUUCGGUUGUGAACAUCC-3'    (SEQ ID NO: 3908)
                3'-GACUAUUGUUAAGCCAACACUUGUAGG-5'  (SEQ ID NO: 1690)

βc-2040 Target: 5'-CTGATAACAATTCGGTTGTGAACATCC-3'  (SEQ ID NO: 2799)

5'-UGAUAACAAUUCGGUUGUGAACAUC-3'    (SEQ ID NO: 3909)
                3'-AGACUAUUGUUAAGCCAACACUUGUAG-5'  (SEQ ID NO: 1691)

βc-2041 Target: 5'-TCTGATAACAATTCGGTTGTGAACATC-3'  (SEQ ID NO: 2800)

5'-AUUUAGUCCUCUGAUAACAAUUCGG-3'    (SEQ ID NO: 3910)
                3'-CAUAAAUCAGGAGACUAUUGUUAAGCC-5'  (SEQ ID NO: 1692)

βc-2052 Target: 5'-GTATTTAGTCCTCTGATAACAATTCGG-3'  (SEQ ID NO: 2801)

5'-UAUUUAGUCCUCUGAUAACAAUUCG-3'    (SEQ ID NO: 3911)
                3'-CCAUAAAUCAGGAGACUAUUGUUAAGC-5'  (SEQ ID NO: 1693)

βc-2053 Target: 5'-GGTATTTAGTCCTCTGATAACAATTCG-3'  (SEQ ID NO: 2802)

5'-GUAUUUAGUCCUCUGAUAACAAUUC-3'    (SEQ ID NO: 3912)
                3'-ACCAUAAAUCAGGAGACUAUUGUUAAG-5'  (SEQ ID NO: 1694)

βc-2054 Target: 5'-TGGTATTTAGTCCTCTGATAACAATTC-3'  (SEQ ID NO: 2803)

5'-GGUAUUUAGUCCUCUGAUAACAAUU-3'    (SEQ ID NO: 3913)
                3'-UACCAUAAAUCAGGAGACUAUUGUUAA-5'  (SEQ ID NO: 1695)

βc-2055 Target: 5'-ATGGTATTTAGTCCTCTGATAACAATT-3'  (SEQ ID NO: 2804)

5'-ACAAUGGAAUGGUAUUUAGUCCUCU-3'    (SEQ ID NO: 3914)
                3'-UUUGUUACCUUACCAUAAAUCAGGAGA-5'  (SEQ ID NO: 1696)

βc-2065 Target: 5'-AAACAATGGAATGGTATTTAGTCCTCT-3'  (SEQ ID NO: 2805)

5'-ACAAACAAUGGAAUGGUAUUUAGUC-3'    (SEQ ID NO: 3915)
                3'-CGUGUUUGUUACCUUACCAUAAAUCAG-5'  (SEQ ID NO: 1697)

βc-2069 Target: 5'-GCACAAACAATGGAATGGTATTTAGTC-3'  (SEQ ID NO: 2806)

5'-GCACAAACAAUGGAAUGGUAUUUAG-3'    (SEQ ID NO: 3916)
                3'-GACGUGUUUGUUACCUUACCAUAAAUC-5'  (SEQ ID NO: 1698)

βc-2071 Target: 5'-CTGCACAAACAATGGAATGGTATTTAG-3'  (SEQ ID NO: 2807)

5'-UGCACAAACAAUGGAAUGGUAUUUA-3'    (SEQ ID NO: 3917)
                3'-CGACGUGUUUGUUACCUUACCAUAAAU-5'  (SEQ ID NO: 1699)

βc-2072 Target: 5'-GCTGCACAAACAATGGAATGGTATTTA-3'  (SEQ ID NO: 2808)

5'-GCUACUCUUUGGAUGUUUUCAUGG-3'     (SEQ ID NO: 3918)
                3'-GUCGAUGAGAAACCUACAAAAGUUACC-5'  (SEQ ID NO: 1700)

βc-2111 Target: 5'-CAGCTACTCTTTGGATGTTTTCAATGG-3'  (SEQ ID NO: 2809)

5'-AGCUACUCUUUGGAUGUUUUCAUG-3'     (SEQ ID NO: 3919)
                3'-CGUCGAUGAGAAACCUACAAAAGUUAC-5'  (SEQ ID NO: 1701)

βc-2112 Target: 5'-GCAGCTACTCTTTGGATGTTTTCAATG-3'  (SEQ ID NO: 2810)
```

TABLE 11-continued

Additional Selected Anti-β-catenin DsiRNAs,
25/27mer Duplexes, Unmodified

|  |  |  |
|---|---|---|
|  | 5'-GCUUCAAUAGCUUCUGCAGCUUCCU-3' | (SEQ ID NO: 3920) |
|  | 3'-GUCGAAGUUAUCGAAGACGUCGAAGGA-5' | (SEQ ID NO: 1702) |
| βc-2168 Target: | 5'-CAGCTTCAATAGCTTCTGCAGCTTCCT-3' | (SEQ ID NO: 2811) |
|  | 5'-UCCCUCAGCUUCAAUAGCUUCUGCA-3' | (SEQ ID NO: 3921) |
|  | 3'-CGAGGGAGUCGAAGUUAUCGAAGACGU-5' | (SEQ ID NO: 1703) |
| βc-2175 Target: | 5'-GCTCCCTCAGCTTCAATAGCTTCTGCA-3' | (SEQ ID NO: 2812) |
|  | 5'-GCUCCCUCAGCUUCAAUAGCUUCUG-3' | (SEQ ID NO: 3922) |
|  | 3'-ACCGAGGGAGUCGAAGUUAUCGAAGAC-5' | (SEQ ID NO: 1704) |
| βc-2177 Target: | 5'-TGGCTCCCTCAGCTTCAATAGCTTCTG-3' | (SEQ ID NO: 2813) |
|  | 5'-AUUCCUAGAGUGAAGUAACUCUGUC-3' | (SEQ ID NO: 3923) |
|  | 3'-AGUAAGGAUCUCACUUCAUUGAGACAG-5' | (SEQ ID NO: 1705) |
| βc-2214 Target: | 5'-TCATTCCTAGAGTGAAGTAACTCTGTC-3' | (SEQ ID NO: 2814) |
|  | 5'-UCAUUCCUAGAGUGAAGUAACUCUG-3' | (SEQ ID NO: 3924) |
|  | 3'-GAAGUAAGGAUCUCACUUCAUUGAGAC-5' | (SEQ ID NO: 1706) |
| βc-2216 Target: | 5'-CTTCATTCCTAGAGTGAAGTAACTCTG-3' | (SEQ ID NO: 2815) |
|  | 5'-UUCAUUCCUAGAGUGAAGUAACUCU-3' | (SEQ ID NO: 3925) |
|  | 3'-GGAAGUAAGGAUCUCACUUCAUUGAGA-5' | (SEQ ID NO: 1707) |
| βc-2217 Target: | 5'-CCTTCATTCCTAGAGTGAAGTAACTCT-3' | (SEQ ID NO: 2816) |
|  | 5'-UCCUCAGACAUUCGGAACAAAACAG-3' | (SEQ ID NO: 3926) |
|  | 3'-ACAGGAGUCUGUAAGCCUUGUUUUGUC-5' | (SEQ ID NO: 1708) |
| βc-2264 Target: | 5'-TGTCCTCAGACATTCGGAACAAAACAG-3' | (SEQ ID NO: 2817) |
|  | 5'-UGUCCUCAGACAUUCGGAACAAAAC-3' | (SEQ ID NO: 3927) |
|  | 3'-GAACAGGAGUCUGUAAGCCUUGUUUUG-5' | (SEQ ID NO: 1709) |
| βc-2266 Target: | 5'-CTTGTCCTCAGACATTCGGAACAAAAC-3' | (SEQ ID NO: 2818) |
|  | 5'-GUUUCUUGUAAUCUUGUGGCUUGUC-3' | (SEQ ID NO: 3928) |
|  | 3'-GGCAAAGAACAUUAGAACACCGAACAG-5' | (SEQ ID NO: 1710) |
| βc-2287 Target: | 5'-CCGTTTCTTGTAATCTTGTGGCTTGTC-3' | (SEQ ID NO: 2819) |
|  | 5'-UGAAAGCCGUUUCUUGUAAUCUUGU-3' | (SEQ ID NO: 3929) |
|  | 3'-UGACUUUCGGCAAAGAACAUUAGAACA-5' | (SEQ ID NO: 1711) |
| βc-2295 Target: | 5'-ACTGAAAGCCGTTTCTTGTAATCTTGT-3' | (SEQ ID NO: 2820) |
|  | 5'-GCUCAACUGAAAGCCGUUUCUUGUA-3' | (SEQ ID NO: 3930) |
|  | 3'-GUCGAGUUGACUUUCGGCAAAGAACAU-5' | (SEQ ID NO: 1712) |
| βc-2302 Target: | 5'-CAGCTCAACTGAAAGCCGTTTCTTGTA-3' | (SEQ ID NO: 2821) |
|  | 5'-AGUCCAAGAUCAGCAGUCUCAUUCC-3' | (SEQ ID NO: 3931) |
|  | 3'-GUUCAGGUUCUAGUCGUCAGAGUAAGG-5' | (SEQ ID NO: 1713) |
| βc-2363 Target: | 5'-CAAGTCCAAGATCAGCAGTCTCATTCC-3' | (SEQ ID NO: 2822) |
|  | 5'-ACCAAUAUCAAGUCCAAGAUCAGCA-3' | (SEQ ID NO: 3932) |
|  | 3'-CGUGGUUAUAGUUCAGGUUCUAGUCGU-5' | (SEQ ID NO: 1714) |
| βc-2373 Target: | 5'-GCACCAATATCAAGTCCAAGATCAGCA-3' | (SEQ ID NO: 2823) |
|  | 5'-AGAACGAUAGCUAGGAUCAUCCUGG-3' | (SEQ ID NO: 3933) |
|  | 3'-UUUCUUGCUAUCGAUCCUAGUAGGACC-5' | (SEQ ID NO: 1715) |
| βc-2424 Target: | 5'-AAAGAACGATAGCTAGGATCATCCTGG-3' | (SEQ ID NO: 2824) |
|  | 5'-UAUCCACCAGAGUGAAAAGAACGAU-3' | (SEQ ID NO: 3934) |
|  | 3'-GUAUAGGUGGUCUCACUUUUCUUGCUA-5' | (SEQ ID NO: 1716) |
| βc-2441 Target: | 5'-CATATCCACCAGAGTGAAAAGAACGAT-3' | (SEQ ID NO: 2825) |

TABLE 11-continued

Additional Selected Anti-β-catenin DsiRNAs,
25/27mer Duplexes, Unmodified

```
                5'-AUUUACAGGUCAGUAUCAAACCAGG-3'     (SEQ ID NO: 3935)
                3'-ACUAAAUGUCCAGUCAUAGUUUGGUCC-5'   (SEQ ID NO: 1717)

βc-2618 Target: 5'-TGATTTACAGGTCAGTATCAAACCAGG-3'   (SEQ ID NO: 2826)

5'-GAUUUACAGGUCAGUAUCAAACCAG-3'     (SEQ ID NO: 3936)
                3'-UACUAAAUGUCCAGUCAUAGUUUGGUC-5'   (SEQ ID NO: 1718)

βc-2619 Target: 5'-ATGATTTACAGGTCAGTATCAAACCAG-3'   (SEQ ID NO: 2827)

5'-UGAUUUACAGGUCAGUAUCAAACCA-3'     (SEQ ID NO: 3937)
                3'-CUACUAAAUGUCCAGUCAUAGUUUGGU-5'   (SEQ ID NO: 1719)

βc-2620 Target: 5'-GATGATTTACAGGTCAGTATCAAACCA-3'   (SEQ ID NO: 2828)

5'-UCUUACCUAAAGGAUGAUUUACAGG-3'     (SEQ ID NO: 3938)
                3'-GAAGAAUGGAUUUCCUACUAAAUGUCC-5'   (SEQ ID NO: 1720)

βc-2634 Target: 5'-CTTCTTACCTAAAGGATGATTTACAGG-3'   (SEQ ID NO: 2829)

5'-UUCUUACCUAAAGGAUGAUUUACAG-3'     (SEQ ID NO: 3939)
                3'-UGAAGAAUGGAUUUCCUACUAAAUGUC-5'   (SEQ ID NO: 1721)

βc-2635 Target: 5'-ACTTCTTACCTAAAGGATGATTTACAG-3'   (SEQ ID NO: 2830)

5'-ACUUCUUACCUAAAGGAUGAUUUAC-3'     (SEQ ID NO: 3940)
                3'-UUUGAAGAAUGGAUUUCCUACUAAAUG-5'   (SEQ ID NO: 1722)

βc-2637 Target: 5'-AAACTTCTTACCTAAAGGATGATTTAC-3'   (SEQ ID NO: 2831)

5'-UUUUUAAAACUUCUUACCUAAAGGA-3'     (SEQ ID NO: 3941)
                3'-CGAAAAAUUUUGAAGAAUGGAUUUCCU-5'   (SEQ ID NO: 1723)

βc-2645 Target: 5'-GCTTTTTAAAACTTCTTACCTAAAGGA-3'   (SEQ ID NO: 2832)

5'-GCUUUUUAAAACUUCUUACCUAAAG-3'     (SEQ ID NO: 3942)
                3'-ACCGAAAAAUUUUGAAGAAUGGAUUUC-5'   (SEQ ID NO: 1724)

βc-2647 Target: 5'-TGGCTTTTTAAAACTTCTTACCTAAAG-3'   (SEQ ID NO: 2833)

5'-AAACUGGCUUUUUAAAACUUCUUAC-3'     (SEQ ID NO: 3943)
                3'-GGUUUGACCGAAAAAUUUUGAAGAAUG-5'   (SEQ ID NO: 1725)

βc-2653 Target: 5'-CCAAACTGGCTTTTTAAAACTTCTTAC-3'   (SEQ ID NO: 2834)

5'-ACCCAAACUGGCUUUUUAAAACUUC-3'     (SEQ ID NO: 3944)
                3'-AAUGGGUUUGACCGAAAAAUUUUGAAG-5'   (SEQ ID NO: 1726)

βc-2657 Target: 5'-TTACCCAAACTGGCTTTTTAAAACTTC-3'   (SEQ ID NO: 2835)

5'-UACCCAAACUGGCUUUUUAAAACUU-3'     (SEQ ID NO: 3945)
                3'-AAAUGGGUUUGACCGAAAAAUUUUGAA-5'   (SEQ ID NO: 1727)

βc-2658 Target: 5'-TTTACCCAAACTGGCTTTTTAAAACTT-3'   (SEQ ID NO: 2836)

5'-UUACCCAAACUGGCUUUUUAAAACU-3'     (SEQ ID NO: 3946)
                3'-AAAAUGGGUUUGACCGAAAAAUUUUGA-5'   (SEQ ID NO: 1728)

βc-2659 Target: 5'-TTTTACCCAAACTGGCTTTTTAAAACT-3'   (SEQ ID NO: 2837)

5'-UUUACCCAAACUGGCUUUUUAAAAC-3'     (SEQ ID NO: 3947)
                3'-UAAAAUGGGUUUGACCGAAAAAUUUUG-5'   (SEQ ID NO: 1729)

βc-2660 Target: 5'-ATTTTACCCAAACTGGCTTTTTAAAAC-3'   (SEQ ID NO: 2838)

5'-AACCAAGUCUUUCUGAAGUUCUGUA-3'     (SEQ ID NO: 3948)
                3'-GGUUGGUUCAGAAAGACUUCAAGACAU-5'   (SEQ ID NO: 1730)

βc-2701 Target: 5'-CCAACCAAGTCTTTCTGAAGTTCTGTA-3'   (SEQ ID NO: 2839)

5'-ACCCUACCAACCAAGUCUUUCUGAA-3'     (SEQ ID NO: 3949)
                3'-GGUGGGAUGGUUGGUUCAGAAAGACUU-5'   (SEQ ID NO: 1731)

βc-2709 Target: 5'-CCACCCTACCAACCAAGTCTTTCTGAA-3'   (SEQ ID NO: 2840)
```

TABLE 11-continued

Additional Selected Anti-β-catenin DsiRNAs,
25/27mer Duplexes, Unmodified

|  |  |  |  |
|---|---|---|---|
|  | 5'-UUACAAAUAGCCUAAACCACUCCCA-3' | (SEQ ID NO: 3950) |  |
|  | 3'-UAAAUGUUUAUCGGAUUUGGUGAGGGU-5' | (SEQ ID NO: 1732) |  |
| βc-2733 Target: | 5'-ATTTACAAATAGCCTAAACCACTCCCA-3' | (SEQ ID NO: 2841) |  |
|  | 5'-UUUACAAAUAGCCUAAACCACUCCC-3' | (SEQ ID NO: 3951) |  |
|  | 3'-CUAAAUGUUUAUCGGAUUUGGUGAGGG-5' | (SEQ ID NO: 1733) |  |
| βc-2734 Target: | 5'-GATTTACAAATAGCCTAAACCACTCCC-3' | (SEQ ID NO: 2842) |  |
|  | 5'-AUUUACAAAUAGCCUAAACCACUCC-3' | (SEQ ID NO: 3952) |  |
|  | 3'-UCUAAAUGUUUAUCGGAUUUGGUGAGG-5' | (SEQ ID NO: 1734) |  |
| βc-2735 Target: | 5'-AGATTTACAAATAGCCTAAACCACTCC-3' | (SEQ ID NO: 2843) |  |
|  | 5'-GAUUUACAAAUAGCCUAAACCACUC-3' | (SEQ ID NO: 3953) |  |
|  | 3'-GUCUAAAUGUUUAUCGGAUUUGGUGAG-5' | (SEQ ID NO: 1735) |  |
| βc-2736 Target: | 5'-CAGATTTACAAATAGCCTAAACCACTC-3' | (SEQ ID NO: 2844) |  |
|  | 5'-UUUUUGUGGCAGAUUUACAAAUAGC-3' | (SEQ ID NO: 3954) |  |
|  | 3'-ACAAAAACACCGUCUAAAUGUUUAUCG-5' | (SEQ ID NO: 1736) |  |
| βc-2747 Target: | 5'-TGTTTTTGTGGCAGATTTACAAATAGC-3' | (SEQ ID NO: 2845) |  |
|  | 5'-GUUUUUGUGGCAGAUUUACAAAUAG-3' | (SEQ ID NO: 3955) |  |
|  | 3'-GACAAAAACACCGUCUAAAUGUUUAUC-5' | (SEQ ID NO: 1737) |  |
| βc-2748 Target: | 5'-CTGTTTTTGTGGCAGATTTACAAATAG-3' | (SEQ ID NO: 2846) |  |
|  | 5'-UGUUUUUGUGGCAGAUUUACAAAUA-3' | (SEQ ID NO: 3956) |  |
|  | 3'-GGACAAAAACACCGUCUAAAUGUUUAU-5' | (SEQ ID NO: 1738) |  |
| βc-2749 Target: | 5'-CCTGTTTTTGTGGCAGATTTACAAATA-3' | (SEQ ID NO: 2847) |  |
|  | 5'-AUACCUGUUUUUGUGGCAGAUUUAC-3' | (SEQ ID NO: 3957) |  |
|  | 3'-UAUAUGGACAAAAACACCGUCUAAAUG-5' | (SEQ ID NO: 1739) |  |
| βc-2754 Target: | 5'-ATATACCTGTTTTTGTGGCAGATTTAC-3' | (SEQ ID NO: 2848) |  |
|  | 5'-UUCAAAGUAUAUACCUGUUUUUGUG-3' | (SEQ ID NO: 3958) |  |
|  | 3'-GAAAGUUUCAUAUAUGGACAAAAACAC-5' | (SEQ ID NO: 1740) |  |
| βc-2764 Target: | 5'-CTTTCAAAGTATATACCTGTTTTTGTG-3' | (SEQ ID NO: 2849) |  |
|  | 5'-UCUCCUUUCAAAGUAUAUACCUGUU-3' | (SEQ ID NO: 3959) |  |
|  | 3'-GUAGAGGAAAGUUUCAUAUAUGGACAA-5' | (SEQ ID NO: 1741) |  |
| βc-2770 Target: | 5'-CATCTCCTTTCAAAGTATATACCTGTT-3' | (SEQ ID NO: 2850) |  |
|  | 5'-AUCUCCUUUCAAAGUAUAUACCUGU-3' | (SEQ ID NO: 3960) |  |
|  | 3'-UGUAGAGGAAAGUUUCAUAUAUGGACA-5' | (SEQ ID NO: 1742) |  |
| βc-2771 Target: | 5'-ACATCTCCTTTCAAAGTATATACCTGT-3' | (SEQ ID NO: 2851) |  |
|  | 5'-ACAUCUCCUUUCAAAGUAUAUACCU-3' | (SEQ ID NO: 3961) |  |
|  | 3'-UCUGUAGAGGAAAGUUUCAUAUAUGGA-5' | (SEQ ID NO: 1743) |  |
| βc-2773 Target: | 5'-AGACATCTCCTTTCAAAGTATATACCT-3' | (SEQ ID NO: 2852) |  |
|  | 5'-GACAUCUCCUUUCAAAGUAUAUACC-3' | (SEQ ID NO: 3962) |  |
|  | 3'-UUCUGUAGAGGAAAGUUUCAUAUAUGG-5' | (SEQ ID NO: 1744) |  |
| βc-2774 Target: | 5'-AAGACATCTCCTTTCAAAGTATATACC-3' | (SEQ ID NO: 2853) |  |
|  | 5'-AGACAUCUCCUUUCAAAGUAUAUAC-3' | (SEQ ID NO: 3963) |  |
|  | 3'-GUUCUGUAGAGGAAAGUUUCAUAUAUG-5' | (SEQ ID NO: 1745) |  |
| βc-2775 Target: | 5'-CAAGACATCTCCTTTCAAAGTATATAC-3' | (SEQ ID NO: 2854) |  |
|  | 5'-UUCCAAGACAUCUCCUUUCAAAGUA-3' | (SEQ ID NO: 3964) |  |
|  | 3'-ACAAGGUUCUGUAGAGGAAAGUUUCAU-5' | (SEQ ID NO: 1746) |  |
| βc-2780 Target: | 5'-TGTTCCAAGACATCTCCTTTCAAAGTA-3' | (SEQ ID NO: 2855) |  |

TABLE 11-continued

Additional Selected Anti-β-catenin DsiRNAs,
25/27mer Duplexes, Unmodified

```
                5'-UUCCAAUGUUCCAAGACAUCUCCUU-3'    (SEQ ID NO: 3965)
                3'-GUAAGGUUACAAGGUUCUGUAGAGGAA-5'  (SEQ ID NO: 1747)

βc-2788 Target: 5'-CATTCCAATGTTCCAAGACATCTCCTT-3'  (SEQ ID NO: 2856)

5'-AUUCCAAUGUUCCAAGACAUCUCCU-3'    (SEQ ID NO: 3966)
                3'-UGUAAGGUUACAAGGUUCUGUAGAGGA-5'  (SEQ ID NO: 1748)

βc-2789 Target: 5'-ACATTCCAATGTTCCAAGACATCTCCT-3'  (SEQ ID NO: 2857)

5'-ACAUUCCAAUGUUCCAAGACAUCUC-3'    (SEQ ID NO: 3967)
                3'-CUUGUAAGGUUACAAGGUUCUGUAGAG-5'  (SEQ ID NO: 1749)

βc-2791 Target: 5'-GAACATTCCAATGTTCCAAGACATCTC-3'  (SEQ ID NO: 2858)

5'-AGAAAUCUGAGAACAUUCCAAUGUU-3'    (SEQ ID NO: 3968)
                3'-GGUCUUUAGACUCUUGUAAGGUUACAA-5'  (SEQ ID NO: 1750)

βc-2803 Target: 5'-CCAGAAATCTGAGAACATTCCAATGTT-3'  (SEQ ID NO: 2859)

5'-AACCAGAAAUCUGAGAACAUUCCAA-3'    (SEQ ID NO: 3969)
                3'-UGUUGGUCUUUAGACUCUUGUAAGGUU-5'  (SEQ ID NO: 1751)

βc-2807 Target: 5'-ACAACCAGAAATCTGAGAACATTCCAA-3'  (SEQ ID NO: 2860)

5'-ACAACCAGAAAUCUGAGAACAUUCC-3'    (SEQ ID NO: 3970)
                3'-AUUGUUGGUCUUUAGACUCUUGUAAGG-5'  (SEQ ID NO: 1752)

βc-2809 Target: 5'-TAACAACCAGAAATCTGAGAACATTCC-3'  (SEQ ID NO: 2861)

5'-AACAACCAGAAAUCUGAGAACAUUC-3'    (SEQ ID NO: 3971)
                3'-UAUUGUUGGUCUUUAGACUCUUGUAAG-5'  (SEQ ID NO: 1753)

βc-2810 Target: 5'-ATAACAACCAGAAATCTGAGAACATTC-3'  (SEQ ID NO: 2862)

5'-UAACAACCAGAAAUCUGAGAACAUU-3'    (SEQ ID NO: 3972)
                3'-GUAUUGUUGGUCUUUAGACUCUUGUAA-5'  (SEQ ID NO: 1754)

βc-2811 Target: 5'-CATAACAACCAGAAATCTGAGAACATT-3'  (SEQ ID NO: 2863)

5'-AUCACAUAACAACCAGAAAUCUGAG-3'    (SEQ ID NO: 3973)
                3'-ACUAGUGUAUUGUUGGUCUUUAGACUC-5'  (SEQ ID NO: 1755)

βc-2817 Target: 5'-TGATCACATAACAACCAGAAATCTGAG-3'  (SEQ ID NO: 2864)

5'-GAUCACAUAACAACCAGAAAUCUGA-3'    (SEQ ID NO: 3974)
                3'-UACUAGUGUAUUGUUGGUCUUUAGACU-5'  (SEQ ID NO: 1756)

βc-2818 Target: 5'-ATGATCACATAACAACCAGAAATCTGA-3'  (SEQ ID NO: 2865)

5'-ACACAUGAUCACAUAACAACCAGAA-3'    (SEQ ID NO: 3975)
                3'-GGUGUGUACUAGUGUAUUGUUGGUCUU-5'  (SEQ ID NO: 1757)

βc-2824 Target: 5'-CCACACATGATCACATAACAACCAGAA-3'  (SEQ ID NO: 2866)

5'-UCCACACAUGAUCACAUAACAACCA-3'    (SEQ ID NO: 3976)
                3'-GAAGGUGUGUACUAGUGUAUUGUUGGU-5'  (SEQ ID NO: 1758)

βc-2827 Target: 5'-CTTCCACACATGATCACATAACAACCA-3'  (SEQ ID NO: 2867)

5'-UAACUUCCACACAUGAUCACAUAAC-3'    (SEQ ID NO: 3977)
                3'-UUAUUGAAGGUGUGUACUAGUGUAUUG-5'  (SEQ ID NO: 1759)

βc-2832 Target: 5'-AATAACTTCCACACATGATCACATAAC-3'  (SEQ ID NO: 2868)

5'-AUAACUUCCACACAUGAUCACAUAA-3'    (SEQ ID NO: 3978)
                3'-AUUAUUGAAGGUGUGUACUAGUGUAUU-5'  (SEQ ID NO: 1760)

βc-2833 Target: 5'-TAATAACTTCCACACATGATCACATAA-3'  (SEQ ID NO: 2869)

5'-AAUAACUUCCACACAUGAUCACAUA-3'    (SEQ ID NO: 3979)
                3'-AAUUAUUGAAGGUGUGUACUAGUGUAU-5'  (SEQ ID NO: 1761)

βc-2834 Target: 5'-TTAATAACTTCCACACATGATCACATA-3'  (SEQ ID NO: 2870)
```

TABLE 11-continued

Additional Selected Anti-β-catenin DsiRNAs,
25/27mer Duplexes, Unmodified

```
                5'-UAAUAACUUCCACACAUGAUCACAU-3'      (SEQ ID NO: 3980)
                3'-CAAUUAUUGAAGGUGUGUACUAGUGUA-5'    (SEQ ID NO: 1762)

βc-2835 Target: 5'-GTTAATAACTTCCACACATGATCAC-3'      (SEQ ID NO: 2871)

5'-UUAAAGUUAAUAACUUCCACACAUG-3'      (SEQ ID NO: 3981)
                3'-GUAAUUUCAAUUAUUGAAGGUGUGUAC-5'    (SEQ ID NO: 1763)

βc-2842 Target: 5'-CATTAAAGTTAATAACTTCCACACATG-3'    (SEQ ID NO: 2872)

5'-AUUAAAGUUAAUAACUUCCACACAU-3'      (SEQ ID NO: 3982)
                3'-UGUAAUUUCAAUUAUUGAAGGUGUGUA-5'    (SEQ ID NO: 1764)

βc-2843 Target: 5'-ACATTAAAGTTAATAACTTCCACAC-3'      (SEQ ID NO: 2873)

5'-ACAUUAAAGUUAAUAACUUCCACAC-3'      (SEQ ID NO: 3983)
                3'-UUUGUAAUUUCAAUUAUUGAAGGUGUG-5'    (SEQ ID NO: 1765)

βc-2845 Target: 5'-AAACATTAAAGTTAATAACTTCCACAC-3'    (SEQ ID NO: 2874)

5'-AACAUUAAAGUUAAUAACUUCCACA-3'      (SEQ ID NO: 3984)
                3'-UUUUGUAAUUUCAAUUAUUGAAGGUGU-5'    (SEQ ID NO: 1766)

βc-2846 Target: 5'-AAAACATTAAAGTTAATAACTTCCACA-3'    (SEQ ID NO: 2875)

5'-AAACAUUAAAGUUAAUAACUUCCAC-3'      (SEQ ID NO: 3985)
                3'-UUUUUGUAAUUUCAAUUAUUGAAGGUG-5'    (SEQ ID NO: 1767)

βc-2847 Target: 5'-AAAAACATTAAAGTTAATAACTTCCAC-3'    (SEQ ID NO: 2876)

5'-AAAACAUUAAAGUUAAUAACUUCCA-3'      (SEQ ID NO: 3986)
                3'-UUUUUUGUAAUUUCAAUUAUUGAAGGU-5'    (SEQ ID NO: 1768)

βc-2848 Target: 5'-AAAAAACATTAAAGTTAATAACTTCCA-3'    (SEQ ID NO: 2877)

5'-AAAAACAUUAAAGUUAAUAACUUCC-3'      (SEQ ID NO: 3987)
                3'-GUUUUUUGUAAUUUCAAUUAUUGAAGG-5'    (SEQ ID NO: 1769)

βc-2849 Target: 5'-CAAAAAACATTAAAGTTAATAACTTCC-3'    (SEQ ID NO: 2878)

5'-AAAAAACAUUAAAGUUAAUAACUUC-3'      (SEQ ID NO: 3988)
                3'-CGUUUUUUGUAAUUUCAAUUAUUGAAG-5'    (SEQ ID NO: 1770)

βc-2850 Target: 5'-GCAAAAAACATTAAAGTTAATAACTTC-3'    (SEQ ID NO: 2879)

5'-GCAAAAAACAUUAAAGUUAAUAACU-3'      (SEQ ID NO: 3989)
                3'-ACCGUUUUUUGUAAUUUCAAUUAUUGA-5'    (SEQ ID NO: 1771)

βc-2852 Target: 5'-TGGCAAAAAACATTAAAGTTAATAACT-3'    (SEQ ID NO: 2880)

5'-GGCAAAAAACAUUAAAGUUAAUAAC-3'      (SEQ ID NO: 3990)
                3'-CACCGUUUUUUGUAAUUUCAAUUAUUG-5'    (SEQ ID NO: 1772)

βc-2853 Target: 5'-GTGGCAAAAAACATTAAAGTTAATAAC-3'    (SEQ ID NO: 2881)

5'-GCAAAAGCUGUGGCAAAAAACAUUA-3'      (SEQ ID NO: 3991)
                3'-AACGUUUUCGACACCGUUUUUUGUAAU-5'    (SEQ ID NO: 1773)

βc-2864 Target: 5'-TTGCAAAAGCTGTGGCAAAAAACATTA-3'    (SEQ ID NO: 2882)

5'-UGCAAAAGCUGUGGCAAAAAACAUU-3'      (SEQ ID NO: 3992)
                3'-CAACGUUUUCGACACCGUUUUUUGUAA-5'    (SEQ ID NO: 1774)

βc-2865 Target: 5'-GTTGCAAAAGCTGTGGCAAAAAACATT-3'    (SEQ ID NO: 2883)

5'-UCAUUUGAGUAUUAAGUUGCAAAAG-3'      (SEQ ID NO: 3993)
                3'-UGAGUAAACUCAUAAUUCAACGUUUUC-5'    (SEQ ID NO: 1775)

βc-2882 Target: 5'-ACTCATTTGAGTATTAAGTTGCAAAAG-3'    (SEQ ID NO: 2884)

5'-AAAACAGCAAAUGUUACUCAUUUGA-3'      (SEQ ID NO: 3994)
                3'-AAUUUUGUCGUUUACAAUGAGUAAACU-5'    (SEQ ID NO: 1776)

βc-2899 Target: 5'-TTAAAACAGCAAATGTTACTCATTTGA-3'    (SEQ ID NO: 2885)
```

TABLE 11-continued

Additional Selected Anti-β-catenin DsiRNAs,
25/27mer Duplexes, Unmodified

```
                5'-UAAAACAGCAAAUGUUACUCAUUUG-3'    (SEQ ID NO: 3995)
                3'-AAAUUUUGUCGUUUACAAUGAGUAAAC-5'  (SEQ ID NO: 1777)

βc-2900 Target: 5'-TTTAAAACAGCAAATGTTACTCATTTG-3'   (SEQ ID NO: 2886)

5'-UUAAAACAGCAAAUGUUACUCAUUU-3'    (SEQ ID NO: 3996)
                3'-CAAAUUUUGUCGUUUACAAUGAGUAAA-5'  (SEQ ID NO: 1778)

βc-2901 Target: 5'-GTTTAAAACAGCAAATGTTACTCATTT-3'   (SEQ ID NO: 2887)

5'-UUUAAAACAGCAAAUGUUACUCAUU-3'    (SEQ ID NO: 3997)
                3'-ACAAAUUUUGUCGUUUACAAUGAGUAA-5'  (SEQ ID NO: 1779)

βc-2902 Target: 5'-TGTTTAAAACAGCAAATGTTACTCATT-3'   (SEQ ID NO: 2888)

5'-GUUUAAAACAGCAAAUGUUACUCAU-3'    (SEQ ID NO: 3998)
                3'-UACAAAUUUUGUCGUUUACAAUGAGUA-5'  (SEQ ID NO: 1780)

βc-2903 Target: 5'-ATGTTTAAAACAGCAAATGTTACTC-3'    (SEQ ID NO: 2889)

5'-UGUUUAAAACAGCAAAUGUUACUCA-3'    (SEQ ID NO: 3999)
                3'-UUACAAAUUUUGUCGUUUACAAUGAGU-5'  (SEQ ID NO: 1781)

βc-2904 Target: 5'-AATGTTTAAAACAGCAAATGTTACTCA-3'   (SEQ ID NO: 2890)

5'-AUUAAUGUUUAAAACAGCAAAUGUU-3'    (SEQ ID NO: 4000)
                3'-GAUAAUUACAAAUUUUGUCGUUUACAA-5'  (SEQ ID NO: 1782)

βc-2909 Target: 5'-CTATTAATGTTTAAAACAGCAAATGTT-3'   (SEQ ID NO: 2891)

5'-AGAAAGGCUGCUAUUAAUGUUUAAA-3'    (SEQ ID NO: 4001)
                3'-UCUCUUUCCGACGAUAAUUACAAAUUU-5'  (SEQ ID NO: 1783)

βc-2921 Target: 5'-AGAGAAAGGCTGCTATTAATGTTTAAA-3'   (SEQ ID NO: 2892)

5'-AGUUCAGACAAUACAGCUGUAUAAA-3'    (SEQ ID NO: 4002)
                3'-GUUCAAGUCUGUUAUGUCGACAUAUUU-5'  (SEQ ID NO: 1784)

βc-2949 Target: 5'-CAAGTTCAGACAATACAGCTGTATAAA-3'   (SEQ ID NO: 2893)

5'-ACAAUGCAAGUUCAGACAAUACAGC-3'    (SEQ ID NO: 4003)
                3'-AGUGUUACGUUCAAGUCUGUUAUGUCG-5'  (SEQ ID NO: 1785)

βc-2957 Target: 5'-TCACAATGCAAGTTCAGACAATACAGC-3'   (SEQ ID NO: 2894)

5'-UCACAAUGCAAGUUCAGACAAUACA-3'    (SEQ ID NO: 4004)
                3'-UUAGUGUUACGUUCAAGUCUGUUAUGU-5'  (SEQ ID NO: 1786)

βc-2959 Target: 5'-AATCACAATGCAAGTTCAGACAATACA-3'   (SEQ ID NO: 2895)

5'-AAUCACAAUGCAAGUUCAGACAAUA-3'    (SEQ ID NO: 4005)
                3'-GGUUAGUGUUACGUUCAAGUCUGUUAU-5'  (SEQ ID NO: 1787)

βc-2961 Target: 5'-CCAATCACAATGCAAGTTCAGACAATA-3'   (SEQ ID NO: 2896)

5'-GGCCAAUCACAAUGCAAGUUCAGAC-3'    (SEQ ID NO: 4006)
                3'-GUCCGGUUAGUGUUACGUUCAAGUCUG-5'  (SEQ ID NO: 1788)

βc-2965 Target: 5'-CAGGCCAATCACAATGCAAGTTCAGAC-3'   (SEQ ID NO: 2897)

5'-GUUCCCAUAGGAAACUCAGCUUGGU-3'    (SEQ ID NO: 4007)
                3'-AACAAGGGUAUCCUUUGAGUCGAACCA-5'  (SEQ ID NO: 1789)

βc-3052 Target: 5'-TTGTTCCCATAGGAAACTCAGCTTGGT-3'   (SEQ ID NO: 2898)

5'-UCAAUUGUUCCCAUAGGAAACUCAG-3'    (SEQ ID NO: 4008)
                3'-GAAGUUAACAAGGGUAUCCUUUGAGUC-5'  (SEQ ID NO: 1790)

βc-3058 Target: 5'-CTTCAATTGTTCCCATAGGAAACTCAG-3'   (SEQ ID NO: 2899)

5'-UUCAAUUGUUCCCAUAGGAAACUCA-3'    (SEQ ID NO: 4009)
                3'-UGAAGUUAACAAGGGUAUCCUUUGAGU-5'  (SEQ ID NO: 1791)

βc-3059 Target: 5'-ACTTCAATTGTTCCCATAGGAAACTCA-3'   (SEQ ID NO: 2900)
```

TABLE 11-continued

Additional Selected Anti-β-catenin DsiRNAs,
25/27mer Duplexes, Unmodified

|  |  |  |
|---|---|---|
|  | 5'-GUUUACUUCAAUUGUUCCCAUAGGA-3'<br>3'-UUCAAAUGAAGUUAACAAGGGUAUCCU-5' | (SEQ ID NO: 4010)<br>(SEQ ID NO: 1792) |
| βc-3065 Target: | 5'-AAGTTTACTTCAATTGTTCCCATAGGA-3' | (SEQ ID NO: 2901) |
|  | 5'-AGUUUACUUCAAUUGUUCCCAUAGG-3'<br>3'-UUUCAAAUGAAGUUAACAAGGGUAUCC-5' | (SEQ ID NO: 4011)<br>(SEQ ID NO: 1793) |
| βc-3066 Target: | 5'-AAAGTTTACTTCAATTGTTCCCATAGG-3' | (SEQ ID NO: 2902) |
|  | 5'-AAAAAGUUUACUUCAAUUGUUCCCA-3'<br>3'-UGUUUUUCAAAUGAAGUUAACAAGGGU-5' | (SEQ ID NO: 4012)<br>(SEQ ID NO: 1794) |
| βc-3070 Target: | 5'-ACAAAAGTTTACTTCAATTGTTCCCA-3' | (SEQ ID NO: 2903) |
|  | 5'-GAACAAAAGUUUACUUCAAUUGUU-3'<br>3'-GUCUUGUUUUUCAAAUGAAGUUAACAA-5' | (SEQ ID NO: 4013)<br>(SEQ ID NO: 1795) |
| βc-3074 Target: | 5'-CAGAACAAAAGTTTACTTCAATTGTT-3' | (SEQ ID NO: 2904) |
|  | 5'-GACCAGAACAAAAGUUUACUUCAA-3'<br>3'-UCCUGGUCUUGUUUUUCAAAUGAAGUU-5' | (SEQ ID NO: 4014)<br>(SEQ ID NO: 1796) |
| βc-3079 Target: | 5'-AGGACCAGAACAAAAGTTTACTTCAA-3' | (SEQ ID NO: 2905) |
|  | 5'-GGACCAGAACAAAAGUUUACUUCA-3'<br>3'-UUCCUGGUCUUGUUUUUCAAAUGAAGU-5' | (SEQ ID NO: 4015)<br>(SEQ ID NO: 1797) |
| βc-3080 Target: | 5'-AAGGACCAGAACAAAAGTTTACTTCA-3' | (SEQ ID NO: 2906) |
|  | 5'-ACCAAAAAGGACCAGAACAAAAAGU-3'<br>3'-GCUGGUUUUUCCUGGUCUUGUUUUUCA-5' | (SEQ ID NO: 4016)<br>(SEQ ID NO: 1798) |
| βc-3088 Target: | 5'-CGACCAAAAAGGACCAGAACAAAAAGT-3' | (SEQ ID NO: 2907) |
|  | 5'-GACCAAAAAGGACCAGAACAAAAAG-3'<br>3'-AGCUGGUUUUUCCUGGUCUUGUUUUUC-5' | (SEQ ID NO: 4017)<br>(SEQ ID NO: 1799) |
| βc-3089 Target: | 5'-TCGACCAAAAAGGACCAGAACAAAAAG-3' | (SEQ ID NO: 2908) |
|  | 5'-ACUCCUCGACCAAAAAGGACCAGAA-3'<br>3'-AAUGAGGAGCUGGUUUUUCCUGGUCUU-5' | (SEQ ID NO: 4018)<br>(SEQ ID NO: 1800) |
| βc-3096 Target: | 5'-TTACTCCTCGACCAAAAAGGACCAGAA-3' | (SEQ ID NO: 2909) |
|  | 5'-UCCAUUUGUAUUGUUACUCCUCGAC-3'<br>3'-UUAGGUAAACAUAACAAUGAGGAGCUG-5' | (SEQ ID NO: 4019)<br>(SEQ ID NO: 1801) |
| βc-3111 Target: | 5'-AATCCATTTGTATTGTTACTCCTCGAC-3' | (SEQ ID NO: 2910) |
|  | 5'-AUCCAUUUGUAUUGUUACUCCUCGA-3'<br>3'-UUUAGGUAAACAUAACAAUGAGGAGCU-5' | (SEQ ID NO: 4020)<br>(SEQ ID NO: 1802) |
| βc-3112 Target: | 5'-AAATCCATTTGTATTGTTACTCCTCGA-3' | (SEQ ID NO: 2911) |
|  | 5'-AAUCCAUUUGUAUUGUUACUCCUCG-3'<br>3'-UUUUAGGUAAACAUAACAAUGAGGAGC-5' | (SEQ ID NO: 4021)<br>(SEQ ID NO: 1803) |
| βc-3113 Target: | 5'-AAAATCCATTTGTATTGTTACTCCTCG-3' | (SEQ ID NO: 2912) |
|  | 5'-AAAUCCAUUUGUAUUGUUACUCCUC-3'<br>3'-GUUUUAGGUAAACAUAACAAUGAGGAG-5' | (SEQ ID NO: 4022)<br>(SEQ ID NO: 1804) |
| βc-3114 Target: | 5'-CAAAATCCATTTGTATTGTTACTCCTC-3' | (SEQ ID NO: 2913) |
|  | 5'-AAAAUCCAUUUGUAUUGUUACUCCU-3'<br>3'-GGUUUUAGGUAAACAUAACAAUGAGGA-5' | (SEQ ID NO: 4023)<br>(SEQ ID NO: 1805) |
| βc-3115 Target: | 5'-CCAAAATCCATTTGTATTGTTACTCCT-3' | (SEQ ID NO: 2914) |
|  | 5'-ACUCCCAAAAUCCAUUUGUAUUGUU-3'<br>3'-AGUGAGGGUUUUAGGUAAACAUAACAA-5' | (SEQ ID NO: 4024)<br>(SEQ ID NO: 1806) |
| βc-3121 Target: | 5'-TCACTCCCAAAATCCATTTGTATTGTT-3' | (SEQ ID NO: 2915) |

TABLE 11-continued

Additional Selected Anti-β-catenin DsiRNAs,
25/27mer Duplexes, Unmodified

```
                5'-UUCACUUCUUGAGUCACUCCCAAAA-3'    (SEQ ID NO: 4025)
                3'-AGAAGUGAAGAACUCAGUGAGGGUUUU-5'  (SEQ ID NO: 1807)

βc-3136 Target: 5'-TCTTCACTTCTTGAGTCACTCCCAAAA-3'  (SEQ ID NO: 2916)

5'-UCUUCACUUCUUGAGUCACUCCCAA-3'    (SEQ ID NO: 4026)
                3'-UAAGAAGUGAAGAACUCAGUGAGGGUU-5'  (SEQ ID NO: 1808)

βc-3138 Target: 5'-ATTCTTCACTTCTTGAGTCACTCCCAA-3'  (SEQ ID NO: 2917)

5'-UUCUUCACUUCUUGAGUCACUCCCA-3'    (SEQ ID NO: 4027)
                3'-GUAAGAAGUGAAGAACUCAGUGAGGGU-5'  (SEQ ID NO: 1809)

βc-3139 Target: 5'-CATTCTTCACTTCTTGAGTCACTCCCA-3'  (SEQ ID NO: 2918)

5'-AUUCUUCACUUCUUGAGUCACUCCC-3'    (SEQ ID NO: 4028)
                3'-CGUAAGAAGUGAAGAACUCAGUGAGGG-5'  (SEQ ID NO: 1810)

βc-3140 Target: 5'-GCATTCTTCACTTCTTGAGTCACTCCC-3'  (SEQ ID NO: 2919)

5'-GCAUUCUUCACUUCUUGAGUCACUC-3'    (SEQ ID NO: 4029)
                3'-CACGUAAGAAGUGAAGAACUCAGUGAG-5'  (SEQ ID NO: 1811)

βc-3142 Target: 5'-GTGCATTCTTCACTTCTTGAGTCACTC-3'  (SEQ ID NO: 2920)

5'-AUUCUUGUGCAUUCUUCACUUCUUG-3'    (SEQ ID NO: 4030)
                3'-GGUAAGAACACGUAAGAAGUGAAGAAC-5'  (SEQ ID NO: 1812)

βc-3150 Target: 5'-CCATTCTTGTGCATTCTTCACTTCTTG-3'  (SEQ ID NO: 2921)

5'-UCCAUUCUUGUGCAUUCUUCACUUC-3'    (SEQ ID NO: 4031)
                3'-CUAGGUAAGAACACGUAAGAAGUGAAG-5'  (SEQ ID NO: 1813)

βc-3153 Target: 5'-GATCCATTCTTGTGCATTCTTCACTTC-3'  (SEQ ID NO: 2922)

5'-AUCCAUUCUUGUGCAUUCUUCACUU-3'    (SEQ ID NO: 4032)
                3'-ACUAGGUAAGAACACGUAAGAAGUGAA-5'  (SEQ ID NO: 1814)

βc-3154 Target: 5'-TGATCCATTCTTGTGCATTCTTCACTT-3'  (SEQ ID NO: 2923)

5'-GAUCCAUUCUUGUGCAUUCUUCACU-3'    (SEQ ID NO: 4033)
                3'-CACUAGGUAAGAACACGUAAGAAGUGA-5'  (SEQ ID NO: 1815)

βc-3155 Target: 5'-GTGATCCATTCTTGTGCATTCTTCACT-3'  (SEQ ID NO: 2924)

5'-AAUUCCAUCUUGUGAUCCAUUCUUG-3'    (SEQ ID NO: 4034)
                3'-AUUUAAGGUAGAACACUAGGUAAGAAC-5'  (SEQ ID NO: 1816)

βc-3168 Target: 5'-TAAATTCCATCTTGTGATCCATTCTTG-3'  (SEQ ID NO: 2925)

5'-UAAAUUCCAUCUUGUGAUCCAUUCU-3'    (SEQ ID NO: 4035)
                3'-CUAUUUAAGGUAGAACACUAGGUAAGA-5'  (SEQ ID NO: 1817)

βc-3170 Target: 5'-GATAAATTCCATCTTGTGATCCATTCT-3'  (SEQ ID NO: 2926)

5'-AUAAAUUCCAUCUUGUGAUCCAUUC-3'    (SEQ ID NO: 4036)
                3'-ACUAUUUAAGGUAGAACACUAGGUAAG-5'  (SEQ ID NO: 1818)

βc-3171 Target: 5'-TGATAAATTCCATCTTGTGATCCATTC-3'  (SEQ ID NO: 2927)

5'-GAUAAAUUCCAUCUUGUGAUCCAUU-3'    (SEQ ID NO: 4037)
                3'-AACUAUUUAAGGUAGAACACUAGGUAA-5'  (SEQ ID NO: 1819)

βc-3172 Target: 5'-TTGATAAATTCCATCTTGTGATCCATT-3'  (SEQ ID NO: 2928)

5'-UGAUAAAUUCCAUCUUGUGAUCCAU-3'    (SEQ ID NO: 4038)
                3'-AAACUAUUUAAGGUAGAACACUAGGUA-5'  (SEQ ID NO: 1820)

βc-3173 Target: 5'-TTTGATAAATTCCATCTTGTGATCC-3'    (SEQ ID NO: 2929)

5'-GGCUAGGGUUUGAUAAAUUCCAUCU-3'    (SEQ ID NO: 4039)
                3'-UUCCGAUCCCAAACUAUUUAAGGUAGA-5'  (SEQ ID NO: 1821)

βc-3183 Target: 5'-AAGGCTAGGGTTTGATAAATTCCATCT-3'  (SEQ ID NO: 2930)
```

TABLE 11-continued

Additional Selected Anti-β-catenin DsiRNAs,
25/27mer Duplexes, Unmodified

|  |  |  |
|---|---|---|
|  | 5'-AAAAAUUUAACAAGCAAGGCUAGGG-3' | (SEQ ID NO: 4040) |
|  | 3'-UUUUUUUAAAUUGUUCGUUCCGAUCCC-5' | (SEQ ID NO: 1822) |
| βc-3200 Target: | 5'-AAAAAAATTTAACAAGCAAGGCTAGGG-3' | (SEQ ID NO: 2931) |
|  | 5'-AAAAAAAAAAAAAAUUUAACAAGCA-3' | (SEQ ID NO: 4041) |
|  | 3'-UUUUUUUUUUUUUUUAAAUUGUUCGU-5' | (SEQ ID NO: 1823) |
| βc-3209 Target: | 5'-AAAAAAAAAAAAAAATTTAACAAGCA-3' | (SEQ ID NO: 2932) |
|  | 5'-AAAAAAAAAAAAAAAUUUAACAAGC-3' | (SEQ ID NO: 4042) |
|  | 3'-UUUUUUUUUUUUUUUUAAAUUGUUCG-5' | (SEQ ID NO: 1824) |
| βc-3210 Target: | 5'-AAAAAAAAAAAAAAAATTTAACAAGC-3' | (SEQ ID NO: 2933) |
|  | 5'-AAAAAAAAAAAAAAAAUUUAACAAG-3' | (SEQ ID NO: 4043) |
|  | 3'-UUUUUUUUUUUUUUUUUAAAUUGUUC-5' | (SEQ ID NO: 1825) |
| βc-3211 Target: | 5'-AAAAAAAAAAAAAAAAATTTAACAAG-3' | (SEQ ID NO: 2934) |
|  | 5'-AAAAAAAAAAAAAAAAAUUUAACAA-3' | (SEQ ID NO: 4044) |
|  | 3'-UUUUUUUUUUUUUUUUUUAAAUUGUU-5' | (SEQ ID NO: 1826) |
| βc-3212 Target: | 5'-AAAAAAAAAAAAAAAAAATTTAACAA-3' | (SEQ ID NO: 2935) |
|  | 5'-AAAAAAAAAAAAAAAAAAUUUAACA-3' | (SEQ ID NO: 4045) |
|  | 3'-AUUUUUUUUUUUUUUUUUUAAAUUGU-5' | (SEQ ID NO: 1827) |
| βc-3213 Target: | 5'-TAAAAAAAAAAAAAAAAAATTTAACA-3' | (SEQ ID NO: 2936) |
|  | 5'-AAAAAAAAAAAAAAAAAAAUUUAAC-3' | (SEQ ID NO: 4046) |
|  | 3'-AAUUUUUUUUUUUUUUUUUUAAAUUG-5' | (SEQ ID NO: 1828) |
| βc-3214 Target: | 5'-TTAAAAAAAAAAAAAAAAAATTTAAC-3' | (SEQ ID NO: 2937) |
|  | 5'-UAAAAAAAAAAAAAAAAAAAUUUAA-3' | (SEQ ID NO: 4047) |
|  | 3'-GAAUUUUUUUUUUUUUUUUUUAAAUU-5' | (SEQ ID NO: 1829) |
| βc-3215 Target: | 5'-CTTAAAAAAAAAAAAAAAAAATTTAA-3' | (SEQ ID NO: 2938) |
|  | 5'-UUAAAAAAAAAAAAAAAAAAAUUUA-3' | (SEQ ID NO: 4048) |
|  | 3'-AGAAUUUUUUUUUUUUUUUUUUAAAU-5' | (SEQ ID NO: 1830) |
| βc-3216 Target: | 5'-TCTTAAAAAAAAAAAAAAAAAATTTA-3' | (SEQ ID NO: 2939) |
|  | 5'-UCUUAAAAAAAAAAAAAAAAAAAUU-3' | (SEQ ID NO: 4049) |
|  | 3'-UAAGAAUUUUUUUUUUUUUUUUUUAA-5' | (SEQ ID NO: 1831) |
| βc-3218 Target: | 5'-ATTCTTAAAAAAAAAAAAAAAAAATT-3' | (SEQ ID NO: 2940) |
|  | 5'-UUCUUAAAAAAAAAAAAAAAAAAAU-3' | (SEQ ID NO: 4050) |
|  | 3'-AUAAGAAUUUUUUUUUUUUUUUUUUA-5' | (SEQ ID NO: 1832) |
| βc-3219 Target: | 5'-TATTCTTAAAAAAAAAAAAAAAAAAT-3' | (SEQ ID NO: 2941) |
|  | 5'-AUUCUUAAAAAAAAAAAAAAAAAAA-3' | (SEQ ID NO: 4051) |
|  | 3'-UAUAAGAAUUUUUUUUUUUUUUUUUU-5' | (SEQ ID NO: 1833) |
| βc-3220 Target: | 5'-ATATTCTTAAAAAAAAAAAAAAAAAA-3' | (SEQ ID NO: 2942) |
|  | 5'-UAUUCUUAAAAAAAAAAAAAAAAAA-3' | (SEQ ID NO: 4052) |
|  | 3'-CUAUAAGAAUUUUUUUUUUUUUUUUU-5' | (SEQ ID NO: 1834) |
| βc-3221 Target: | 5'-GATATTCTTAAAAAAAAAAAAAAAAA-3' | (SEQ ID NO: 2943) |
|  | 5'-AUAUUCUUAAAAAAAAAAAAAAAAA-3' | (SEQ ID NO: 4053) |
|  | 3'-UCUAUAAGAAUUUUUUUUUUUUUUUU-5' | (SEQ ID NO: 1835) |
| βc-3222 Target: | 5'-AGATATTCTTAAAAAAAAAAAAAAAA-3' | (SEQ ID NO: 2944) |
|  | 5'-GAUAUUCUUAAAAAAAAAAAAAAAA-3' | (SEQ ID NO: 4054) |
|  | 3'-GUCUAUAAGAAUUUUUUUUUUUUUUU-5' | (SEQ ID NO: 1836) |
| βc-3223 Target: | 5'-CAGATATTCTTAAAAAAAAAAAAAAA-3' | (SEQ ID NO: 2945) |

TABLE 11-continued

Additional Selected Anti-β-catenin DsiRNAs,
25/27mer Duplexes, Unmodified

```
                5'-AGAUAUUCUUAAAAAAAAAAAAAA-3'      (SEQ ID NO: 4055)
                3'-UGUCUAUAAGAAUUUUUUUUUUUUU-5'     (SEQ ID NO: 1837)

βc-3224 Target: 5'-ACAGATATTCTTAAAAAAAAAAAAAA-3'    (SEQ ID NO: 2946)

5'-UUACAGAUAUUCUUAAAAAAAAAAA-3'     (SEQ ID NO: 4056)
                3'-GUAAUGUCUAUAAGAAUUUUUUUUUUU-5'   (SEQ ID NO: 1838)

βc-3228 Target: 5'-CATTACAGATATTCTTAAAAAAAAAA-3'    (SEQ ID NO: 2947)

5'-AUUACAGAUAUUCUUAAAAAAAAAA-3'     (SEQ ID NO: 4057)
                3'-GGUAAUGUCUAUAAGAAUUUUUUUUU-5'    (SEQ ID NO: 1839)

βc-3229 Target: 5'-CCATTACAGATATTCTTAAAAAAAAA-3'    (SEQ ID NO: 2948)

5'-UACCAUUACAGAUAUUCUUAAAAAA-3'     (SEQ ID NO: 4058)
                3'-UCAUGGUAAUGUCUAUAAGAAUUUUUU-5'   (SEQ ID NO: 1840)

βc-3233 Target: 5'-AGTACCATTACAGATATTCTTAAAAA-3'    (SEQ ID NO: 2949)

5'-GUACCAUUACAGAUAUUCUUAAAAA-3'     (SEQ ID NO: 4059)
                3'-GUCAUGGUAAUGUCUAUAAGAAUUUUU-5'   (SEQ ID NO: 1841)

βc-3234 Target: 5'-CAGTACCATTACAGATATTCTTAAAA-3'    (SEQ ID NO: 2950)

5'-AGUACCAUUACAGAUAUUCUUAAAA-3'     (SEQ ID NO: 4060)
                3'-AGUCAUGGUAAUGUCUAUAAGAAUUUU-5'   (SEQ ID NO: 1842)

βc-3235 Target: 5'-TCAGTACCATTACAGATATTCTTAAA-3'    (SEQ ID NO: 2951)

5'-AGUCAGUACCAUUACAGAUAUUCUU-3'     (SEQ ID NO: 4061)
                3'-UUUCAGUCAUGGUAAUGUCUAUAAGAA-5'   (SEQ ID NO: 1843)

βc-3239 Target: 5'-AAAGTCAGTACCATTACAGATATTCTT-3'   (SEQ ID NO: 2952)

5'-UACUUCAAAGCAAGCAAAGUCAGUA-3'     (SEQ ID NO: 4062)
                3'-CGAUGAAGUUUCGUUCGUUUCAGUCAU-5'   (SEQ ID NO: 1844)

βc-3256 Target: 5'-GCTACTTCAAAGCAAGCAAAGTCAGTA-3'   (SEQ ID NO: 2953)

5'-AAAAAGAGCUACUUCAAAGCAAGCA-3'     (SEQ ID NO: 4063)
                3'-UUUUUUUCUCGAUGAAGUUUCGUUCGU-5'   (SEQ ID NO: 1845)

βc-3265 Target: 5'-AAAAAAAGAGCTACTTCAAAGCAAGCA-3'   (SEQ ID NO: 2954)

5'-AAAAAAAAAAGAGCUACUUCAAAGC-3'     (SEQ ID NO: 4064)
                3'-UUUUUUUUUUUUCUCGAUGAAGUUUCG-5'   (SEQ ID NO: 1846)

βc-3270 Target: 5'-AAAAAAAAAAAAGAGCTACTTCAAAGC-3'   (SEQ ID NO: 2955)

5'-AAAAAAAAAAAGAGCUACUUCAAAG-3'     (SEQ ID NO: 4065)
                3'-UUUUUUUUUUUUUCUCGAUGAAGUUUC-5'   (SEQ ID NO: 1847)

βc-3271 Target: 5'-AAAAAAAAAAAAAGAGCTACTTCAAAG-3'   (SEQ ID NO: 2956)

5'-AAAAAAAAAAAAAGAGCUACUUCAA-3'     (SEQ ID NO: 4066)
                3'-UUUUUUUUUUUUUUUCUCGAUGAAGUU-5'   (SEQ ID NO: 1848)

βc-3273 Target: 5'-AAAAAAAAAAAAAAAGAGCTACTTCAA-3'   (SEQ ID NO: 2957)

5'-AAAAAAAAAAAAAAGAGCUACUUCA-3'     (SEQ ID NO: 4067)
                3'-UUUUUUUUUUUUUUUUCUCGAUGAAGU-5'   (SEQ ID NO: 1849)

βc-3274 Target: 5'-AAAAAAAAAAAAAAAAGAGCTACTTCA-3'   (SEQ ID NO: 2958)

5'-AAAAAAAAAAAAAAAGAGCUACUUC-3'     (SEQ ID NO: 4068)
                3'-UUUUUUUUUUUUUUUUUCUCGAUGAAG-5'   (SEQ ID NO: 1850)

βc-3275 Target: 5'-AAAAAAAAAAAAAAAAAGAGCTACTTC-3'   (SEQ ID NO: 2959)

5'-AAAAAAAAAAAAAAAAGAGCUACUU-3'     (SEQ ID NO: 4069)
                3'-UUUUUUUUUUUUUUUUUUCUCGAUGAA-5'   (SEQ ID NO: 1851)

βc-3276 Target: 5'-AAAAAAAAAAAAAAAAAAGAGCTACTT-3'   (SEQ ID NO: 2960)
```

TABLE 11-continued

Additional Selected Anti-β-catenin DsiRNAs,
25/27mer Duplexes, Unmodified

```
             5'-AAAAAAAAAAAAAAAAAAAAAAGAG-3'      (SEQ ID NO: 4070)
             3'-UUUUUUUUUUUUUUUUUUUUUUUCUC-5'    (SEQ ID NO: 1852)

βc-3282 Target:  5'-AAAAAAAAAAAAAAAAAAAAAAGAG-3'  (SEQ ID NO: 2961)

5'-AAAAAAAAAAAAAAAAAAAAAAAGA-3'      (SEQ ID NO: 4071)
             3'-UUUUUUUUUUUUUUUUUUUUUUUCU-5'     (SEQ ID NO: 1853)

βc-3283 Target:  5'-AAAAAAAAAAAAAAAAAAAAAAAGA-3'  (SEQ ID NO: 2962)

5'-AAAAAAAAAAAAAAAAAAAAAAAAG-3'      (SEQ ID NO: 4072)
             3'-GUUUUUUUUUUUUUUUUUUUUUUUC-5'     (SEQ ID NO: 1854)

βc-3284 Target:  5'-CAAAAAAAAAAAAAAAAAAAAAAG-3'  (SEQ ID NO: 2963)

5'-AAAAAAAAAAAAAAAAAAAAAAAAA-3'      (SEQ ID NO: 4073)
             3'-CGUUUUUUUUUUUUUUUUUUUUUUU-5'     (SEQ ID NO: 1855)

βc-3285 Target:  5'-GCAAAAAAAAAAAAAAAAAAAAAA-3'  (SEQ ID NO: 2964)

5'-GCAAAAAAAAAAAAAAAAAAAAAAA-3'     (SEQ ID NO: 4074)
             3'-GACGUUUUUUUUUUUUUUUUUUUUU-5'     (SEQ ID NO: 1856)

βc-3287 Target:  5'-CTGCAAAAAAAAAAAAAAAAAAAAA-3' (SEQ ID NO: 2965)

5'-UGCAAAAAAAAAAAAAAAAAAAAAA-3'     (SEQ ID NO: 4075)
             3'-UGACGUUUUUUUUUUUUUUUUUUUU-5'     (SEQ ID NO: 1857)

βc-3288 Target:  5'-ACTGCAAAAAAAAAAAAAAAAAAAA-3' (SEQ ID NO: 2966)

5'-UUACUGCAAAAAAAAAAAAAAAAAA-3'     (SEQ ID NO: 4076)
             3'-UCAAUGACGUUUUUUUUUUUUUUUU-5'     (SEQ ID NO: 1858)

βc-3292 Target:  5'-AGTTACTGCAAAAAAAAAAAAAAAA-3' (SEQ ID NO: 2967)

5'-GUUACUGCAAAAAAAAAAAAAAAAA-3'     (SEQ ID NO: 4077)
             3'-GUCAAUGACGUUUUUUUUUUUUUUU-5'     (SEQ ID NO: 1859)

βc-3293 Target:  5'-CAGTTACTGCAAAAAAAAAAAAAAA-3' (SEQ ID NO: 2968)

5'-AGUUACUGCAAAAAAAAAAAAAAAA-3'     (SEQ ID NO: 4078)
             3'-UGUCAAUGACGUUUUUUUUUUUUUU-5'     (SEQ ID NO: 1860)

βc-3294 Target:  5'-ACAGTTACTGCAAAAAAAAAAAAAA-3' (SEQ ID NO: 2969)

5'-AAACAGUUACUGCAAAAAAAAAAAA-3'     (SEQ ID NO: 4079)
             3'-UUUUUGUCAAUGACGUUUUUUUUUU-5'     (SEQ ID NO: 1861)

βc-3298 Target:  5'-AAAAACAGTTACTGCAAAAAAAAAA-3' (SEQ ID NO: 2970)

5'-AAAACAGUUACUGCAAAAAAAAAAA-3'     (SEQ ID NO: 4080)
             3'-UUUUUUGUCAAUGACGUUUUUUUUU-5'     (SEQ ID NO: 1862)

βc-3299 Target:  5'-AAAAAACAGTTACTGCAAAAAAAAA-3' (SEQ ID NO: 2971)

5'-AAAAACAGUUACUGCAAAAAAAAAA-3'     (SEQ ID NO: 4081)
             3'-AUUUUUUGUCAAUGACGUUUUUUUU-5'     (SEQ ID NO: 1863)

βc-3300 Target:  5'-TAAAAAACAGTTACTGCAAAAAAAA-3' (SEQ ID NO: 2972)

5'-UAAAAAACAGUUACUGCAAAAAAAA-3'     (SEQ ID NO: 4082)
             3'-GAAUUUUUUGUCAAUGACGUUUUUU-5'     (SEQ ID NO: 1864)

βc-3302 Target:  5'-CTTAAAAAACAGTTACTGCAAAAAAA-3' (SEQ ID NO: 2973)

5'-UUAAAAAACAGUUACUGCAAAAAAA-3'    (SEQ ID NO: 4083)
             3'-UGAAUUUUUUGUCAAUGACGUUUUU-5'     (SEQ ID NO: 1865)

βc-3303 Target:  5'-ACTTAAAAAACAGTTACTGCAAAAAA-3' (SEQ ID NO: 2974)

5'-ACUUAAAAAACAGUUACUGCAAAAA-3'    (SEQ ID NO: 4084)
             3'-UCUGAAUUUUUUGUCAAUGACGUUU-5'     (SEQ ID NO: 1866)

βc-3305 Target:  5'-AGACTTAAAAAACAGTTACTGCAAAAA-3' (SEQ ID NO: 2975)
```

TABLE 11-continued

Additional Selected Anti-β-catenin DsiRNAs, 25/27mer Duplexes, Unmodified

|  |  |  |  |
|---|---|---|---|
| | 5'-ACUACGAGAGACUUAAAAAACAGUU-3' | (SEQ ID NO: 4085) |
| | 3'-UGUGAUGCUCUCUGAAUUUUUGUCAA-5' | (SEQ ID NO: 1867) |
| βc-3315 Target: | 5'-ACACTACGAGAGACTTAAAAAACAGTT-3' | (SEQ ID NO: 2976) |
| | 5'-ACACUACGAGAGACUUAAAAAACAG-3' | (SEQ ID NO: 4086) |
| | 3'-AUUGUGAUGCUCUCUGAAUUUUUGUC-5' | (SEQ ID NO: 1868) |
| βc-3317 Target: | 5'-TAACACTACGAGAGACTTAAAAAACAG-3' | (SEQ ID NO: 2977) |
| | 5'-AACACUACGAGAGACUUAAAAAACA-3' | (SEQ ID NO: 4087) |
| | 3'-AAUUGUGAUGCUCUCUGAAUUUUUGU-5' | (SEQ ID NO: 1869) |
| βc-3318 Target: | 5'-TTAACACTACGAGAGACTTAAAAAACA-3' | (SEQ ID NO: 2978) |
| | 5'-UUAACACUACGAGAGACUUAAAAAA-3' | (SEQ ID NO: 4088) |
| | 3'-UGAAUUGUGAUGCUCUCUGAAUUUUU-5' | (SEQ ID NO: 1870) |
| βc-3320 Target: | 5'-ACTTAACACTACGAGAGACTTAAAAAA-3' | (SEQ ID NO: 2979) |
| | 5'-AACUUAACACUACGAGAGACUUAAA-3' | (SEQ ID NO: 4089) |
| | 3'-UAUUGAAUUGUGAUGCUCUCUGAAUUU-5' | (SEQ ID NO: 1871) |
| βc-3323 Target: | 5'-ATAACTTAACACTACGAGAGACTTAAA-3' | (SEQ ID NO: 2980) |
| | 5'-UAACUUAACACUACGAGAGACUUAA-3' | (SEQ ID NO: 4090) |
| | 3'-AUAUUGAAUUGUGAUGCUCUCUGAAUU-5' | (SEQ ID NO: 1872) |
| βc-3324 Target: | 5'-TATAACTTAACACTACGAGAGACTTAA-3' | (SEQ ID NO: 2981) |
| | 5'-AUUCACUAUAACUUAACACUACGAG-3' | (SEQ ID NO: 4091) |
| | 3'-CAUAAGUGAUAUUGAAUUGUGAUGCUC-5' | (SEQ ID NO: 1873) |
| βc-3332 Target: | 5'-GTATTCACTATAACTTAACACTACGAG-3' | (SEQ ID NO: 2982) |
| | 5'-UAUUCACUAUAACUUAACACUACGA-3' | (SEQ ID NO: 4092) |
| | 3'-UCAUAAGUGAUAUUGAAUUGUGAUGCU-5' | (SEQ ID NO: 1874) |
| βc-3333 Target: | 5'-AGTATTCACTATAACTTAACACTACGA-3' | (SEQ ID NO: 2983) |
| | 5'-GUAUUCACUAUAACUUAACACUACG-3' | (SEQ ID NO: 4093) |
| | 3'-GUCAUAAGUGAUAUUGAAUUGUGAUGC-5' | (SEQ ID NO: 1875) |
| βc-3334 Target: | 5'-CAGTATTCACTATAACTTAACACTACG-3' | (SEQ ID NO: 2984) |
| | 5'-AGUAUUCACUAUAACUUAACACUAC-3' | (SEQ ID NO: 4094) |
| | 3'-CGUCAUAAGUGAUAUUGAAUUGUGAUG-5' | (SEQ ID NO: 1876) |
| βc-3335 Target: | 5'-GCAGTATTCACTATAACTTAACACTAC-3' | (SEQ ID NO: 2985) |
| | 5'-AAAUUGCUGUAGCAGUAUUCACUAU-3' | (SEQ ID NO: 4095) |
| | 3'-UCUUUAACGACAUCGUCAUAAGUGAUA-5' | (SEQ ID NO: 1877) |
| βc-3348 Target: | 5'-AGAAATTGCTGTAGCAGTATTCACTAT-3' | (SEQ ID NO: 2986) |
| | 5'-GAAAUUGCUGUAGCAGUAUUCACUA-3' | (SEQ ID NO: 4096) |
| | 3'-AUCUUUAACGACAUCGUCAUAAGUGAU-5' | (SEQ ID NO: 1878) |
| βc-3349 Target: | 5'-TAGAAATTGCTGTAGCAGTATTCACTA-3' | (SEQ ID NO: 2987) |
| | 5'-AGAAAUUGCUGUAGCAGUAUUCACU-3' | (SEQ ID NO: 4097) |
| | 3'-AAUCUUUAACGACAUCGUCAUAAGUGA-5' | (SEQ ID NO: 1879) |
| βc-3350 Target: | 5'-TTAGAAATTGCTGTAGCAGTATTCACT-3' | (SEQ ID NO: 2988) |
| | 5'-UCAAUUCUUAAAAAUUAGAAAUUGC-3' | (SEQ ID NO: 4098) |
| | 3'-UGAGUUAAGAAUUUUUAAUCUUUAACG-5' | (SEQ ID NO: 1880) |
| βc-3366 Target: | 5'-ACTCAATTCTTAAAAATTAGAAATTGC-3' | (SEQ ID NO: 2989) |
| | 5'-AUUACUCAAUUCUUAAAAAUUAGAA-3' | (SEQ ID NO: 4099) |
| | 3'-GGUAAUGAGUUAAGAAUUUUUAAUCUU-5' | (SEQ ID NO: 1881) |
| βc-3371 Target: | 5'-CCATTACTCAATTCTTAAAAATTAGAA-3' | (SEQ ID NO: 2990) |

TABLE 11-continued

Additional Selected Anti-β-catenin DsiRNAs,
25/27mer Duplexes, Unmodified

```
                 5'-ACCAUUACUCAAUUCUUAAAAAUUA-3'   (SEQ ID NO: 4100)
                 3'-UGUGGUAAUGAGUUAAGAAUUUUUAAU-5' (SEQ ID NO: 1882)

βc-3374 Target:  5'-ACACCATTACTCAATTCTTAAAAATTA-3' (SEQ ID NO: 2991)

5'-ACACCAUUACUCAAUUCUUAAAAAU-3'   (SEQ ID NO: 4101)
                 3'-GAUGUGGUAAUGAGUUAAGAAUUUUUA-5' (SEQ ID NO: 1883)

βc-3376 Target:  5'-CTACACCATTACTCAATTCTTAAAAT-3'  (SEQ ID NO: 2992)

5'-UACACCAUUACUCAAUUCUUAAAAA-3'   (SEQ ID NO: 4102)
                 3'-AGAUGUGGUAAUGAGUUAAGAAUUUUU-5' (SEQ ID NO: 1884)

βc-3377 Target:  5'-TCTACACCATTACTCAATTCTTAAAA-3'  (SEQ ID NO: 2993)

5'-UCUACACCAUUACUCAAUUCUUAAA-3'   (SEQ ID NO: 4103)
                 3'-CAAGAUGUGGUAAUGAGUUAAGAAUUU-5' (SEQ ID NO: 1885)

βc-3379 Target:  5'-GTTCTACACCATTACTCAATTCTTAAA-3' (SEQ ID NO: 2994)

5'-GUUCUACACCAUUACUCAAUUCUUA-3'   (SEQ ID NO: 4104)
                 3'-CACAAGAUGUGGUAAUGAGUUAAGAAU-5' (SEQ ID NO: 1886)

βc-3381 Target:  5'-GTGTTCTACACCATTACTCAATTCTTA-3' (SEQ ID NO: 2995)

5'-GAAUUAGUGUUCUACACCAUUACUC-3'   (SEQ ID NO: 4105)
                 3'-UACUUAAUCACAAGAUGUGGUAAUGAG-5' (SEQ ID NO: 1887)

βc-3389 Target:  5'-ATGAATTAGTGTTCTACACCATTACTC-3' (SEQ ID NO: 2996)

5'-AUUAUGAAUUAGUGUUCUACACCAU-3'   (SEQ ID NO: 4106)
                 3'-ACUAAUACUUAAUCACAAGAUGUGGUA-5' (SEQ ID NO: 1888)

βc-3394 Target:  5'-TGATTATGAATTAGTGTTCTACACC-3'   (SEQ ID NO: 2997)

5'-GAUUAUGAAUUAGUGUUCUACACCA-3'   (SEQ ID NO: 4107)
                 3'-CACUAAUACUUAAUCACAAGAUGUGGU-5' (SEQ ID NO: 1889)

βc-3395 Target:  5'-GTGATTATGAATTAGTGTTCTACACCA-3' (SEQ ID NO: 2998)

5'-UGAUUAUGAAUUAGUGUUCUACACC-3'   (SEQ ID NO: 4108)
                 3'-UCACUAAUACUUAAUCACAAGAUGUGG-5' (SEQ ID NO: 1890)

βc-3396 Target:  5'-AGTGATTATGAATTAGTGTTCTACACC-3' (SEQ ID NO: 2999)

5'-UAAUUAGAGUGAUUAUGAAUUAGUG-3'   (SEQ ID NO: 4109)
                 3'-UAAUUAAUCUCACUAAUACUUAAUCAC-5' (SEQ ID NO: 1891)

βc-3405 Target:  5'-ATTAATTAGAGTGATTATGAATTAGTG-3' (SEQ ID NO: 3000)

5'-UUAAUUAGAGUGAUUAUGAAUUAGU-3'   (SEQ ID NO: 4110)
                 3'-UUAAUUAAUCUCACUAAUACUUAAUCA-5' (SEQ ID NO: 1892)

βc-3406 Target:  5'-AATTAATTAGAGTGATTATGAATTAGT-3' (SEQ ID NO: 3001)

5'-AUUAAUUAGAGUGAUUAUGAAUUAG-3'   (SEQ ID NO: 4111)
                 3'-GUUAAUUAAUCUCACUAAUACUUAAUC-5' (SEQ ID NO: 1893)

βc-3407 Target:  5'-CAATTAATTAGAGTGATTATGAATTAG-3' (SEQ ID NO: 3002)

5'-UACAAUUAAUUAGAGUGAUUAUGAA-3'   (SEQ ID NO: 4112)
                 3'-UAAUGUUAAUUAAUCUCACUAAUACUU-5' (SEQ ID NO: 1894)

βc-3411 Target:  5'-ATTACAATTAATTAGAGTGATTATGAA-3' (SEQ ID NO: 3003)

5'-UUACAAUUAAUUAGAGUGAUUAUGA-3'   (SEQ ID NO: 4113)
                 3'-CUAAUGUUAAUUAAUCUCACUAAUACU-5' (SEQ ID NO: 1895)

βc-3412 Target:  5'-GATTACAATTAATTAGAGTGATTATGA-3' (SEQ ID NO: 3004)

5'-AUUACAAUUAAUUAGAGUGAUUAUG-3'   (SEQ ID NO: 4114)
                 3'-UCUAAUGUUAAUUAAUCUCACUAAUAC-5' (SEQ ID NO: 1896)

βc-3413 Target:  5'-AGATTACAATTAATTAGAGTGATTATG-3' (SEQ ID NO: 3005)
```

TABLE 11-continued

Additional Selected Anti-β-catenin DsiRNAs,
25/27mer Duplexes, Unmodified

```
                5'-UUAUUCAGAUUACAAUUAAUUAGAG-3'      (SEQ ID NO: 4115)
                3'-GAAAUAAGUCUAAUGUUAAUUAAUCUC-5'    (SEQ ID NO: 1897)

βc-3421 Target: 5'-CTTTATTCAGATTACAATTAATTAGAG-3'    (SEQ ID NO: 3006)

5'-UUUAUUCAGAUUACAAUUAAUUAGA-3'      (SEQ ID NO: 4116)
                3'-UGAAAUAAGUCUAAUGUUAAUUAAUCU-5'    (SEQ ID NO: 1898)

βc-3422 Target: 5'-ACTTTATTCAGATTACAATTAATTAGA-3'    (SEQ ID NO: 3007)

5'-ACACUUUAUUCAGAUUACAAUUAAU-3'      (SEQ ID NO: 4117)
                3'-AAUGUGAAAUAAGUCUAAUGUUAAUUA-5'    (SEQ ID NO: 1899)

βc-3426 Target: 5'-TTACACTTTATTCAGATTACAATTAAT-3'    (SEQ ID NO: 3008)

5'-UACACUUUAUUCAGAUUACAAUUAA-3'      (SEQ ID NO: 4118)
                3'-CAAUGUGAAAUAAGUCUAAUGUUAAUU-5'    (SEQ ID NO: 1900)

βc-3427 Target: 5'-GTTACACTTTATTCAGATTACAATTAA-3'    (SEQ ID NO: 3009)

5'-UUACACUUUAUUCAGAUUACAAUUA-3'      (SEQ ID NO: 4119)
                3'-ACAAUGUGAAAUAAGUCUAAUGUUAAU-5'    (SEQ ID NO: 1901)

βc-3428 Target: 5'-TGTTACACTTTATTCAGATTACAATTA-3'    (SEQ ID NO: 3010)

5'-GUUACACUUUAUUCAGAUUACAAUU-3'      (SEQ ID NO: 4120)
                3'-AACAAUGUGAAAUAAGUCUAAUGUUAA-5'    (SEQ ID NO: 1902)

βc-3429 Target: 5'-TTGTTACACTTTATTCAGATTACAATT-3'    (SEQ ID NO: 3011)

5'-UGUUACACUUUAUUCAGAUUACAAU-3'      (SEQ ID NO: 4121)
                3'-UAACAAUGUGAAAUAAGUCUAAUGUUA-5'    (SEQ ID NO: 1903)

βc-3430 Target: 5'-ATTGTTACACTTTATTCAGATTACAAT-3'    (SEQ ID NO: 3012)

5'-ACACAAUUGUUACACUUUAUUCAGA-3'      (SEQ ID NO: 4122)
                3'-GAUGUGUUAACAAUGUGAAAUAAGUCU-5'    (SEQ ID NO: 1904)

βc-3437 Target: 5'-CTACACAATTGTTACACTTTATTCAGA-3'    (SEQ ID NO: 3013)

5'-GGCUACACAAUUGUUACACUUUAUU-3'      (SEQ ID NO: 4123)
                3'-UUCCGAUGUGUUAACAAUGUGAAAUAA-5'    (SEQ ID NO: 1905)

βc-3441 Target: 5'-AAGGCTACACAATTGTTACACTTTATT-3'    (SEQ ID NO: 3014)

5'-AAAAAGGCUACACAAUUGUUACACU-3'      (SEQ ID NO: 4124)
                3'-UGUUUUUCCGAUGUGUUAACAAUGUGA-5'    (SEQ ID NO: 1906)

βc-3446 Target: 5'-ACAAAAAGGCTACACAATTGTTACACT-3'    (SEQ ID NO: 3015)

5'-UUAUACAAAAGGCUACACAAUUGU-3'       (SEQ ID NO: 4125)
                3'-AAAAUAUGUUUUUCCGAUGUGUUAACA-5'    (SEQ ID NO: 1907)

βc-3452 Target: 5'-TTTTATACAAAAGGCTACACAATTGT-3'     (SEQ ID NO: 3016)

5'-UUUAUACAAAAGGCUACACAAUUG-3'       (SEQ ID NO: 4126)
                3'-UAAAAUAUGUUUUUCCGAUGUGUUAAC-5'    (SEQ ID NO: 1908)

βc-3453 Target: 5'-ATTTTATACAAAAGGCTACACAATTG-3'     (SEQ ID NO: 3017)

5'-AUUUUAUACAAAAGGCUACACAAU-3'       (SEQ ID NO: 4127)
                3'-GAUAAAAUAUGUUUUUCCGAUGUGUUA-5'    (SEQ ID NO: 1909)

βc-3455 Target: 5'-CTATTTTATACAAAAGGCTACACAAT-3'    (SEQ ID NO: 3018)

5'-UAUUUUAUACAAAAGGCUACACAA-3'       (SEQ ID NO: 4128)
                3'-AGAUAAAAUAUGUUUUUCCGAUGUGUU-5'    (SEQ ID NO: 1910)

βc-3456 Target: 5'-TCTATTTTATACAAAAGGCTACACAA-3'    (SEQ ID NO: 3019)

5'-UCUAUUUUAUACAAAAGGCUACAC-3'       (SEQ ID NO: 4129)
                3'-ACAGAUAAAAUAUGUUUUUCCGAUGUG-5'    (SEQ ID NO: 1911)

βc-3458 Target: 5'-TGTCTATTTTATACAAAAGGCTACAC-3'    (SEQ ID NO: 3020)
```

TABLE 11-continued

Additional Selected Anti-β-catenin DsiRNAs,
25/27mer Duplexes, Unmodified

```
                5'-UAUUUGUCUAUUUUAUACAAAAAGG-3'    (SEQ ID NO: 4130)
                3'-AGAUAAACAGAUAAAAUAUGUUUUCC-5'   (SEQ ID NO: 1912)

βc-3464 Target: 5'-TCTATTTGTCTATTTTATACAAAAAGG-3'  (SEQ ID NO: 3021)

5'-UCUAUUUGUCUAUUUUAUACAAAAA-3'    (SEQ ID NO: 4131)
                3'-AAAGAUAAACAGAUAAAAUAUGUUUUU-5'  (SEQ ID NO: 1913)

βc-3466 Target: 5'-TTTCTATTTGTCTATTTTATACAAAAA-3'  (SEQ ID NO: 3022)

5'-UUCUAUUUGUCUAUUUUAUACAAAA-3'    (SEQ ID NO: 4132)
                3'-AAAAGAUAAACAGAUAAAAUAUGUUUU-5'  (SEQ ID NO: 1914)

βc-3467 Target: 5'-TTTTCTATTTGTCTATTTTATACAAAA-3'  (SEQ ID NO: 3023)

5'-UUUCUAUUUGUCUAUUUUAUACAAA-3'    (SEQ ID NO: 4133)
                3'-UAAAAGAUAAACAGAUAAAAUAUGUUU-5'  (SEQ ID NO: 1915)

βc-3468 Target: 5'-ATTTTCTATTTGTCTATTTTATACAAA-3'  (SEQ ID NO: 3024)

5'-UUUUCUAUUUGUCUAUUUUAUACAA-3'    (SEQ ID NO: 4134)
                3'-GUAAAAGAUAAACAGAUAAAAUAUGUU-5'  (SEQ ID NO: 1916)

βc-3469 Target: 5'-CATTTTCTATTTGTCTATTTTATACAA-3'  (SEQ ID NO: 3025)

5'-AUUUUCUAUUUGUCUAUUUUAUACA-3'    (SEQ ID NO: 4135)
                3'-GGUAAAAGAUAAACAGAUAAAAUAUGU-5'  (SEQ ID NO: 1917)

βc-3470 Target: 5'-CCATTTTCTATTTGTCTATTTTATACA-3'  (SEQ ID NO: 3026)

5'-ACCAUUUUCUAUUUGUCUAUUUUAU-3'    (SEQ ID NO: 4136)
                3'-CCUGGUAAAAGAUAAACAGAUAAAAUA-5'  (SEQ ID NO: 1918)

βc-3473 Target: 5'-GGACCATTTTCTATTTGTCTATTTTAT-3'  (SEQ ID NO: 3027)

5'-GACCAUUUUCUAUUUGUCUAUUUUA-3'    (SEQ ID NO: 4137)
                3'-ACCUGGUAAAAGAUAAACAGAUAAAAU-5'  (SEQ ID NO: 1919)

βc-3474 Target: 5'-TGGACCATTTTCTATTTGTCTATTTTA-3'  (SEQ ID NO: 3028)

5'-GGACCAUUUUCUAUUUGUCUAUUUU-3'    (SEQ ID NO: 4138)
                3'-AACCUGGUAAAAGAUAAACAGAUAAAA-5'  (SEQ ID NO: 1920)

βc-3475 Target: 5'-TTGGACCATTTTCTATTTGTCTATTTT-3'  (SEQ ID NO: 3029)

5'-ACUAAUUGGACCAUUUUCUAUUUGU-3'    (SEQ ID NO: 4139)
                3'-UUUGAUUAACCUGGUAAAAGAUAAACA-5'  (SEQ ID NO: 1921)

βc-3482 Target: 5'-AAACTAATTGGACCATTTTCTATTTGT-3'  (SEQ ID NO: 3030)

5'-AACUAAUUGGACCAUUUUCUAUUUG-3'    (SEQ ID NO: 4140)
                3'-CUUUGAUUAACCUGGUAAAAGAUAAAC-5'  (SEQ ID NO: 1922)

βc-3483 Target: 5'-GAAACTAATTGGACCATTTTCTATTTG-3'  (SEQ ID NO: 3031)

5'-AAACUAAUUGGACCAUUUUCUAUUU-3'    (SEQ ID NO: 4141)
                3'-CCUUUGAUUAACCUGGUAAAAGAUAAA-5'  (SEQ ID NO: 1923)

βc-3484 Target: 5'-GGAAACTAATTGGACCATTTTCTATTT-3'  (SEQ ID NO: 3032)

5'-GAAACUAAUUGGACCAUUUUCUAUU-3'    (SEQ ID NO: 4142)
                3'-UCCUUUGAUUAACCUGGUAAAAGAUAA-5'  (SEQ ID NO: 1924)

βc-3485 Target: 5'-AGGAAACTAATTGGACCATTTTCTATT-3'  (SEQ ID NO: 3033)

5'-AAAAAGGAAACUAAUUGGACCAUUU-3'    (SEQ ID NO: 4143)
                3'-AAUUUUUCCUUUGAUUAACCUGGUAAA-5'  (SEQ ID NO: 1925)

βc-3491 Target: 5'-TTAAAAAGGAAACTAATTGGACCATTT-3'  (SEQ ID NO: 3034)

5'-UAAAAAGGAAACUAAUUGGACCAUU-3'    (SEQ ID NO: 4144)
                3'-UAAUUUUUCCUUUGAUUAACCUGGUAA-5'  (SEQ ID NO: 1926)

βc-3492 Target: 5'-ATTAAAAAGGAAACTAATTGGACCATT-3'  (SEQ ID NO: 3035)
```

TABLE 11-continued

Additional Selected Anti-β-catenin DsiRNAs,
25/27mer Duplexes, Unmodified

|  |  |  |
|---|---|---|
|  | 5'-GCAUAUUAAAAAGGAAACUAAUUGG-3'<br>3'-UUCGUAUAAUUUUUCCUUUGAUUAACC-5' | (SEQ ID NO: 4145)<br>(SEQ ID NO: 1927) |
| βc-3498 Target: | 5'-AAGCATATTAAAAAGGAAACTAATTGG-3' | (SEQ ID NO: 3036) |
|  | 5'-AGCAUAUUAAAAAGGAAACUAAUUG-3'<br>3'-AUUCGUAUAAUUUUUCCUUUGAUUAAC-5' | (SEQ ID NO: 4146)<br>(SEQ ID NO: 1928) |
| βc-3499 Target: | 5'-TAAGCATATTAAAAAGGAAACTAATTG-3' | (SEQ ID NO: 3037) |
|  | 5'-UUUAAGCAUAUUAAAAAGGAAACUA-3'<br>3'-UAAAAUUCGUAUAAUUUUUCCUUUGAU-5' | (SEQ ID NO: 4147)<br>(SEQ ID NO: 1929) |
| βc-3503 Target: | 5'-ATTTTAAGCATATTAAAAAGGAAACTA-3' | (SEQ ID NO: 3038) |
|  | 5'-GCUUAUUUUAAGCAUAUUAAAAAGG-3'<br>3'-GACGAAUAAAAUUCGUAUAAUUUUUCC-5' | (SEQ ID NO: 4148)<br>(SEQ ID NO: 1930) |
| βc-3509 Target: | 5'-CTGCTTATTTTAAGCATATTAAAAGG-3' | (SEQ ID NO: 3039) |
|  | 5'-UGCUUAUUUUAAGCAUAUUAAAAAG-3'<br>3'-GGACGAAUAAAAUUCGUAUAAUUUUUC-5' | (SEQ ID NO: 4149)<br>(SEQ ID NO: 1931) |
| βc-3510 Target: | 5'-CCTGCTTATTTTAAGCATATTAAAAG-3' | (SEQ ID NO: 3040) |
|  | 5'-UCCACCUGCUUAUUUUAAGCAUAUU-3'<br>3'-CUAGGUGGACGAAUAAAAUUCGUAUAA-5' | (SEQ ID NO: 4150)<br>(SEQ ID NO: 1932) |
| βc-3516 Target: | 5'-GATCCACCTGCTTATTTTAAGCATATT-3' | (SEQ ID NO: 3041) |
|  | 5'-AAAACAUGAAAUAGAUCCACCUGCU-3'<br>3'-GUUUUUGUACUUUAUCUAGGUGGACGA-5' | (SEQ ID NO: 4151)<br>(SEQ ID NO: 1933) |
| βc-3531 Target: | 5'-CAAAAACATGAAATAGATCCACCTGCT-3' | (SEQ ID NO: 3042) |
|  | 5'-AAAACAUGAAAUAGAUCCACCUGC-3'<br>3'-AGUUUUUGUACUUUAUCUAGGUGGACG-5' | (SEQ ID NO: 4152)<br>(SEQ ID NO: 1934) |
| βc-3532 Target: | 5'-TCAAAAACATGAAATAGATCCACCTGC-3' | (SEQ ID NO: 3043) |
|  | 5'-UCAAAAACAUGAAAUAGAUCCACCU-3'<br>3'-CUAGUUUUUGUACUUUAUCUAGGUGGA-5' | (SEQ ID NO: 4153)<br>(SEQ ID NO: 1935) |
| βc-3534 Target: | 5'-GATCAAAAACATGAAATAGATCCACCT-3' | (SEQ ID NO: 3044) |
|  | 5'-AUCAAAAACAUGAAAUAGAUCCACC-3'<br>3'-ACUAGUUUUUGUACUUUAUCUAGGUGG-5' | (SEQ ID NO: 4154)<br>(SEQ ID NO: 1936) |
| βc-3535 Target: | 5'-TGATCAAAAACATGAAATAGATCCACC-3' | (SEQ ID NO: 3045) |
|  | 5'-GAUCAAAAACAUGAAAUAGAUCCAC-3'<br>3'-AACUAGUUUUUGUACUUUAUCUAGGUG-5' | (SEQ ID NO: 4155)<br>(SEQ ID NO: 1937) |
| βc-3536 Target: | 5'-TTGATCAAAAACATGAAATAGATCCAC-3' | (SEQ ID NO: 3046) |
|  | 5'-UUUUUGAUCAAAAACAUGAAAUAGA-3'<br>3'-UCAAAAACAGUUUUUGUACUUUAUCU-5' | (SEQ ID NO: 4156)<br>(SEQ ID NO: 1938) |
| βc-3541 Target: | 5'-AGTTTTTGATCAAAAACATGAAATAGA-3' | (SEQ ID NO: 3047) |
|  | 5'-AAAUAGUUUUUGAUCAAAAACAUGA-3'<br>3'-GGUUUAUCAAAAACUAGUUUUUGUACU-5' | (SEQ ID NO: 4157)<br>(SEQ ID NO: 1939) |
| βc-3547 Target: | 5'-CCAAATAGTTTTTGATCAAAAACATGA-3' | (SEQ ID NO: 3048) |
|  | 5'-UCCCAAAUAGUUUUUGAUCAAAAAC-3'<br>3'-AUAGGGUUUAUCAAAAACUAGUUUUUG-5' | (SEQ ID NO: 4158)<br>(SEQ ID NO: 1940) |
| βc-3551 Target: | 5'-TATCCCAAATAGTTTTTGATCAAAAAC-3' | (SEQ ID NO: 3049) |
|  | 5'-AUCCCAAAUAGUUUUUGAUCAAAAA-3'<br>3'-UAUAGGGUUUAUCAAAAACUAGUUUUU-5' | (SEQ ID NO: 4159)<br>(SEQ ID NO: 1941) |
| βc-3552 Target: | 5'-ATATCCCAAATAGTTTTTGATCAAAAA-3' | (SEQ ID NO: 3050) |

TABLE 11-continued

Additional Selected Anti-β-catenin DsiRNAs,
25/27mer Duplexes, Unmodified

|  |  |  |
|---|---|---|
|  | 5'-UAUCCCAAAUAGUUUUUGAUCAAAA-3'<br>3'-GUAUAGGGUUUAUCAAAAACUAGUUUU-5' | (SEQ ID NO: 4160)<br>(SEQ ID NO: 1942) |
| βc-3553 Target: | 5'-CATATCCCAAATAGTTTTTGATCAAAA-3' | (SEQ ID NO: 3051) |
|  | 5'-AUAUCCCAAAUAGUUUUUGAUCAAA-3'<br>3'-UGUAUAGGGUUUAUCAAAAACUAGUUU-5' | (SEQ ID NO: 4161)<br>(SEQ ID NO: 1943) |
| βc-3554 Target: | 5'-ACATATCCCAAATAGTTTTTGATCAAA-3' | (SEQ ID NO: 3052) |
|  | 5'-AUACAUAUCCCAAAUAGUUUUUGAU-3'<br>3'-GGUAUGUAUAGGGUUUAUCAAAAACUA-5' | (SEQ ID NO: 4162)<br>(SEQ ID NO: 1944) |
| βc-3558 Target: | 5'-CCATACATATCCCAAATAGTTTTTGAT-3' | (SEQ ID NO: 3053) |
|  | 5'-ACCCUACCCAUACAUAUCCCAAAUA-3'<br>3'-AAUGGGAUGGGUAUGUAUAGGGUUUAU-5' | (SEQ ID NO: 4163)<br>(SEQ ID NO: 1945) |
| βc-3567 Target: | 5'-TTACCCTACCCATACATATCCCAAATA-3' | (SEQ ID NO: 3054) |
|  | 5'-UACCCUACCCAUACAUAUCCCAAAU-3'<br>3'-AAAUGGGAUGGGUAUGUAUAGGGUUUA-5' | (SEQ ID NO: 4164)<br>(SEQ ID NO: 1946) |
| βc-3568 Target: | 5'-TTTACCCTACCCATACATATCCCAAAT-3' | (SEQ ID NO: 3055) |
|  | 5'-UUACCCUACCCAUACAUAUCCCAAA-3'<br>3'-UAAAUGGGAUGGGUAUGUAUAGGGUUU-5' | (SEQ ID NO: 4165)<br>(SEQ ID NO: 1947) |
| βc-3569 Target: | 5'-ATTTACCCTACCCATACATATCCCAAA-3' | (SEQ ID NO: 3056) |
|  | 5'-ACCUCUUACUGAUUUACCCUACCCA-3'<br>3'-UGUGGAGAAUGACUAAAUGGGAUGGGU-5' | (SEQ ID NO: 4166)<br>(SEQ ID NO: 1948) |
| βc-3582 Target: | 5'-ACACCTCTTACTGATTTACCCTACCCA-3' | (SEQ ID NO: 3057) |
|  | 5'-ACACCUCUUACUGAUUUACCCUACC-3'<br>3'-AUUGUGGAGAAUGACUAAAUGGGAUGG-5' | (SEQ ID NO: 4167)<br>(SEQ ID NO: 1949) |
| βc-3584 Target: | 5'-TAACACCTCTTACTGATTTACCCTACC-3' | (SEQ ID NO: 3058) |
|  | 5'-AACACCUCUUACUGAUUUACCCUAC-3'<br>3'-UAUUGUGGAGAAUGACUAAAUGGGAUG-5' | (SEQ ID NO: 4168)<br>(SEQ ID NO: 1950) |
| βc-3585 Target: | 5'-ATAACACCTCTTACTGATTTACCCTAC-3' | (SEQ ID NO: 3059) |
|  | 5'-UAACACCUCUUACUGAUUUACCCUA-3'<br>3'-UUAUUGUGGAGAAUGACUAAAUGGGAU-5' | (SEQ ID NO: 4169)<br>(SEQ ID NO: 1951) |
| βc-3586 Target: | 5'-AATAACACCTCTTACTGATTTACCCTA-3' | (SEQ ID NO: 3060) |
|  | 5'-AUAACACCUCUUACUGAUUUACCCU-3'<br>3'-UUUAUUGUGGAGAAUGACUAAAUGGGA-5' | (SEQ ID NO: 4170)<br>(SEQ ID NO: 1952) |
| βc-3587 Target: | 5'-AAATAACACCTCTTACTGATTTACCCT-3' | (SEQ ID NO: 3061) |
|  | 5'-AAUAACACCUCUUACUGAUUUACCC-3'<br>3'-GUUUAUUGUGGAGAAUGACUAAAUGGG-5' | (SEQ ID NO: 4171)<br>(SEQ ID NO: 1953) |
| βc-3588 Target: | 5'-CAAATAACACCTCTTACTGATTTACCC-3' | (SEQ ID NO: 3062) |
|  | 5'-GUUCCAAAUAACACCUCUUACUGAU-3'<br>3'-UCCAAGGUUUAUUGUGGAGAAUGACUA-5' | (SEQ ID NO: 4172)<br>(SEQ ID NO: 1954) |
| βc-3594 Target: | 5'-AGGTTCCAAATAACACCTCTTACTGAT-3' | (SEQ ID NO: 3063) |
|  | 5'-AACAAGGUUCCAAAUAACACCUCUU-3'<br>3'-UUUUGUUCCAAGGUUUAUUGUGGAGAA-5' | (SEQ ID NO: 4173)<br>(SEQ ID NO: 1955) |
| βc-3600 Target: | 5'-AAAACAAGGTTCCAAATAACACCTCTT-3' | (SEQ ID NO: 3064) |
|  | 5'-AAACAAGGUUCCAAAUAACACCUCU-3'<br>3'-GUUUUGUUCCAAGGUUUAUUGUGGAGA-5' | (SEQ ID NO: 4174)<br>(SEQ ID NO: 1956) |
| βc-3601 Target: | 5'-CAAAACAAGGTTCCAAATAACACCTCT-3' | (SEQ ID NO: 3065) |

TABLE 11-continued

Additional Selected Anti-β-catenin DsiRNAs,
25/27mer Duplexes, Unmodified

|  |  |  |
|---|---|---|
|  | 5'-AAAACAAGGUUCCAAAUAACACCUC-3' | (SEQ ID NO: 4175) |
|  | 3'-GGUUUUGUUCCAAGGUUUAUUGUGGAG-5' | (SEQ ID NO: 1957) |
| βc-3602 Target: | 5'-CCAAAACAAGGTTCCAAATAACACCTC-3' | (SEQ ID NO: 3066) |
|  | 5'-UGUCCAAAACAAGGUUCCAAAUAAC-3' | (SEQ ID NO: 4176) |
|  | 3'-UGACAGGUUUUGUUCCAAGGUUUAUUG-5' | (SEQ ID NO: 1958) |
| βc-3607 Target: | 5'-ACTGTCCAAAACAAGGTTCCAAATAAC-3' | (SEQ ID NO: 3067) |
|  | 5'-AAACUGUCCAAAACAAGGUUCCAAA-3' | (SEQ ID NO: 4177) |
|  | 3'-CAUUUGACAGGUUUUGUUCCAAGGUUU-5' | (SEQ ID NO: 1959) |
| βc-3611 Target: | 5'-GTAAACTGTCCAAAACAAGGTTCCAAA-3' | (SEQ ID NO: 3068) |
|  | 5'-UAAACUGUCCAAAACAAGGUUCCAA-3' | (SEQ ID NO: 4178) |
|  | 3'-CCAUUUGACAGGUUUUGUUCCAAGGUU-5' | (SEQ ID NO: 1960) |
| βc-3612 Target: | 5'-GGTAAACTGTCCAAAACAAGGTTCCAA-3' | (SEQ ID NO: 3069) |
|  | 5'-GCAACUGGUAAACUGUCCAAAACAA-3' | (SEQ ID NO: 4179) |
|  | 3'-UCCGUUGACCAUUUGACAGGUUUUGUU-5' | (SEQ ID NO: 1961) |
| βc-3620 Target: | 5'-AGGCAACTGGTAAACTGTCCAAAACAA-3' | (SEQ ID NO: 3070) |
|  | 5'-GAUAAAAGGCAACUGGUAAACUGUC-3' | (SEQ ID NO: 4180) |
|  | 3'-CCCUAUUUUCCGUUGACCAUUUGACAG-5' | (SEQ ID NO: 1962) |
| βc-3628 Target: | 5'-GGGATAAAAGGCAACTGGTAAACTGTC-3' | (SEQ ID NO: 3071) |
|  | 5'-GGAUAAAAGGCAACUGGUAAACUGU-3' | (SEQ ID NO: 4181) |
|  | 3'-ACCCUAUUUUCCGUUGACCAUUUGACA-5' | (SEQ ID NO: 1963) |
| βc-3629 Target: | 5'-TGGGATAAAAGGCAACTGGTAAACTGT-3' | (SEQ ID NO: 3072) |
|  | 5'-AACUUUGGGAUAAAAGGCAACUGGU-3' | (SEQ ID NO: 4182) |
|  | 3'-UGUUGAAACCCUAUUUUCCGUUGACCA-5' | (SEQ ID NO: 1964) |
| βc-3636 Target: | 5'-ACAACTTTGGGATAAAAGGCAACTGGT-3' | (SEQ ID NO: 3073) |
|  | 5'-ACAACUUUGGGAUAAAAGGCAACUG-3' | (SEQ ID NO: 4183) |
|  | 3'-GUUGUUGAAACCCUAUUUUCCGUUGAC-5' | (SEQ ID NO: 1965) |
| βc-3638 Target: | 5'-CAACAACTTTGGGATAAAAGGCAACTG-3' | (SEQ ID NO: 3074) |
|  | 5'-UUACAACAACUUUGGGAUAAAAGGC-3' | (SEQ ID NO: 4184) |
|  | 3'-CCAAUGUUGUUGAAACCCUAUUUUCCG-5' | (SEQ ID NO: 1966) |
| βc-3643 Target: | 5'-GGTTACAACAACTTTGGGATAAAAGGC-3' | (SEQ ID NO: 3075) |
|  | 5'-GUUACAACAACUUUGGGAUAAAAGG-3' | (SEQ ID NO: 4185) |
|  | 3'-UCCAAUGUUGUUGAAACCCUAUUUUCC-5' | (SEQ ID NO: 1967) |
| βc-3644 Target: | 5'-AGGTTACAACAACTTTGGGATAAAAGG-3' | (SEQ ID NO: 3076) |
|  | 5'-GGUUACAACAACUUUGGGAUAAAAG-3' | (SEQ ID NO: 4186) |
|  | 3'-GUCCAAUGUUGUUGAAACCCUAUUUUC-5' | (SEQ ID NO: 1968) |
| βc-3645 Target: | 5'-CAGGTTACAACAACTTTGGGATAAAAG-3' | (SEQ ID NO: 3077) |
|  | 5'-UCACAGCAGGUUACAACAACUUUGG-3' | (SEQ ID NO: 4187) |
|  | 3'-AUAGUGUCGUCCAAUGUUGUUGAAACC-5' | (SEQ ID NO: 1969) |
| βc-3653 Target: | 5'-TATCACAGCAGGTTACAACAACTTTGG-3' | (SEQ ID NO: 3078) |
|  | 5'-AUCACAGCAGGUUACAACAACUUUG-3' | (SEQ ID NO: 4188) |
|  | 3'-CAUAGUGUCGUCCAAUGUUGUUGAAAC-5' | (SEQ ID NO: 1970) |
| βc-3654 Target: | 5'-GTATCACAGCAGGTTACAACAACTTTG-3' | (SEQ ID NO: 3079) |
|  | 5'-GUAUCACAGCAGGUUACAACAACUU-3' | (SEQ ID NO: 4189) |
|  | 3'-AGCAUAGUGUCGUCCAAUGUUGUUGAA-5' | (SEQ ID NO: 1971) |
| βc-3656 Target: | 5'-TCGTATCACAGCAGGTTACAACAACTT-3' | (SEQ ID NO: 3080) |

TABLE 11-continued

Additional Selected Anti-β-catenin DsiRNAs,
25/27mer Duplexes, Unmodified

```
                5'-UCUCUUGAAGCAUCGUAUCACAGCA-3'      (SEQ ID NO: 4190)
                3'-AAAGAGAACUUCGUAGCAUAGUGUCGU-5'    (SEQ ID NO: 1972)

βc-3670 Target: 5'-TTTCTCTTGAAGCATCGTATCACAGCA-3'   (SEQ ID NO: 3081)

5'-UUCUCUUGAAGCAUCGUAUCACAGC-3'      (SEQ ID NO: 4191)
                3'-AAAAGAGAACUUCGUAGCAUAGUGUCG-5'    (SEQ ID NO: 1973)

βc-3671 Target: 5'-TTTTCTCTTGAAGCATCGTATCACAGC-3'   (SEQ ID NO: 3082)

5'-UUUUCUCUUGAAGCAUCGUAUCACA-3'      (SEQ ID NO: 4192)
                3'-GUAAAAGAGAACUUCGUAGCAUAGUGU-5'    (SEQ ID NO: 1974)

βc-3673 Target: 5'-CATTTTCTCTTGAAGCATCGTATCACA-3'   (SEQ ID NO: 3083)

5'-UUUUAUAACCGCAUUUUCUCUUGAA-3'      (SEQ ID NO: 4193)
                3'-AAAAAAUAUUGGCGUAAAAGAGAACUU-5'    (SEQ ID NO: 1975)

βc-3686 Target: 5'-TTTTTTATAACCGCATTTTCTCTTGAA-3'   (SEQ ID NO: 3084)

5'-UUUUUAUAACCGCAUUUUCUCUUGA-3'      (SEQ ID NO: 4194)
                3'-UAAAAAAUAUUGGCGUAAAAGAGAACU-5'    (SEQ ID NO: 1976)

βc-3687 Target: 5'-ATTTTTTATAACCGCATTTTCTCTTGA-3'   (SEQ ID NO: 3085)

5'-UUUUUUAUAACCGCAUUUUCUCUUG-3'      (SEQ ID NO: 4195)
                3'-GUAAAAAAUAUUGGCGUAAAAGAGAAC-5'    (SEQ ID NO: 1977)

βc-3688 Target: 5'-CATTTTTTATAACCGCATTTTCTCTTG-3'   (SEQ ID NO: 3086)

5'-AUUUUUUAUAACCGCAUUUUCUCUU-3'      (SEQ ID NO: 4196)
                3'-GGUAAAAAAUAUUGGCGUAAAAGAGAA-5'    (SEQ ID NO: 1978)

βc-3689 Target: 5'-CCATTTTTTATAACCGCATTTTCTCTT-3'   (SEQ ID NO: 3087)

5'-GAACCAUUUUUUAUAACCGCAUUUU-3'      (SEQ ID NO: 4197)
                3'-GACUUGGUAAAAAAUAUUGGCGUAAAA-5'    (SEQ ID NO: 1979)

βc-3694 Target: 5'-CTGAACCATTTTTTATAACCGCATTTT-3'   (SEQ ID NO: 3088)

5'-AUUCUGAACCAUUUUUUAUAACCGC-3'      (SEQ ID NO: 4198)
                3'-AUUAAGACUUGGUAAAAAAUAUUGGCG-5'    (SEQ ID NO: 1980)

βc-3699 Target: 5'-TAATTCTGAACCATTTTTTATAACCGC-3'   (SEQ ID NO: 3089)

5'-AAUUCUGAACCAUUUUUUAUAACCG-3'      (SEQ ID NO: 4199)
                3'-AAUUAAGACUUGGUAAAAAAUAUUGGC-5'    (SEQ ID NO: 1981)

βc-3700 Target: 5'-TTAATTCTGAACCATTTTTTATAACCG-3'   (SEQ ID NO: 3090)

5'-UAAUUCUGAACCAUUUUUUAUAACC-3'      (SEQ ID NO: 4200)
                3'-AAAUUAAGACUUGGUAAAAAAUAUUGG-5'    (SEQ ID NO: 1982)

βc-3701 Target: 5'-TTTAATTCTGAACCATTTTTTATAACC-3'   (SEQ ID NO: 3091)

5'-UUAAUUCUGAACCAUUUUUUAUAAC-3'      (SEQ ID NO: 4201)
                3'-CAAAUUAAGACUUGGUAAAAAAUAUUG-5'    (SEQ ID NO: 1983)

βc-3702 Target: 5'-GTTTAATTCTGAACCATTTTTTATAAC-3'   (SEQ ID NO: 3092)

5'-UUUAAUUCUGAACCAUUUUUUAUAA-3'      (SEQ ID NO: 4202)
                3'-UCAAAUUAAGACUUGGUAAAAAAUAUU-5'    (SEQ ID NO: 1984)

βc-3703 Target: 5'-AGTTTAATTCTGAACCATTTTTTATAA-3'   (SEQ ID NO: 3093)

5'-GUUUAAUUCUGAACCAUUUUUUAUA-3'      (SEQ ID NO: 4203)
                3'-UUCAAAUUAAGACUUGGUAAAAAAUAU-5'    (SEQ ID NO: 1985)

βc-3704 Target: 5'-AAGTTTAATTCTGAACCATTTTTTATA-3'   (SEQ ID NO: 3094)

5'-UAAAAGUUUAAUUCUGAACCAUUUU-3'      (SEQ ID NO: 4204)
                3'-UAAAUUUUCAAAUUAAGACUUGGUAAAA-5'   (SEQ ID NO: 1986)

βc-3709 Target: 5'-ATTAAAAGTTTAATTCTGAACCATTTT-3'   (SEQ ID NO: 3095)
```

TABLE 11-continued

Additional Selected Anti-β-catenin DsiRNAs,
25/27mer Duplexes, Unmodified

```
                          5'-UUAAAAGUUUAAUUCUGAACCAUUU-3'      (SEQ ID NO: 4205)
                          3'-UUAAUUUUCAAAUUAAGACUUGGUAAA-5'    (SEQ ID NO: 1987)

βc-3710  Target:          5'-AATTAAAAGTTTAATTCTGAACCATTT-3'    (SEQ ID NO: 3096)

5'-AAUUAAAAGUUUAAUUCUGAACCAU-3'      (SEQ ID NO: 4206)
                          3'-ACUUAAUUUUCAAAUUAAGACUUGGUA-5'    (SEQ ID NO: 1988)

βc-3712  Target:          5'-TGAATTAAAAGTTTAATTCTGAACC-3'      (SEQ ID NO: 3097)

5'-AUACAGCUAAAGGAUGAUUUACAGG-3'      (SEQ ID NO: 4207)
                          3'-GUUAUGUCGAUUUCCUACUAAAUGUCC-5'    (SEQ ID NO: 1989)

βc-2634t2 Target:         5'-CAATACAGCTAAAGGATGATTTACAGG-3'    (SEQ ID NO: 3098)

5'-AAUACAGCUAAAGGAUGAUUUACAG-3'      (SEQ ID NO: 4208)
                          3'-UGUUAUGUCGAUUUCCUACUAAAUGUC-5'    (SEQ ID NO: 1990)

βc-2635t2 Target:         5'-ACAATACAGCTAAAGGATGATTTACAG-3'    (SEQ ID NO: 3099)

5'-ACAAUACAGCUAAAGGAUGAUUUAC-3'      (SEQ ID NO: 4209)
                          3'-UCUGUUAUGUCGAUUUCCUACUAAAUG-5'    (SEQ ID NO: 1991)

βc-2637t2 Target:         5'-AGACAATACAGCTAAAGGATGATTTAC-3'    (SEQ ID NO: 3100)

5'-UACUCCUAAAGGAUGAUUUACAGGU-3'      (SEQ ID NO: 4210)
                          3'-CAAUGAGGAUUUCCUACUAAAUGUCCA-5'    (SEQ ID NO: 1992)

βc-2633t3 Target:         5'-GTTACTCCTAAAGGATGATTTACAGGT-3'    (SEQ ID NO: 3101)

5'-UUACUCCUAAAGGAUGAUUUACAGG-3'      (SEQ ID NO: 4211)
                          3'-ACAAUGAGGAUUUCCUACUAAAUGUCC-5'    (SEQ ID NO: 1993)

βc-2634t3 Target:         5'-TGTTACTCCTAAAGGATGATTTACAGG-3'    (SEQ ID NO: 3102)

5'-GUUACUCCUAAAGGAUGAUUUACAG-3'      (SEQ ID NO: 4212)
                          3'-AACAAUGAGGAUUUCCUACUAAAUGUC-5'    (SEQ ID NO: 1994)

βc-2635t3 Target:         5'-TTGTTACTCCTAAAGGATGATTTACAG-3'    (SEQ ID NO: 3103)

5'-UGUUACUCCUAAAGGAUGAUUUACA-3'      (SEQ ID NO: 4213)
                          3'-UAACAAUGAGGAUUUCCUACUAAAUGU-5'    (SEQ ID NO: 1995)

βc-2636t3 Target:         5'-ATTGTTACTCCTAAAGGATGATTTACA-3'    (SEQ ID NO: 3104)

5'-AUUCCAGAAUCCAAGUAAGACUGCU-3'      (SEQ ID NO: 4214)
                          3'-CCUAAGGUCUUAGGUUCAUUCUGACGA-5'    (SEQ ID NO: 1996)

βc-m318  Target:          5'-GGATTCCAGAATCCAAGTAAGACTGCT-3'    (SEQ ID NO: 3105)

5'-UGCUCCCAUUCAUAAAGGACUUGGG-3'      (SEQ ID NO: 4215)
                          3'-GAACGAGGGUAAGUAUUUCCUGAACCC-5'    (SEQ ID NO: 1997)

βc-m417  Target:          5'-CTTGCTCCCATTCATAAAGGACTTGGG-3'    (SEQ ID NO: 3106)

5'-UCAAUAUCAGCUACUUGCUCUUGCG-3'      (SEQ ID NO: 4216)
                          3'-GCAGUUAUAGUCGAUGAACGAGAACGC-5'    (SEQ ID NO: 1998)

βc-m462  Target:          5'-CGTCAATATCAGCTACTTGCTCTTGCG-3'    (SEQ ID NO: 3107)

5'-GUCAAUAUCAGCUACUUGCUCUUGC-3'      (SEQ ID NO: 4217)
                          3'-GGCAGUUAUAGUCGAUGAACGAGAACG-5'    (SEQ ID NO: 1999)

βc-m463  Target:          5'-CCGTCAATATCAGCTACTTGCTCTTGC-3'    (SEQ ID NO: 3108)

5'-UGCCCGUCAAUAUCAGCUACUUGCU-3'      (SEQ ID NO: 4218)
                          3'-UGACGGGCAGUUAUAGUCGAUGAACGA-5'    (SEQ ID NO: 2000)

βc-m468  Target:          5'-ACTGCCCGTCAATATCAGCTACTTGCT-3'    (SEQ ID NO: 3109)

5'-UUUCAACAUCUGUGAUGGUUCAGCC-3'      (SEQ ID NO: 4219)
                          3'-ACAAAGUUGUAGACACUACCAAGUCGG-5'    (SEQ ID NO: 2001)

βc-m613  Target:          5'-TGTTTCAACATCTGTGATGGTTCAGCC-3'    (SEQ ID NO: 3110)
```

TABLE 11-continued

Additional Selected Anti-β-catenin DsiRNAs,
25/27mer Duplexes, Unmodified

|  |  |  |  |
|---|---|---|---|
|  | 5'-GUUUCAACAUCUGUGAUGGUUCAGC-3' | (SEQ ID NO: 4220) |
|  | 3'-UACAAAGUUGUAGACACUACCAAGUCG-5' | (SEQ ID NO: 2002) |
| βc-m614 Target: | 5'-ATGTTTCAACATCTGTGATGGTTCAGC-3' | (SEQ ID NO: 3111) |
|  | 5'-ACAACUGCAUGUUUCAACAUCUGUG-3' | (SEQ ID NO: 4221) |
|  | 3'-ACUGUUGACGUACAAAGUUGUAGACAC-5' | (SEQ ID NO: 2003) |
| βc-m624 Target: | 5'-TGACAACTGCATGTTTCAACATCTGTG-3' | (SEQ ID NO: 3112) |
|  | 5'-UGACAACUGCAUGUUUCAACAUCUG-3' | (SEQ ID NO: 4222) |
|  | 3'-UAACUGUUGACGUACAAAGUUGUAGAC-5' | (SEQ ID NO: 2004) |
| βc-m626 Target: | 5'-ATTGACAACTGCATGTTTCAACATCTG-3' | (SEQ ID NO: 3113) |
|  | 5'-AAAUUGACAACUGCAUGUUUCAACA-3' | (SEQ ID NO: 4223) |
|  | 3'-AGUUUAACUGUUGACGUACAAAGUUGU-5' | (SEQ ID NO: 2005) |
| βc-m630 Target: | 5'-TCAAATTGACAACTGCATGTTTCAACA-3' | (SEQ ID NO: 3114) |
|  | 5'-UUAAUCAAAUUGACAACUGCAUGUU-3' | (SEQ ID NO: 4224) |
|  | 3'-UCAAUUAGUUUAACUGUUGACGUACAA-5' | (SEQ ID NO: 2006) |
| βc-m636 Target: | 5'-AGTTAATCAAATTGACAACTGCATGTT-3' | (SEQ ID NO: 3115) |
|  | 5'-UGAUAGUUAAUCAAAUUGACAACUG-3' | (SEQ ID NO: 4225) |
|  | 3'-GGACUAUCAAUUAGUUUAACUGUUGAC-5' | (SEQ ID NO: 2007) |
| βc-m642 Target: | 5'-CCTGATAGTTAATCAAATTGACAACTG-3' | (SEQ ID NO: 3116) |
|  | 5'-UCAUCCUGAUAGUUAAUCAAAUUGA-3' | (SEQ ID NO: 4226) |
|  | 3'-GCAGUAGGACUAUCAAUUAGUUUAACU-5' | (SEQ ID NO: 2008) |
| βc-m648 Target: | 5'-CGTCATCCTGATAGTTAATCAAATTGA-3' | (SEQ ID NO: 3117) |
|  | 5'-GUCAUCCUGAUAGUUAAUCAAAUUG-3' | (SEQ ID NO: 4227) |
|  | 3'-CGCAGUAGGACUAUCAAUUAGUUUAAC-5' | (SEQ ID NO: 2009) |
| βc-m649 Target: | 5'-GCGTCATCCTGATAGTTAATCAAATTG-3' | (SEQ ID NO: 3118) |
|  | 5'-UCAUCGUUUAGCAGUUUUGUCAGCU-3' | (SEQ ID NO: 4228) |
|  | 3'-GGAGUAGCAAAUCGUCAAAACAGUCGA-5' | (SEQ ID NO: 2010) |
| βc-m702 Target: | 5'-CCTCATCGTTTAGCAGTTTTGTCAGCT-3' | (SEQ ID NO: 3119) |
|  | 5'-GGUCCUCAUCGUUUAGCAGUUUUGU-3' | (SEQ ID NO: 4229) |
|  | 3'-GACCAGGAGUAGCAAAUCGUCAAAACA-5' | (SEQ ID NO: 2011) |
| βc-m707 Target: | 5'-CTGGTCCTCATCGTTTAGCAGTTTTGT-3' | (SEQ ID NO: 3120) |
|  | 5'-UAACAGCAGCUUUAUUAACUACCAC-3' | (SEQ ID NO: 4230) |
|  | 3'-GUAUUGUCGUCGAAAUAAUUGAUGGUG-5' | (SEQ ID NO: 2012) |
| βc-m734 Target: | 5'-CATAACAGCAGCTTTATTAACTACCAC-3' | (SEQ ID NO: 3121) |
|  | 5'-AUAACAGCAGCUUUAUUAACUACCA-3' | (SEQ ID NO: 4231) |
|  | 3'-GGUAUUGUCGUCGAAAUAAUUGAUGGU-5' | (SEQ ID NO: 2013) |
| βc-m735 Target: | 5'-CCATAACAGCAGCTTTATTAACTACCA-3' | (SEQ ID NO: 3122) |
|  | 5'-ACCAUAACAGCAGCUUUAUUAACUA-3' | (SEQ ID NO: 4232) |
|  | 3'-CCUGGUAUUGUCGUCGAAAUAAUUGAU-5' | (SEQ ID NO: 2014) |
| βc-m738 Target: | 5'-GGACCATAACAGCAGCTTTATTAACTA-3' | (SEQ ID NO: 3123) |
|  | 5'-GACCAUAACAGCAGCUUUAUUAACU-3' | (SEQ ID NO: 4233) |
|  | 3'-ACCUGGUAUUGUCGUCGAAAUAAUUGA-5' | (SEQ ID NO: 2015) |
| βc-m739 Target: | 5'-TGGACCATAACAGCAGCTTTATTAACT-3' | (SEQ ID NO: 3124) |
|  | 5'-GUCUCUACAUCAUUUGUAUUCUGCA-3' | (SEQ ID NO: 4234) |
|  | 3'-GACAGAGAUGUAGUAAACAUAAGACGU-5' | (SEQ ID NO: 2016) |
| βc-m843 Target: | 5'-CTGTCTCTACATCATTTGTATTCTGCA-3' | (SEQ ID NO: 3125) |

TABLE 11-continued

Additional Selected Anti-β-catenin DsiRNAs,
25/27mer Duplexes, Unmodified

|  |  |  |
|---|---|---|
|  | 5'-UGUCUCUACAUCAUUUGUAUUCUGC-3' | (SEQ ID NO: 4235) |
|  | 3'-CGACAGAGAUGUAGUAAACAUAAGACG-5' | (SEQ ID NO: 2017) |
| βc-m844 Target: | 5'-GCTGTCTCTACATCATTTGTATTCTGC-3' | (SEQ ID NO: 3126) |
|  | 5'-AACCAUUUCUGCAGUCCACCAGCU-3' | (SEQ ID NO: 4236) |
|  | 3'-CGUUGGUAAAAGACGUCAGGUGGUCGA-5' | (SEQ ID NO: 2018) |
| βc-m1063 Target: | 5'-GCAACCATTTTCTGCAGTCCACCAGCT-3' | (SEQ ID NO: 3127) |
|  | 5'-GCAACCAUUUUCUGCAGUCCACCAG-3' | (SEQ ID NO: 4237) |
|  | 3'-UUCGUUGGUAAAAGACGUCAGGUGGUC-5' | (SEQ ID NO: 2019) |
| βc-m1065 Target: | 5'-AAGCAACCATTTTCTGCAGTCCACCAG-3' | (SEQ ID NO: 3128) |
|  | 5'-GUUUUGUUGAGCAAAGCAACCAUUU-3' | (SEQ ID NO: 4238) |
|  | 3'-AACAAAACAACUCGUUUCGUUGGUAAA-5' | (SEQ ID NO: 2020) |
| βc-m1080 Target: | 5'-TTGTTTTGTTGAGCAAAGCAACCATTT-3' | (SEQ ID NO: 3129) |
|  | 5'-UGUUUUGUUGAGCAAAGCAACCAUU-3' | (SEQ ID NO: 4239) |
|  | 3'-AAACAAAACAACUCGUUUCGUUGGUAA-5' | (SEQ ID NO: 2021) |
| βc-m1081 Target: | 5'-TTTGTTTTGTTGAGCAAAGCAACCATT-3' | (SEQ ID NO: 3130) |
|  | 5'-GCCAAGAAUUUCACGUUUGUUUUGU-3' | (SEQ ID NO: 4240) |
|  | 3'-AUCGGUUCUUAAAGUGCAAACAAAACA-5' | (SEQ ID NO: 2022) |
| βc-m1098 Target: | 5'-TAGCCAAGAATTTCACGTTTGTTTTGT-3' | (SEQ ID NO: 3131) |
|  | 5'-UGAUUGCCAUAAGCUAAGAUCUGAA-3' | (SEQ ID NO: 4241) |
|  | 3'-GAACUAACGGUAUUCGAUUCUAGACUU-5' | (SEQ ID NO: 2023) |
| βc-m1140 Target: | 5'-CTTGATTGCCATAAGCTAAGATCTGAA-3' | (SEQ ID NO: 3132) |
|  | 5'-UCUCUUGAUUGCCAUAAGCUAAGAU-3' | (SEQ ID NO: 4242) |
|  | 3'-CGAGAGAACUAACGGUAUUCGAUUCUA-5' | (SEQ ID NO: 2024) |
| βc-m1145 Target: | 5'-GCTCTCTTGATTGCCATAAGCTAAGAT-3' | (SEQ ID NO: 3133) |
|  | 5'-UCUCAUAAGUGUAGGUCCUCAUUAU-3' | (SEQ ID NO: 4243) |
|  | 3'-GAAGAGUAUUCACAUCCAGGAGUAAUA-5' | (SEQ ID NO: 2025) |
| βc-m1217 Target: | 5'-CTTCTCATAAGTGTAGGTCCTCATTAT-3' | (SEQ ID NO: 3134) |
|  | 5'-UUCUCAUAAGUGUAGGUCCUCAUUA-3' | (SEQ ID NO: 4244) |
|  | 3'-CGAAGAGUAUUCACAUCCAGGAGUAAU-5' | (SEQ ID NO: 2026) |
| βc-m1218 Target: | 5'-GCTTCTCATAAGTGTAGGTCCTCATTA-3' | (SEQ ID NO: 3135) |
|  | 5'-GCUUCUCAUAAGUGUAGGUCCUCAU-3' | (SEQ ID NO: 4245) |
|  | 3'-UUCGAAGAGUAUUCACAUCCAGGAGUA-5' | (SEQ ID NO: 2027) |
| βc-m1220 Target: | 5'-AAGCTTCTCATAAGTGTAGGTCCTC-3' | (SEQ ID NO: 3136) |
|  | 5'-AGCUUCUCAUAAGUGUAGGUCCUCA-3' | (SEQ ID NO: 4246) |
|  | 3'-CUUCGAAGAGUAUUCACAUCCAGGAGU-5' | (SEQ ID NO: 2028) |
| βc-m1221 Target: | 5'-GAAGCTTCTCATAAGTGTAGGTCCTCA-3' | (SEQ ID NO: 3137) |
|  | 5'-GUCCAAAGACAGUUUUGAACAAGUC-3' | (SEQ ID NO: 4247) |
|  | 3'-CUCAGGUUUCUGUCAAAACUUGUUCAG-5' | (SEQ ID NO: 2029) |
| βc-m1365 Target: | 5'-GAGTCCAAAGACAGTTTTGAACAAGTC-3' | (SEQ ID NO: 3138) |
|  | 5'-AGUCCAAAGACAGUUUUGAACAAGU-3' | (SEQ ID NO: 4248) |
|  | 3'-UCUCAGGUUUCUGUCAAAACUUGUUCA-5' | (SEQ ID NO: 2030) |
| βc-m1366 Target: | 5'-AGAGTCCAAAGACAGTTTTGAACAAGT-3' | (SEQ ID NO: 3139) |
|  | 5'-ACAUUUAUAUCAUCGGAACCCAGAA-3' | (SEQ ID NO: 4249) |
|  | 3'-GGUGUAAAUAUAGUAGCCUUGGGUCUU-5' | (SEQ ID NO: 2031) |
| βc-m1461 Target: | 5'-CCACATTTATATCATCGGAACCCAGAA-3' | (SEQ ID NO: 3140) |

TABLE 11-continued

Additional Selected Anti-β-catenin DsiRNAs,
25/27mer Duplexes, Unmodified

```
               5'-ACCACAUUUAUAUCAUCGGAACCCA-3'     (SEQ ID NO: 4250)
               3'-ACUGGUGUAAAUAUAGUAGCCUUGGGU-5'   (SEQ ID NO: 2032)

βc-m1464 Target: 5'-TGACCACATTTATATCATCGGAACCCA-3' (SEQ ID NO: 3141)

5'-GCACAGGUGACCACAUUUAUAUCAU-3'     (SEQ ID NO: 4251)
               3'-GACGUGUCCACUGGUGUAAAUAUAGUA-5'   (SEQ ID NO: 2033)

βc-m1473 Target: 5'-CTGCACAGGTGACCACATTTATATC-3'   (SEQ ID NO: 3142)

5'-UGCACAGGUGACCACAUUUAUAUCA-3'     (SEQ ID NO: 4252)
               3'-CGACGUGUCCACUGGUGUAAAUAUAGU-5'   (SEQ ID NO: 2034)

βc-m1474 Target: 5'-GCTGCACAGGTGACCACATTTATATCA-3' (SEQ ID NO: 3143)

5'-GUAAUUAUUGCAAGUGAGGUUAGAG-3'     (SEQ ID NO: 4253)
               3'-AACAUUAAUAACGUUCACUCCAAUCUC-5'   (SEQ ID NO: 2035)

βc-m1510 Target: 5'-TTGTAATTATTGCAAGTGAGGTTAGAG-3' (SEQ ID NO: 3144)

5'-UCAUCUUGUUUUUGUAAUUAUUGCA-3'     (SEQ ID NO: 4254)
               3'-GUAGUAGAACAAAAACAUUAAUAACGU-5'   (SEQ ID NO: 2036)

βc-m1523 Target: 5'-CATCATCTTGTTTTGTAATTATTGCA-3'  (SEQ ID NO: 3145)

5'-AUCAUCUUGUUUUUGUAAUUAUUGC-3'     (SEQ ID NO: 4255)
               3'-GGUAGUAGAACAAAAACAUUAAUAACG-5'   (SEQ ID NO: 2037)

βc-m1524 Target: 5'-CCATCATCTTGTTTTGTAATTATTGC-3'  (SEQ ID NO: 3146)

5'-ACCAUCAUCUUGUUUUUGUAAUUAU-3'     (SEQ ID NO: 4256)
               3'-UGUGGUAGUAGAACAAAAACAUUAAUA-5'   (SEQ ID NO: 2038)

βc-m1527 Target: 5'-ACACCATCATCTTGTTTTGTAATTAT-3'  (SEQ ID NO: 3147)

5'-GGCACACCAUCAUCUUGUUUUUGUA-3'     (SEQ ID NO: 4257)
               3'-AACCGUGUGGUAGUAGAACAAAAACAU-5'   (SEQ ID NO: 2039)

βc-m1532 Target: 5'-TTGGCACACCATCATCTTGTTTTGTA-3'  (SEQ ID NO: 3148)

5'-AAUCCAACAGUUGCCUUUAUCAGAG-3'     (SEQ ID NO: 4258)
               3'-AGUUAGGUUGUCAACGGAAAUAGUCUC-5'   (SEQ ID NO: 2040)

βc-m1752 Target: 5'-TCAATCCAACAGTTGCCTTTATCAGAG-3' (SEQ ID NO: 3149)

5'-GAAUCAAUCCAACAGUUGCCUUUAU-3'     (SEQ ID NO: 4259)
               3'-AGCUUAGUUAGGUUGUCAACGGAAAUA-5'   (SEQ ID NO: 2041)

βc-m1757 Target: 5'-TCGAATCAATCCAACAGTTGCCTTTAT-3' (SEQ ID NO: 3150)

5'-UGAACUAGUCGUGGAAUAGCACCCU-3'     (SEQ ID NO: 4260)
               3'-CGACUUGAUCAGCACCUUAUCGUGGGA-5'   (SEQ ID NO: 2042)

βc-m1827 Target: 5'-GCTGAACTAGTCGTGGAATAGCACCCT-3' (SEQ ID NO: 3151)

5'-UACACCCUUCUACUAUCUCCUCCAU-3'     (SEQ ID NO: 4261)
               3'-UCAUGUGGGAAGAUGAUAGAGGAGGUA-5'   (SEQ ID NO: 2043)

βc-m1934 Target: 5'-AGTACACCCTTCTACTATCTCCTCC-3'   (SEQ ID NO: 3152)

5'-GUACACCCUUCUACUAUCUCCUCCA-3'     (SEQ ID NO: 4262)
               3'-GUCAUGUGGGAAGAUGAUAGAGGAGGU-5'   (SEQ ID NO: 2044)

βc-m1935 Target: 5'-CAGTACACCCTTCTACTATCTCCTCCA-3' (SEQ ID NO: 3153)

5'-AGUACACCCUUCUACUAUCUCCUCC-3'     (SEQ ID NO: 4263)
               3'-GGUCAUGUGGGAAGAUGAUAGAGGAGG-5'   (SEQ ID NO: 2045)

βc-m1936 Target: 5'-CCAGTACACCCTTCTACTATCTCCTCC-3' (SEQ ID NO: 3154)

5'-GCUCCAGUACACCCUUCUACUAUCU-3'     (SEQ ID NO: 4264)
               3'-CUCGAGGUCAUGUGGGAAGAUGAUAGA-5'   (SEQ ID NO: 2046)

βc-m1941 Target: 5'-GAGCTCCAGTACACCCTTCTACTATCT-3' (SEQ ID NO: 3155)
```

TABLE 11-continued

Additional Selected Anti-β-catenin DsiRNAs,
25/27mer Duplexes, Unmodified

|  |  |  |  |
|---|---|---|---|
|  | 5'-ACAAUGGAAUGGUAUUGAGUCCUCG-3' | (SEQ ID NO: 4265) |  |
|  | 3'-UUUGUUACCUUACCAUAACUCAGGAGC-5' | (SEQ ID NO: 2047) |  |
| βc-m2009 Target: | 5'-AAACAATGGAATGGTATTGAGTCCTCG-3' | (SEQ ID NO: 3156) |  |
|  | 5'-GCACAAACAAUGGAAUGGUAUUGAG-3' | (SEQ ID NO: 4266) |  |
|  | 3'-GACGUGUUUGUUACCUUACCAUAACUC-5' | (SEQ ID NO: 2048) |  |
| βc-m2015 Target: | 5'-CTGCACAAACAATGGAATGGTATTGAG-3' | (SEQ ID NO: 3157) |  |
|  | 5'-UGCACAAACAAUGGAAUGGUAUUGA-3' | (SEQ ID NO: 4267) |  |
|  | 3'-UGACGUGUUUGUUACCUUACCAUAACU-5' | (SEQ ID NO: 2049) |  |
| βc-m2016 Target: | 5'-ACTGCACAAACAATGGAATGGTATTGA-3' | (SEQ ID NO: 3158) |  |
|  | 5'-GCAACUGCACAAACAAUGGAAUGGU-3' | (SEQ ID NO: 4268) |  |
|  | 3'-UUCGUUGACGUGUUUGUUACCUUACCA-5' | (SEQ ID NO: 2050) |  |
| βc-m2021 Target: | 5'-AAGCAACTGCACAAACAATGGAATGGT-3' | (SEQ ID NO: 3159) |  |
|  | 5'-GAAUAAAGCAACUGCACAAACAAUG-3' | (SEQ ID NO: 4269) |  |
|  | 3'-CUCUUAUUUCGUUGACGUGUUUGUUAC-5' | (SEQ ID NO: 2051) |  |
| βc-m2028 Target: | 5'-GAGAATAAAGCAACTGCACAAACAATG-3' | (SEQ ID NO: 3160) |  |
|  | 5'-UCAAUGGGAGAAUAAAGCAACUGCA-3' | (SEQ ID NO: 4270) |  |
|  | 3'-AAAGUUACCCUCUUAUUUCGUUGACGU-5' | (SEQ ID NO: 2052) |  |
| βc-m2037 Target: | 5'-TTTCAATGGGAGAATAAAGCAACTGCA-3' | (SEQ ID NO: 3161) |  |
|  | 5'-UUCAAUGGGAGAAUAAAGCAACUGC-3' | (SEQ ID NO: 4271) |  |
|  | 3'-AAAAGUUACCCUCUUAUUUCGUUGACG-5' | (SEQ ID NO: 2053) |  |
| βc-m2038 Target: | 5'-TTTTCAATGGGAGAATAAAGCAACTGC-3' | (SEQ ID NO: 3162) |  |
|  | 5'-UUUCAAUGGGAGAAUAAAGCAACUG-3' | (SEQ ID NO: 4272) |  |
|  | 3'-UAAAAGUUACCCUCUUAUUUCGUUGAC-5' | (SEQ ID NO: 2054) |  |
| βc-m2039 Target: | 5'-ATTTTCAATGGGAGAATAAAGCAACTG-3' | (SEQ ID NO: 3163) |  |
|  | 5'-AUAUUUUCAAUGGGAGAAUAAAGCA-3' | (SEQ ID NO: 4273) |  |
|  | 3'-CCUAUAAAAGUUACCCUCUUAUUUCGU-5' | (SEQ ID NO: 2055) |  |
| βc-m2043 Target: | 5'-GGATATTTTCAATGGGAGAATAAAGCA-3' | (SEQ ID NO: 3164) |  |
|  | 5'-GAUAUUUUCAAUGGGAGAAUAAAGC-3' | (SEQ ID NO: 4274) |  |
|  | 3'-ACCUAUAAAAGUUACCCUCUUAUUUCG-5' | (SEQ ID NO: 2056) |  |
| βc-m2044 Target: | 5'-TGGATATTTTCAATGGGAGAATAAAGC-3' | (SEQ ID NO: 3165) |  |
|  | 5'-GGAUAUUUUCAAUGGGAGAAUAAAG-3' | (SEQ ID NO: 4275) |  |
|  | 3'-AACCUAUAAAAGUUACCCUCUUAUUUC-5' | (SEQ ID NO: 2057) |  |
| βc-m2045 Target: | 5'-TTGGATATTTTCAATGGGAGAATAAAG-3' | (SEQ ID NO: 3166) |  |
|  | 5'-GCUACUCUUUGGAUAUUUUCAAUGG-3' | (SEQ ID NO: 4276) |  |
|  | 3'-GUCGAUGAGAAACCUAUAAAAGUUACC-5' | (SEQ ID NO: 2058) |  |
| βc-m2055 Target: | 5'-CAGCTACTCTTTGGATATTTTCAATGG-3' | (SEQ ID NO: 3167) |  |
|  | 5'-AGCUACUCUUUGGAUAUUUUCAAUG-3' | (SEQ ID NO: 4277) |  |
|  | 3'-CGUCGAUGAGAAACCUAUAAAAGUUAC-5' | (SEQ ID NO: 2059) |  |
| βc-m2056 Target: | 5'-GCAGCTACTCTTTGGATATTTTCAATG-3' | (SEQ ID NO: 3168) |  |
|  | 5'-GCUUCUUGUAAUCCUGUGGCUUGUC-3' | (SEQ ID NO: 4278) |  |
|  | 3'-GGCGAAGAACAUUAGGACACCGAACAG-5' | (SEQ ID NO: 2060) |  |
| βc-m2231 Target: | 5'-CCGCTTCTTGTAATCCTGTGGCTTGTC-3' | (SEQ ID NO: 3169) |  |
|  | 5'-AGUCCAAGAUCUGCAGUCUCAUUCC-3' | (SEQ ID NO: 4279) |  |
|  | 3'-GGUCAGGUUCUAGACGUCAGAGUAAGG-5' | (SEQ ID NO: 2061) |  |
| βc-m2307 Target: | 5'-CCAGTCCAAGATCTGCAGTCTCATTCC-3' | (SEQ ID NO: 3170) |  |

TABLE 11-continued

Additional Selected Anti-β-catenin DsiRNAs,
25/27mer Duplexes, Unmodified

```
                5'-UAUCCACCAGAGUGAAAAGAACGGU-3'   (SEQ ID NO: 4280)
                3'-GCAUAGGUGGUCUCACUUUUCUUGCCA-5' (SEQ ID NO: 2062)

βc-m2385 Target: 5'-CGTATCCACCAGAGTGAAAAGAACGGT-3' (SEQ ID NO: 3171)

5'-GGCCAGCUGAUUGCUAUCACCUGGG-3'   (SEQ ID NO: 4281)
                3'-GUCCGGUCGACUAACGAUAGUGGACCC-5' (SEQ ID NO: 2063)

βc-m2539 Target: 5'-CAGGCCAGCTGATTGCTATCACCTGGG-3' (SEQ ID NO: 3172)

5'-AUUUACAGGUCAGUAUCAAACCAGG-3'   (SEQ ID NO: 4282)
                3'-GCUAAAUGUCCAGUCAUAGUUUGGUCC-5' (SEQ ID NO: 2064)

βc-m2562 Target: 5'-CGATTTACAGGTCAGTATCAAACCAGG-3' (SEQ ID NO: 3173)

5'-GAUUUACAGGUCAGUAUCAAACCAG-3'   (SEQ ID NO: 4283)
                3'-UGCUAAAUGUCCAGUCAUAGUUUGGUC-5' (SEQ ID NO: 2065)

βc-m2563 Target: 5'-ACGATTTACAGGTCAGTATCAAACCAG-3' (SEQ ID NO: 3174)

5'-UCUUACCUAAAGGACGAUUUACAGG-3'   (SEQ ID NO: 4284)
                3'-AAAGAAUGGAUUUCCUGCUAAAUGUCC-5' (SEQ ID NO: 2066)

βc-m2578 Target: 5'-TTTCTTACCTAAAGGACGATTTACAGG-3' (SEQ ID NO: 3175)

5'-UUUCUUACCUAAAGGACGAUUUACA-3'   (SEQ ID NO: 4285)
                3'-CGAAAGAAUGGAUUUCCUGCUAAAUGU-5' (SEQ ID NO: 2067)

βc-m2580 Target: 5'-GCTTTCTTACCTAAAGGACGATTTACA-3' (SEQ ID NO: 3176)

5'-UUUUAUAAGCUUUCUUACCUAAAGGA-3'  (SEQ ID NO: 4286)
                3'-GAAAAUAUUCGAAAGAAUGGAUUUCCU-5' (SEQ ID NO: 2068)

βc-m2589 Target: 5'-CTTTTATAAGCTTTCTTACCTAAAGGA-3' (SEQ ID NO: 3177)

5'-UUUUAUAAGCUUUCUUACCUAAAGG-3'   (SEQ ID NO: 4287)
                3'-CGAAAAUAUUCGAAAGAAUGGAUUUCC-5' (SEQ ID NO: 2069)

βc-m2590 Target: 5'-GCTTTTATAAGCTTTCTTACCTAAAGG-3' (SEQ ID NO: 3178)

5'-GGCUUUUAUAAGCUUUCUUACCUAA-3'   (SEQ ID NO: 4288)
                3'-GACCGAAAAUAUUCGAAAGAAUGGAUU-5' (SEQ ID NO: 2070)

βc-m2593 Target: 5'-CTGGCTTTTATAAGCTTTCTTACCTAA-3' (SEQ ID NO: 3179)

5'-ACACUGGCUUUUAUAAGCUUUCUUA-3'   (SEQ ID NO: 4289)
                3'-GGUGUGACCGAAAAUAUUCGAAAGAAU-5' (SEQ ID NO: 2071)

βc-m2598 Target: 5'-CCACACTGGCTTTTATAAGCTTTCTTA-3' (SEQ ID NO: 3180)

5'-UCACCCACACUGGCUUUUAUAAGCU-3'   (SEQ ID NO: 4290)
                3'-UAAGUGGGUGUGACCGAAAAUAUUCGA-5' (SEQ ID NO: 2072)

βc-m2604 Target: 5'-ATTCACCCACACTGGCTTTTATAAGCT-3' (SEQ ID NO: 3181)

5'-UACCAAGUCUUUCUGGAGUUCUGCA-3'   (SEQ ID NO: 4291)
                3'-GGAUGGUUCAGAAAGACCUCAAGACGU-5' (SEQ ID NO: 2073)

βc-m2644 Target: 5'-CCTACCAAGTCTTTCTGGAGTTCTGCA-3' (SEQ ID NO: 3182)

5'-UUACAAACAGGCCUAAAACCAUUCC-3'   (SEQ ID NO: 4292)
                3'-UAAAUGUUUGUCCGGAUUUUGGUAAGG-5' (SEQ ID NO: 2074)

βc-m2674 Target: 5'-ATTTACAAACAGGCCTAAAACCATTCC-3' (SEQ ID NO: 3183)

5'-UUUACAAACAGGCCUAAAACCAUUC-3'   (SEQ ID NO: 4293)
                3'-CUAAAUGUUUGUCCGGAUUUUGGUAAG-5' (SEQ ID NO: 2075)

βc-m2675 Target: 5'-GATTTACAAACAGGCCTAAAACCATTC-3' (SEQ ID NO: 3184)

5'-AUUUACAAACAGGCCUAAAACCAUU-3'   (SEQ ID NO: 4294)
                3'-UCUAAAUGUUUGUCCGGAUUUUGGUAA-5' (SEQ ID NO: 2076)

βc-m2676 Target: 5'-AGATTTACAAACAGGCCTAAAACCATT-3' (SEQ ID NO: 3185)
```

TABLE 11-continued

Additional Selected Anti-β-catenin DsiRNAs,
25/27mer Duplexes, Unmodified

|  |  |  |
|---|---|---|
|  | 5'-UCUCCUUCCAAGGUAUGUAUCUGUU-3' | (SEQ ID NO: 4295) |
|  | 3'-GUAGAGGAAGGUUCCAUACAUAGACAA-5' | (SEQ ID NO: 2077) |
| βc-m2710 Target: | 5'-CATCTCCTTCCAAGGTATGTATCTGTT-3' | (SEQ ID NO: 3186) |
|  | 5'-AUCUCCUUCCAAGGUAUGUAUCUGU-3' | (SEQ ID NO: 4296) |
|  | 3'-UGUAGAGGAAGGUUCCAUACAUAGACA-5' | (SEQ ID NO: 2078) |
| βc-m2711 Target: | 5'-ACATCTCCTTCCAAGGTATGTATCTGT-3' | (SEQ ID NO: 3187) |
|  | 5'-UUCCACACAUGAACAUCUCCUUCCA-3' | (SEQ ID NO: 4297) |
|  | 3'-UGAAGGUGUGUACUUGUAGAGGAAGGU-5' | (SEQ ID NO: 2079) |
| βc-m2725 Target: | 5'-ACTTCCACACATGAACATCTCCTTCCA-3' | (SEQ ID NO: 3188) |
|  | 5'-AACUUCCACACAUGAACAUCUCCUU-3' | (SEQ ID NO: 4298) |
|  | 3'-CUUUGAAGGUGUGUACUUGUAGAGGAA-5' | (SEQ ID NO: 2080) |
| βc-m2728 Target: | 5'-GAAACTTCCACACATGAACATCTCCTT-3' | (SEQ ID NO: 3189) |
|  | 5'-AAACUUCCACACAUGAACAUCUCCU-3' | (SEQ ID NO: 4299) |
|  | 3'-UCUUUGAAGGUGUGUACUUGUAGAGGA-5' | (SEQ ID NO: 2081) |
| βc-m2729 Target: | 5'-AGAAACTTCCACACATGAACATCTCCT-3' | (SEQ ID NO: 3190) |
|  | 5'-GAAACUUCCACACAUGAACAUCUCC-3' | (SEQ ID NO: 4300) |
|  | 3'-CUCUUUGAAGGUGUGUACUUGUAGAGG-5' | (SEQ ID NO: 2082) |
| βc-m2730 Target: | 5'-GAGAAACTTCCACACATGAACATCTCC-3' | (SEQ ID NO: 3191) |
|  | 5'-AGAAACUUCCACACAUGAACAUCUC-3' | (SEQ ID NO: 4301) |
|  | 3'-ACUCUUUGAAGGUGUGUACUUGUAGAG-5' | (SEQ ID NO: 2083) |
| βc-m2731 Target: | 5'-TGAGAAACTTCCACACATGAACATCTC-3' | (SEQ ID NO: 3192) |
|  | 5'-UCAACGUGAGAAACUUCCACACAUG-3' | (SEQ ID NO: 4302) |
|  | 3'-GUAGUUGCACUCUUUGAAGGUGUGUAC-5' | (SEQ ID NO: 2084) |
| βc-m2739 Target: | 5'-CATCAACGTGAGAAACTTCCACACATG-3' | (SEQ ID NO: 3193) |
|  | 5'-ACAUCAACGUGAGAAACUUCCACAC-3' | (SEQ ID NO: 4303) |
|  | 3'-UUUGUAGUUGCACUCUUUGAAGGUGUG-5' | (SEQ ID NO: 2085) |
| βc-m2742 Target: | 5'-AAACATCAACGTGAGAAACTTCCACAC-3' | (SEQ ID NO: 3194) |
|  | 5'-AACAUCAACGUGAGAAACUUCCACA-3' | (SEQ ID NO: 4304) |
|  | 3'-UUUUGUAGUUGCACUCUUUGAAGGUGU-5' | (SEQ ID NO: 2086) |
| βc-m2743 Target: | 5'-AAAACATCAACGTGAGAAACTTCCACA-3' | (SEQ ID NO: 3195) |
|  | 5'-AAACAUCAACGUGAGAAACUUCCAC-3' | (SEQ ID NO: 4305) |
|  | 3'-UUUUUGUAGUUGCACUCUUUGAAGGUG-5' | (SEQ ID NO: 2087) |
| βc-m2744 Target: | 5'-AAAAACATCAACGTGAGAAACTTCCAC-3' | (SEQ ID NO: 3196) |
|  | 5'-AAAACAUCAACGUGAGAAACUUCCA-3' | (SEQ ID NO: 4306) |
|  | 3'-GUUUUUGUAGUUGCACUCUUUGAAGGU-5' | (SEQ ID NO: 2088) |
| βc-m2745 Target: | 5'-CAAAAACATCAACGTGAGAAACTTCCA-3' | (SEQ ID NO: 3197) |
|  | 5'-AAAAACAUCAACGUGAGAAACUUCC-3' | (SEQ ID NO: 4307) |
|  | 3'-CGUUUUUGUAGUUGCACUCUUUGAAGG-5' | (SEQ ID NO: 2089) |
| βc-m2746 Target: | 5'-GCAAAAACATCAACGTGAGAAACTTCC-3' | (SEQ ID NO: 3198) |
|  | 5'-GCAAAAACAUCAACGUGAGAAACUU-3' | (SEQ ID NO: 4308) |
|  | 3'-ACCGUUUUUGUAGUUGCACUCUUUGAA-5' | (SEQ ID NO: 2090) |
| βc-m2748 Target: | 5'-TGGCAAAAACATCAACGTGAGAAACTT-3' | (SEQ ID NO: 3199) |
|  | 5'-GCAAAAGCUGUGGCAAAAACAUCAA-3' | (SEQ ID NO: 4309) |
|  | 3'-GACGUUUUCGACACCGUUUUUGUAGUU-5' | (SEQ ID NO: 2091) |
| βc-m2760 Target: | 5'-CTGCAAAAGCTGTGGCAAAAACATCAA-3' | (SEQ ID NO: 3200) |

TABLE 11-continued

Additional Selected Anti-β-catenin DsiRNAs,
25/27mer Duplexes, Unmodified

|  |  |  |
|---|---|---|
|  | 5'-UGCAAAAGCUGUGGCAAAAACAUCA-3' | (SEQ ID NO: 4310) |
|  | 3'-CGACGUUUUCGACACCGUUUUUGUAGU-5' | (SEQ ID NO: 2092) |
| βc-m2761 Target: | 5'-GCTGCAAAAGCTGTGGCAAAAACATCA-3' | (SEQ ID NO: 3201) |
|  | 5'-UCAUCUGAGUAUAACGCUGCAAAAG-3' | (SEQ ID NO: 4311) |
|  | 3'-UGAGUAGACUCAUAUUGCGACGUUUUC-5' | (SEQ ID NO: 2093) |
| βc-m2778 Target: | 5'-ACTCATCTGAGTATAACGCTGCAAAAG-3' | (SEQ ID NO: 3202) |
|  | 5'-AAAACAGCAAAUGUUACUCAUCUGA-3' | (SEQ ID NO: 4312) |
|  | 3'-ACUUUUGUCGUUUACAAUGAGUAGACU-5' | (SEQ ID NO: 2094) |
| βc-m2795 Target: | 5'-TGAAAACAGCAAATGTTACTCATCTGA-3' | (SEQ ID NO: 3203) |
|  | 5'-GAAAACAGCAAAUGUUACUCAUCUG-3' | (SEQ ID NO: 4313) |
|  | 3'-AACUUUUGUCGUUUACAAUGAGUAGAC-5' | (SEQ ID NO: 2095) |
| βc-m2796 Target: | 5'-TTGAAAACAGCAAATGTTACTCATCTG-3' | (SEQ ID NO: 3204) |
|  | 5'-UGAAAACAGCAAAUGUUACUCAUCU-3' | (SEQ ID NO: 4314) |
|  | 3'-CAACUUUUGUCGUUUACAAUGAGUAGA-5' | (SEQ ID NO: 2096) |
| βc-m2797 Target: | 5'-GTTGAAAACAGCAAATGTTACTCATCT-3' | (SEQ ID NO: 3205) |
|  | 5'-AUUAAUGUUGAAAACAGCAAAUGUU-3' | (SEQ ID NO: 4315) |
|  | 3'-GAUAAUUACAACUUUUGUCGUUUACAA-5' | (SEQ ID NO: 2097) |
| βc-m2805 Target: | 5'-CTATTAATGTTGAAAACAGCAAATGTT-3' | (SEQ ID NO: 3206) |
|  | 5'-ACUACAGCUGUAUAGAGAGAAAGGC-3' | (SEQ ID NO: 4316) |
|  | 3'-UGUGAUGUCGACAUAUCUCUCUUUCCG-5' | (SEQ ID NO: 2098) |
| βc-m2834 Target: | 5'-ACACTACAGCTGTATAGAGAGAAAGGC-3' | (SEQ ID NO: 3207) |
|  | 5'-GGCCAAUCACAAUGCACGUUCAGAC-3' | (SEQ ID NO: 4317) |
|  | 3'-GUCCGGUUAGUGUUACGUGCAAGUCUG-5' | (SEQ ID NO: 2099) |
| βc-m2859 Target: | 5'-CAGGCCAATCACAATGCACGTTCAGAC-3' | (SEQ ID NO: 3208) |
|  | 5'-GUUCCCAUAGGAAACUCAGCUUGGU-3' | (SEQ ID NO: 4318) |
|  | 3'-GACAAGGGUAUCCUUUGAGUCGAACCA-5' | (SEQ ID NO: 2100) |
| βc-m2946 Target: | 5'-CTGTTCCCATAGGAAACTCAGCTTGGT-3' | (SEQ ID NO: 3209) |
|  | 5'-GAACAAAAAGCGUACUUCGACUGUU-3' | (SEQ ID NO: 4319) |
|  | 3'-GUCUUGUUUUUCGCAUGAAGCUGACAA-5' | (SEQ ID NO: 2101) |
| βc-m2968 Target: | 5'-CAGAACAAAAAGCGTACTTCGACTGTT-3' | (SEQ ID NO: 3210) |
|  | 5'-GGACCAGAACAAAAAGCGUACUUCG-3' | (SEQ ID NO: 4320) |
|  | 3'-UUCCUGGUCUUGUUUUUCGCAUGAAGC-5' | (SEQ ID NO: 2102) |
| βc-m2974 Target: | 5'-AAGGACCAGAACAAAAAGCGTACTTCG-3' | (SEQ ID NO: 3211) |
|  | 5'-ACCAAAAAGGACCAGAACAAAAAGC-3' | (SEQ ID NO: 4321) |
|  | 3'-GCUGGUUUUUCCUGGUCUUGUUUUUCG-5' | (SEQ ID NO: 2103) |
| βc-m2982 Target: | 5'-CGACCAAAAAGGACCAGAACAAAAAGC-3' | (SEQ ID NO: 3212) |
|  | 5'-GACCAAAAAGGACCAGAACAAAAAG-3' | (SEQ ID NO: 4322) |
|  | 3'-AGCUGGUUUUUCCUGGUCUUGUUUUUC-5' | (SEQ ID NO: 2104) |
| βc-m2983 Target: | 5'-TCGACCAAAAAGGACCAGAACAAAAAG-3' | (SEQ ID NO: 3213) |
|  | 5'-ACUCCUCGACCAAAAAGGACCAGAA-3' | (SEQ ID NO: 4323) |
|  | 3'-AAUGAGGAGCUGGUUUUUCCUGGUCUU-5' | (SEQ ID NO: 2105) |
| βc-m2990 Target: | 5'-TTACTCCTCGACCAAAAAGGACCAGAA-3' | (SEQ ID NO: 3214) |
|  | 5'-UCCAUUUGUAUUGUUACUCCUCGAC-3' | (SEQ ID NO: 4324) |
|  | 3'-UUAGGUAAACAUAACAAUGAGGAGCUG-5' | (SEQ ID NO: 2106) |
| βc-m3005 Target: | 5'-AATCCATTTGTATTGTTACTCCTCGAC-3' | (SEQ ID NO: 3215) |

TABLE 11-continued

Additional Selected Anti-β-catenin DsiRNAs,
25/27mer Duplexes, Unmodified

|  |  |  |  |
|---|---|---|---|
|  | 5'-AUCCAUUUGUAUUGUUACUCCUCGA-3' | (SEQ ID NO: 4325) |  |
|  | 3'-UUUAGGUAAACAUAACAAUGAGGAGCU-5' | (SEQ ID NO: 2107) |  |
| βc-m3006 Target: | 5'-AAATCCATTTGTATTGTTACTCCTCGA-3' | (SEQ ID NO: 3216) |  |
|  | 5'-AAUCCAUUUGUAUUGUUACUCCUCG-3' | (SEQ ID NO: 4326) |  |
|  | 3'-GUUUAGGUAAACAUAACAAUGAGGAGC-5' | (SEQ ID NO: 2108) |  |
| βc-m3007 Target: | 5'-CAAATCCATTTGTATTGTTACTCCTCG-3' | (SEQ ID NO: 3217) |  |
|  | 5'-AAAUCCAUUUGUAUUGUUACUCCUC-3' | (SEQ ID NO: 4327) |  |
|  | 3'-GGUUUAGGUAAACAUAACAAUGAGGAG-5' | (SEQ ID NO: 2109) |  |
| βc-m3008 Target: | 5'-CCAAATCCATTTGTATTGTTACTCCTC-3' | (SEQ ID NO: 3218) |  |
|  | 5'-ACUCCCCAAAUCCAUUUGUAUUGUU-3' | (SEQ ID NO: 4328) |  |
|  | 3'-AGUGAGGGGUUUAGGUAAACAUAACAA-5' | (SEQ ID NO: 2110) |  |
| βc-m3015 Target: | 5'-TCACTCCCCAAATCCATTTGTATTGTT-3' | (SEQ ID NO: 3219) |  |
|  | 5'-UCCAUUCGUGUGCAUUCUUCACUGC-3' | (SEQ ID NO: 4329) |  |
|  | 3'-CUAGGUAAGCACACGUAAGAAGUGACG-5' | (SEQ ID NO: 2111) |  |
| βc-m3047 Target: | 5'-GATCCATTCGTGTGCATTCTTCACTGC-3' | (SEQ ID NO: 3220) |  |
|  | 5'-AUCCAUUCGUGUGCAUUCUUCACUG-3' | (SEQ ID NO: 4330) |  |
|  | 3'-ACUAGGUAAGCACACGUAAGAAGUGAC-5' | (SEQ ID NO: 2112) |  |
| βc-m3048 Target: | 5'-TGATCCATTCGTGTGCATTCTTCACTG-3' | (SEQ ID NO: 3221) |  |
|  | 5'-GAUCCAUUCGUGUGCAUUCUUCACU-3' | (SEQ ID NO: 4331) |  |
|  | 3'-CACUAGGUAAGCACACGUAAGAAGUGA-5' | (SEQ ID NO: 2113) |  |
| βc-m3049 Target: | 5'-GTGATCCATTCGTGTGCATTCTTCACT-3' | (SEQ ID NO: 3222) |  |
|  | 5'-AAACAAAGAACAAGCAAGGCUAGGG-3' | (SEQ ID NO: 4332) |  |
|  | 3'-AUUUUGUUUCUUGUUCGUUCCGAUCCC-5' | (SEQ ID NO: 2114) |  |
| βc-m3093 Target: | 5'-TAAAACAAAGAACAAGCAAGGCTAGGG-3' | (SEQ ID NO: 3223) |  |
|  | 5'-ACCACUACAGAUAUUAAAACAAAGA-3' | (SEQ ID NO: 4333) |  |
|  | 3'-CGUGGUGAUGUCUAUAAUUUUGUUUCU-5' | (SEQ ID NO: 2115) |  |
| βc-m3109 Target: | 5'-GCACCACTACAGATATTAAAACAAAGA-3' | (SEQ ID NO: 3224) |  |
|  | 5'-GCACCACUACAGAUAUUAAAACAAA-3' | (SEQ ID NO: 4334) |  |
|  | 3'-GUCGUGGUGAUGUCUAUAAUUUUGUUU-5' | (SEQ ID NO: 2116) |  |
| βc-m3111 Target: | 5'-CAGCACCACTACAGATATTAAAACAAA-3' | (SEQ ID NO: 3225) |  |
|  | 5'-AGCACCACUACAGAUAUUAAAACAA-3' | (SEQ ID NO: 4335) |  |
|  | 3'-AGUCGUGGUGAUGUCUAUAAUUUUGUU-5' | (SEQ ID NO: 2117) |  |
| βc-m3112 Target: | 5'-TCAGCACCACTACAGATATTAAAACAA-3' | (SEQ ID NO: 3226) |  |
|  | 5'-AAAAUAAAAGCAAGCAAAGUCAGCA-3' | (SEQ ID NO: 4336) |  |
|  | 3'-UUUUUUAUUUUCGUUCGUUUCAGUCGU-5' | (SEQ ID NO: 2118) |  |
| βc-m3133 Target: | 5'-AAAAAATAAAAGCAAGCAAAGTCAGCA-3' | (SEQ ID NO: 3227) |  |
|  | 5'-GCAAAAAAUAAAAGCAAGCAAAGUC-3' | (SEQ ID NO: 4337) |  |
|  | 3'-GACGUUUUUUAUUUUCGUUCGUUUCAG-5' | (SEQ ID NO: 2119) |  |
| βc-m3137 Target: | 5'-CTGCAAAAAATAAAAGCAAGCAAAGTC-3' | (SEQ ID NO: 3228) |  |
|  | 5'-UUACUGCAAAAAAUAAAAGCAAGCA-3' | (SEQ ID NO: 4338) |  |
|  | 3'-UCAAUGACGUUUUUUAUUUUCGUUCGU-5' | (SEQ ID NO: 2120) |  |
| βc-m3142 Target: | 5'-AGTTACTGCAAAAAATAAAAGCAAGCA-3' | (SEQ ID NO: 3229) |  |
|  | 5'-UAACAGUUACUGCAAAAAAUAAAAG-3' | (SEQ ID NO: 4339) |  |
|  | 3'-UGAUUGUCAAUGACGUUUUUUAUUUUC-5' | (SEQ ID NO: 2121) |  |
| βc-m3148 Target: | 5'-ACTAACAGTTACTGCAAAAAATAAAAG-3' | (SEQ ID NO: 3230) |  |

TABLE 11-continued

Additional Selected Anti-β-catenin DsiRNAs,
25/27mer Duplexes, Unmodified

|  |  |  |
|---|---|---|
|  | 5'-ACUAACAGUUACUGCAAAAAAUAAA-3' | (SEQ ID NO: 4340) |
|  | 3'-UUUGAUUGUCAAUGACGUUUUUUAUUU-5' | (SEQ ID NO: 2122) |
| βc-m3150 Target: | 5'-AAACTAACAGTTACTGCAAAAAATAAA-3' | (SEQ ID NO: 3231) |
|  | 5'-AAACUAACAGUUACUGCAAAAAAUA-3' | (SEQ ID NO: 4341) |
|  | 3'-UUUUUGAUUGUCAAUGACGUUUUUUAU-5' | (SEQ ID NO: 2123) |
| βc-m3152 Target: | 5'-AAAAACTAACAGTTACTGCAAAAAATA-3' | (SEQ ID NO: 3232) |
|  | 5'-AAAACUAACAGUUACUGCAAAAAAU-3' | (SEQ ID NO: 4342) |
|  | 3'-AUUUUUGAUUGUCAAUGACGUUUUUUA-5' | (SEQ ID NO: 2124) |
| βc-m3153 Target: | 5'-TAAAAACTAACAGTTACTGCAAAAAAT-3' | (SEQ ID NO: 3233) |
|  | 5'-UAAAAACUAACAGUUACUGCAAAAA-3' | (SEQ ID NO: 4343) |
|  | 3'-GAAUUUUUGAUUGUCAAUGACGUUUUU-5' | (SEQ ID NO: 2125) |
| βc-m3155 Target: | 5'-CTTAAAAACTAACAGTTACTGCAAAAA-3' | (SEQ ID NO: 3234) |
|  | 5'-UACUUAAAAACUAACAGUUACUGCA-3' | (SEQ ID NO: 4344) |
|  | 3'-UGAUGAAUUUUUGAUUGUCAAUGACGU-5' | (SEQ ID NO: 2126) |
| βc-m3159 Target: | 5'-ACTACTTAAAAACTAACAGTTACTGCA-3' | (SEQ ID NO: 3235) |
|  | 5'-ACUACUUAAAAACUAACAGUUACUG-3' | (SEQ ID NO: 4345) |
|  | 3'-UGUGAUGAAUUUUUGAUUGUCAAUGAC-5' | (SEQ ID NO: 2127) |
| βc-m3161 Target: | 5'-ACACTACTTAAAAACTAACAGTTACTG-3' | (SEQ ID NO: 3236) |
|  | 5'-UAACACUACUUAAAAACUAACAGUU-3' | (SEQ ID NO: 4346) |
|  | 3'-GUAUUGUGAUGAAUUUUUGAUUGUCAA-5' | (SEQ ID NO: 2128) |
| βc-m3165 Target: | 5'-CATAACACTACTTAAAAACTAACAGTT-3' | (SEQ ID NO: 3237) |
|  | 5'-AUAACACUACUUAAAAACUAACAGU-3' | (SEQ ID NO: 4347) |
|  | 3'-UGUAUUGUGAUGAAUUUUUGAUUGUCA-5' | (SEQ ID NO: 2129) |
| βc-m3166 Target: | 5'-ACATAACACTACTTAAAAACTAACAGT-3' | (SEQ ID NO: 3238) |
|  | 5'-ACAUAACACUACUUAAAAACUAACA-3' | (SEQ ID NO: 4348) |
|  | 3'-CUUGUAUUGUGAUGAAUUUUUGAUUGU-5' | (SEQ ID NO: 2130) |
| βc-m3168 Target: | 5'-GAACATAACACTACTTAAAAACTAACA-3' | (SEQ ID NO: 3239) |
|  | 5'-AACAUAACACUACUUAAAAACUAAC-3' | (SEQ ID NO: 4349) |
|  | 3'-UCUUGUAUUGUGAUGAAUUUUUGAUUG-5' | (SEQ ID NO: 2131) |
| βc-m3169 Target: | 5'-AGAACATAACACTACTTAAAAACTAAC-3' | (SEQ ID NO: 3240) |
|  | 5'-GAACAUAACACUACUUAAAAACUAA-3' | (SEQ ID NO: 4350) |
|  | 3'-AUCUUGUAUUGUGAUGAAUUUUUGAUU-5' | (SEQ ID NO: 2132) |
| βc-m3170 Target: | 5'-TAGAACATAACACTACTTAAAAACTAA-3' | (SEQ ID NO: 3241) |
|  | 5'-AGAACAUAACACUACUUAAAAACUA-3' | (SEQ ID NO: 4351) |
|  | 3'-GAUCUUGUAUUGUGAUGAAUUUUUGAU-5' | (SEQ ID NO: 2133) |
| βc-m3171 Target: | 5'-CTAGAACATAACACTACTTAAAAACTA-3' | (SEQ ID NO: 3242) |
|  | 5'-UCACUAGAACAUAACACUACUUAAA-3' | (SEQ ID NO: 4352) |
|  | 3'-CAAGUGAUCUUGUAUUGUGAUGAAUUU-5' | (SEQ ID NO: 2134) |
| βc-m3176 Target: | 5'-GTTCACTAGAACATAACACTACTTAAA-3' | (SEQ ID NO: 3243) |
|  | 5'-GUUCACUAGAACAUAACACUACUUA-3' | (SEQ ID NO: 4353) |
|  | 3'-UCCAAGUGAUCUUGUAUUGUGAUGAAU-5' | (SEQ ID NO: 2135) |
| βc-m3178 Target: | 5'-AGGTTCACTAGAACATAACACTACTTA-3' | (SEQ ID NO: 3244) |
|  | 5'-GGUUCACUAGAACAUAACACUACUU-3' | (SEQ ID NO: 4354) |
|  | 3'-GUCCAAGUGAUCUUGUAUUGUGAUGAA-5' | (SEQ ID NO: 2136) |
| βc-m3179 Target: | 5'-CAGGTTCACTAGAACATAACACTACTT-3' | (SEQ ID NO: 3245) |

TABLE 11-continued

Additional Selected Anti-β-catenin DsiRNAs,
25/27mer Duplexes, Unmodified

```
                5'-AUUACUCGGUUCUUAGAAAUCAGAA-3'   (SEQ ID NO: 4355)
                3'-GGUAAUGAGCCAAGAAUCUUUAGUCUU-5' (SEQ ID NO: 2137)

βc-m3216 Target: 5'-CCATTACTCGGTTCTTAGAAATCAGAA-3' (SEQ ID NO: 3246)

5'-ACCAUUACUCGGUUCUUAGAAAUCA-3'   (SEQ ID NO: 4356)
                3'-UGUGGUAAUGAGCCAAGAAUCUUUAGU-5' (SEQ ID NO: 2138)

βc-m3219 Target: 5'-ACACCATTACTCGGTTCTTAGAAATCA-3' (SEQ ID NO: 3247)

5'-UCUACACCAUUACUCGGUUCUUAGA-3'   (SEQ ID NO: 4357)
                3'-CAAGAUGUGGUAAUGAGCCAAGAAUCU-5' (SEQ ID NO: 2139)

βc-m3224 Target: 5'-GTTCTACACCATTACTCGGTTCTTAGA-3' (SEQ ID NO: 3248)

5'-GAAUUAGUGUUCUACACCAUUACUC-3'   (SEQ ID NO: 4358)
                3'-UACUUAAUCACAAGAUGUGGUAAUGAG-5' (SEQ ID NO: 2140)

βc-m3234 Target: 5'-ATGAATTAGTGTTCTACACCATTACTC-3' (SEQ ID NO: 3249)

5'-AUUAUGAAUUAGUGUUCUACACCAU-3'   (SEQ ID NO: 4359)
                3'-ACUAAUACUUAAUCACAAGAUGUGGUA-5' (SEQ ID NO: 2141)

βc-m3239 Target: 5'-TGATTATGAATTAGTGTTCTACACC-3'   (SEQ ID NO: 3250)

5'-GAUUAUGAAUUAGUGUUCUACACCA-3'   (SEQ ID NO: 4360)
                3'-CACUAAUACUUAAUCACAAGAUGUGGU-5' (SEQ ID NO: 2142)

βc-m3240 Target: 5'-GTGATTATGAATTAGTGTTCTACACCA-3' (SEQ ID NO: 3251)

5'-UGAUUAUGAAUUAGUGUUCUACACC-3'   (SEQ ID NO: 4361)
                3'-GCACUAAUACUUAAUCACAAGAUGUGG-5' (SEQ ID NO: 2143)

βc-m3241 Target: 5'-CGTGATTATGAATTAGTGTTCTACACC-3' (SEQ ID NO: 3252)

5'-ACAAUUAGCGUGAUUAUGAAUUAGU-3'   (SEQ ID NO: 4362)
                3'-AAUGUUAAUCGCACUAAUACUUAAUCA-5' (SEQ ID NO: 2144)

βc-m3251 Target: 5'-TTACAATTAGCGTGATTATGAATTAGT-3' (SEQ ID NO: 3253)

5'-UACAAUUAGCGUGAUUAUGAAUUAG-3'   (SEQ ID NO: 4363)
                3'-UAAUGUUAAUCGCACUAAUACUUAAUC-5' (SEQ ID NO: 2145)

βc-m3252 Target: 5'-ATTACAATTAGCGTGATTATGAATTAG-3' (SEQ ID NO: 3254)

5'-AGAUUACAAUUAGCGUGAUUAUGAA-3'   (SEQ ID NO: 4364)
                3'-GGUCUAAUGUUAAUCGCACUAAUACUU-5' (SEQ ID NO: 2146)

βc-m3256 Target: 5'-CCAGATTACAATTAGCGTGATTATGAA-3' (SEQ ID NO: 3255)

5'-UACACGUCUCCAGAUUACAAUUAGC-3'   (SEQ ID NO: 4365)
                3'-CAAUGUGCAGAGGUCUAAUGUUAAUCG-5' (SEQ ID NO: 2147)

βc-m3267 Target: 5'-GTTACACGTCTCCAGATTACAATTAGC-3' (SEQ ID NO: 3256)

5'-GUUACACGUCUCCAGAUUACAAUUA-3'   (SEQ ID NO: 4366)
                3'-UACAAUGUGCAGAGGUCUAAUGUUAAU-5' (SEQ ID NO: 2148)

βc-m3269 Target: 5'-ATGTTACACGTCTCCAGATTACAATTA-3' (SEQ ID NO: 3257)

5'-UACACAAUGUUACACGUCUCCAGAU-3'   (SEQ ID NO: 4367)
                3'-CGAUGUGUUACAAUGUGCAGAGGUCUA-5' (SEQ ID NO: 2149)

βc-m3277 Target: 5'-GCTACACAATGTTACACGTCTCCAGAT-3' (SEQ ID NO: 3258)

5'-GCUACACAAUGUUACACGUCUCCAG-3'   (SEQ ID NO: 4368)
                3'-UCCGAUGUGUUACAAUGUGCAGAGGUC-5' (SEQ ID NO: 2150)

βc-m3279 Target: 5'-AGGCTACACAATGTTACACGTCTCCAG-3' (SEQ ID NO: 3259)

5'-ACAAAAGGCUACACAAUGUUACACG-3'   (SEQ ID NO: 4369)
                3'-UAUGUUUUCCGAUGUGUUACAAUGUGC-5' (SEQ ID NO: 2151)

βc-m3286 Target: 5'-ATACAAAAGGCTACACAATGTTACACG-3' (SEQ ID NO: 3260)
```

TABLE 11-continued

Additional Selected Anti-β-catenin DsiRNAs,
25/27mer Duplexes, Unmodified

|  |  |  |  |
|---|---|---|---|
|  | 5'-UACAAAAGGCUACACAAUGUUACAC-3' | (SEQ ID NO: 4370) |  |
|  | 3'-AUAUGUUUUCCGAUGUGUUACAAUGUG-5' | (SEQ ID NO: 2152) |  |
| βc-m3287 Target: | 5'-TATACAAAAGGCTACACAATGTTACAC-3' | (SEQ ID NO: 3261) |  |
|  | 5'-UUUAUACAAAAGGCUACACAAUGUU-3' | (SEQ ID NO: 4371) |  |
|  | 3'-AUAAAUAUGUUUUCCGAUGUGUUACAA-5' | (SEQ ID NO: 2153) |  |
| βc-m3291 Target: | 5'-TATTTATACAAAAGGCTACACAATGTT-3' | (SEQ ID NO: 3262) |  |
|  | 5'-AUUUAUACAAAAGGCUACACAAUGU-3' | (SEQ ID NO: 4372) |  |
|  | 3'-GAUAAAUAUGUUUUCCGAUGUGUUACA-5' | (SEQ ID NO: 2154) |  |
| βc-m3292 Target: | 5'-CTATTTATACAAAAGGCTACACAATGT-3' | (SEQ ID NO: 3263) |  |
|  | 5'-UCUAUUUAUACAAAAGGCUACACAA-3' | (SEQ ID NO: 4373) |  |
|  | 3'-ACAGAUAAAUAUGUUUUCCGAUGUGUU-5' | (SEQ ID NO: 2155) |  |
| βc-m3295 Target: | 5'-TGTCTATTTATACAAAAGGCTACACAA-3' | (SEQ ID NO: 3264) |  |
|  | 5'-GUCUAUUUAUACAAAAGGCUACACA-3' | (SEQ ID NO: 4374) |  |
|  | 3'-GACAGAUAAAUAUGUUUUCCGAUGUGU-5' | (SEQ ID NO: 2156) |  |
| βc-m3296 Target: | 5'-CTGTCTATTTATACAAAAGGCTACACA-3' | (SEQ ID NO: 3265) |  |
|  | 5'-UGUCUAUUUAUACAAAAGGCUACAC-3' | (SEQ ID NO: 4375) |  |
|  | 3'-AGACAGAUAAAUAUGUUUUCCGAUGUG-5' | (SEQ ID NO: 2157) |  |
| βc-m3297 Target: | 5'-TCTGTCTATTTATACAAAAGGCTACAC-3' | (SEQ ID NO: 3266) |  |
|  | 5'-UCUAUCUGUCUAUUUAUACAAAAGG-3' | (SEQ ID NO: 4376) |  |
|  | 3'-AAAGAUAGACAGAUAAAUAUGUUUUCC-5' | (SEQ ID NO: 2158) |  |
| βc-m3303 Target: | 5'-TTTCTATCTGTCTATTTATACAAAAGG-3' | (SEQ ID NO: 3267) |  |
|  | 5'-UUCUAUCUGUCUAUUUAUACAAAAG-3' | (SEQ ID NO: 4377) |  |
|  | 3'-UAAAGAUAGACAGAUAAAUAUGUUUUC-5' | (SEQ ID NO: 2159) |  |
| βc-m3304 Target: | 5'-ATTTCTATCTGTCTATTTATACAAAAG-3' | (SEQ ID NO: 3268) |  |
|  | 5'-UUUCUAUCUGUCUAUUUAUACAAAA-3' | (SEQ ID NO: 4378) |  |
|  | 3'-GUAAAGAUAGACAGAUAAAUAUGUUUU-5' | (SEQ ID NO: 2160) |  |
| βc-m3305 Target: | 5'-CATTTCTATCTGTCTATTTATACAAAA-3' | (SEQ ID NO: 3269) |  |
|  | 5'-AUUUCUAUCUGUCUAUUUAUACAAA-3' | (SEQ ID NO: 4379) |  |
|  | 3'-GGUAAAGAUAGACAGAUAAAUAUGUUU-5' | (SEQ ID NO: 2161) |  |
| βc-m3306 Target: | 5'-CCATTTCTATCTGTCTATTTATACAAA-3' | (SEQ ID NO: 3270) |  |
|  | 5'-GACCAUUUCUAUCUGUCUAUUUAUA-3' | (SEQ ID NO: 4380) |  |
|  | 3'-GCCUGGUAAAGAUAGACAGAUAAAUAU-5' | (SEQ ID NO: 2162) |  |
| βc-m3310 Target: | 5'-CGGACCATTTCTATCTGTCTATTTATA-3' | (SEQ ID NO: 3271) |  |
|  | 5'-GGACCAUUUCUAUCUGUCUAUUUAU-3' | (SEQ ID NO: 4381) |  |
|  | 3'-AGCCUGGUAAAGAUAGACAGAUAAAUA-5' | (SEQ ID NO: 2163) |  |
| βc-m3311 Target: | 5'-TCGGACCATTTCTATCTGTCTATTTAT-3' | (SEQ ID NO: 3272) |  |
|  | 5'-ACUAAUCGGACCAUUUCUAUCUGUC-3' | (SEQ ID NO: 4382) |  |
|  | 3'-UUUGAUUAGCCUGGUAAAGAUAGACAG-5' | (SEQ ID NO: 2164) |  |
| βc-m3318 Target: | 5'-AAACTAATCGGACCATTTCTATCTGTC-3' | (SEQ ID NO: 3273) |  |
|  | 5'-AACUAAUCGGACCAUUUCUAUCUGU-3' | (SEQ ID NO: 4383) |  |
|  | 3'-CUUUGAUUAGCCUGGUAAAGAUAGACA-5' | (SEQ ID NO: 2165) |  |
| βc-m3319 Target: | 5'-GAAACTAATCGGACCATTTCTATCTGT-3' | (SEQ ID NO: 3274) |  |
|  | 5'-AAACUAAUCGGACCAUUUCUAUCUG-3' | (SEQ ID NO: 4384) |  |
|  | 3'-CCUUUGAUUAGCCUGGUAAAGAUAGAC-5' | (SEQ ID NO: 2166) |  |
| βc-m3320 Target: | 5'-GGAAACTAATCGGACCATTTCTATCTG-3' | (SEQ ID NO: 3275) |  |

TABLE 11-continued

Additional Selected Anti-β-catenin DsiRNAs,
25/27mer Duplexes, Unmodified

|  |  |  |
|---|---|---|
|  | 5'-GAAACUAAUCGGACCAUUUCUAUCU-3'<br>3'-UCCUUUGAUUAGCCUGGUAAAGAUAGA-5' | (SEQ ID NO: 4385)<br>(SEQ ID NO: 2167) |
| βc-m3321 Target: | 5'-AGGAAACTAATCGGACCATTTCTATCT-3' | (SEQ ID NO: 3276) |
|  | 5'-UAAAAAGGAAACUAAUCGGACCAUU-3'<br>3'-UAAUUUUCCUUUGAUUAGCCUGGUAA-5' | (SEQ ID NO: 4386)<br>(SEQ ID NO: 2168) |
| βc-m3328 Target: | 5'-ATTAAAAGGAAACTAATCGGACCATT-3' | (SEQ ID NO: 3277) |
|  | 5'-GCAUAUUAAAAGGAAACUAAUCGG-3'<br>3'-UUCGUAUAAUUUUUCCUUUGAUUAGCC-5' | (SEQ ID NO: 4387)<br>(SEQ ID NO: 2169) |
| βc-m3334 Target: | 5'-AAGCATATTAAAAGGAAACTAATCGG-3' | (SEQ ID NO: 3278) |
|  | 5'-AGCAUAUUAAAAGGAAACUAAUCG-3'<br>3'-AUUCGUAUAAUUUUUCCUUUGAUUAGC-5' | (SEQ ID NO: 4388)<br>(SEQ ID NO: 2170) |
| βc-m3335 Target: | 5'-TAAGCATATTAAAAGGAAACTAATCG-3' | (SEQ ID NO: 3279) |
|  | 5'-UUUAAGCAUAUUAAAAGGAAACUA-3'<br>3'-UAAAAUUCGUAUAAUUUUUCCUUUGAU-5' | (SEQ ID NO: 4389)<br>(SEQ ID NO: 2171) |
| βc-m3339 Target: | 5'-ATTTTAAGCATATTAAAAGGAAACTA-3' | (SEQ ID NO: 3280) |
|  | 5'-GCUUAUUUUAAGCAUAUUAAAAGG-3'<br>3'-GACGAAUAAAAUUCGUAUAAUUUUUCC-5' | (SEQ ID NO: 4390)<br>(SEQ ID NO: 2172) |
| βc-m3345 Target: | 5'-CTGCTTATTTTAAGCATATTAAAAGG-3' | (SEQ ID NO: 3281) |
|  | 5'-UGCUUAUUUUAAGCAUAUUAAAAG-3'<br>3'-GGACGAAUAAAAUUCGUAUAAUUUUUC-5' | (SEQ ID NO: 4391)<br>(SEQ ID NO: 2173) |
| βc-m3346 Target: | 5'-CCTGCTTATTTTAAGCATATTAAAAG-3' | (SEQ ID NO: 3282) |
|  | 5'-UCCACCUGCUUAUUUUAAGCAUAUU-3'<br>3'-CUAGGUGGACGAAUAAAAUUCGUAUAA-5' | (SEQ ID NO: 4392)<br>(SEQ ID NO: 2174) |
| βc-m3352 Target: | 5'-GATCCACCTGCTTATTTTAAGCATATT-3' | (SEQ ID NO: 3283) |
|  | 5'-AAAACAUGAAAUAGAUCCACCUGCU-3'<br>3'-GUUUUUGUACUUUAUCUAGGUGGACGA-5' | (SEQ ID NO: 4393)<br>(SEQ ID NO: 2175) |
| βc-m3367 Target: | 5'-CAAAAACATGAAATAGATCCACCTGCT-3' | (SEQ ID NO: 3284) |
|  | 5'-AAAAACAUGAAAUAGAUCCACCUGC-3'<br>3'-AGUUUUUGUACUUUAUCUAGGUGGACG-5' | (SEQ ID NO: 4394)<br>(SEQ ID NO: 2176) |
| βc-m3368 Target: | 5'-TCAAAAACATGAAATAGATCCACCTGC-3' | (SEQ ID NO: 3285) |
|  | 5'-UCAAAAACAUGAAAUAGAUCCACCU-3'<br>3'-CAAGUUUUUGUACUUUAUCUAGGUGGA-5' | (SEQ ID NO: 4395)<br>(SEQ ID NO: 2177) |
| βc-m3370 Target: | 5'-GTTCAAAAACATGAAATAGATCCACCT-3' | (SEQ ID NO: 3286) |
|  | 5'-UUCAAAAACAUGAAAUAGAUCCACC-3'<br>3'-ACAAGUUUUUGUACUUUAUCUAGGUGG-5' | (SEQ ID NO: 4396)<br>(SEQ ID NO: 2178) |
| βc-m3371 Target: | 5'-TGTTCAAAAACATGAAATAGATCCACC-3' | (SEQ ID NO: 3287) |
|  | 5'-GUUCAAAAACAUGAAAUAGAUCCAC-3'<br>3'-AACAAGUUUUUGUACUUUAUCUAGGUG-5' | (SEQ ID NO: 4397)<br>(SEQ ID NO: 2179) |
| βc-m3372 Target: | 5'-TTGTTCAAAAACATGAAATAGATCCAC-3' | (SEQ ID NO: 3288) |
|  | 5'-UUUUUGUUCAAAACAUGAAAUAGA-3'<br>3'-UCAAAAACAAGUUUUUGUACUUUAUCU-5' | (SEQ ID NO: 4398)<br>(SEQ ID NO: 2180) |
| βc-m3377 Target: | 5'-AGTTTTTGTTCAAAAACATGAAATAGA-3' | (SEQ ID NO: 3289) |
|  | 5'-AUAAAGUUUUGUUCAAAACAUGA-3'<br>3'-GCUAUUUCAAAAACAAGUUUUUGUACU-5' | (SEQ ID NO: 4399)<br>(SEQ ID NO: 2181) |
| βc-m3383 Target: | 5'-CGATAAAGTTTTTGTTCAAAAACATGA-3' | (SEQ ID NO: 3290) |

TABLE 11-continued

Additional Selected Anti-β-catenin DsiRNAs,
25/27mer Duplexes, Unmodified

```
                5'-UCCCCGAUAAAGUUUUGUUCAAAA-3'    (SEQ ID NO: 4400)
                3'-AUAGGGGCUAUUUCAAAAACAAGUUUU-5' (SEQ ID NO: 2182)

βc-m3389 Target: 5'-TATCCCCGATAAAGTTTTGTTCAAAA-3'  (SEQ ID NO: 3291)

5'-AUCCCCGAUAAAGUUUUGUUCAAA-3'    (SEQ ID NO: 4401)
                3'-CAUAGGGGCUAUUUCAAAAACAAGUUUU-5'(SEQ ID NO: 2183)

βc-m3390 Target: 5'-GTATCCCCGATAAAGTTTTGTTCAAA-3'  (SEQ ID NO: 3292)

5'-ACCUCUUACUGAUUUACCCUACCGC-3'   (SEQ ID NO: 4402)
                3'-UGUGGAGAAUGACUAAAUGGGAUGGCG-5' (SEQ ID NO: 2184)

βc-m3419 Target: 5'-ACACCTCTTACTGATTTACCCTACCGC-3' (SEQ ID NO: 3293)

5'-ACACCUCUUACUGAUUUACCCUACC-3'   (SEQ ID NO: 4403)
                3'-AUUGUGGAGAAUGACUAAAUGGGAUGG-5' (SEQ ID NO: 2185)

βc-m3421 Target: 5'-TAACACCTCTTACTGATTTACCCTACC-3' (SEQ ID NO: 3294)

5'-AACACCUCUUACUGAUUUACCCUAC-3'   (SEQ ID NO: 4404)
                3'-UAUUGUGGAGAAUGACUAAAUGGGAUG-5' (SEQ ID NO: 2186)

βc-m3422 Target: 5'-ATAACACCTCTTACTGATTTACCCTAC-3' (SEQ ID NO: 3295)

5'-UAACACCUCUUACUGAUUUACCCUA-3'   (SEQ ID NO: 4405)
                3'-UUAUUGUGGAGAAUGACUAAAUGGGAU-5' (SEQ ID NO: 2187)

βc-m3423 Target: 5'-AATAACACCTCTTACTGATTTACCCTA-3' (SEQ ID NO: 3296)

5'-AUAACACCUCUUACUGAUUUACCCU-3'   (SEQ ID NO: 4406)
                3'-UUUAUUGUGGAGAAUGACUAAAUGGGA-5' (SEQ ID NO: 2188)

βc-m3424 Target: 5'-AAATAACACCTCTTACTGATTTACCCT-3' (SEQ ID NO: 3297)

5'-AAUAACACCUCUUACUGAUUUACCC-3'   (SEQ ID NO: 4407)
                3'-GUUUAUUGUGGAGAAUGACUAAAUGGG-5' (SEQ ID NO: 2189)

βc-m3425 Target: 5'-CAAATAACACCTCTTACTGATTTACCC-3' (SEQ ID NO: 3298)

5'-GGCUCAAAUAACACCUCUUACUGAU-3'   (SEQ ID NO: 4408)
                3'-UUCCGAGUUUAUUGUGGAGAAUGACUA-5' (SEQ ID NO: 2190)

βc-m3431 Target: 5'-AAGGCTCAAATAACACCTCTTACTGAT-3' (SEQ ID NO: 3299)

5'-AACAAGGCUCAAAUAACACCUCUUA-3'   (SEQ ID NO: 4409)
                3'-UUUUGUUCCGAGUUUAUUGUGGAGAAU-5' (SEQ ID NO: 2191)

βc-m3436 Target: 5'-AAAACAAGGCTCAAATAACACCTCTTA-3' (SEQ ID NO: 3300)

5'-AAACAAGGCUCAAAUAACACCUCUU-3'   (SEQ ID NO: 4410)
                3'-GUUUUGUUCCGAGUUUAUUGUGGAGAA-5' (SEQ ID NO: 2192)

βc-m3437 Target: 5'-CAAAACAAGGCTCAAATAACACCTCTT-3' (SEQ ID NO: 3301)

5'-AAAACAAGGCUCAAAUAACACCUCU-3'   (SEQ ID NO: 4411)
                3'-GGUUUUGUUCCGAGUUUAUUGUGGAGA-5' (SEQ ID NO: 2193)

βc-m3438 Target: 5'-CCAAAACAAGGCTCAAATAACACCTCT-3' (SEQ ID NO: 3302)

5'-UCCAAAACAAGGCUCAAAUAACACC-3'   (SEQ ID NO: 4412)
                3'-ACAGGUUUUGUUCCGAGUUUAUUGUGG-5' (SEQ ID NO: 2194)

βc-m3441 Target: 5'-TGTCCAAAACAAGGCTCAAATAACACC-3' (SEQ ID NO: 3303)

5'-UGUCCAAAACAAGGCUCAAAUAACA-3'   (SEQ ID NO: 4413)
                3'-UGACAGGUUUUGUUCCGAGUUUAUUGU-5' (SEQ ID NO: 2195)

βc-m3443 Target: 5'-ACTGTCCAAAACAAGGCTCAAATAACA-3' (SEQ ID NO: 3304)

5'-UAUACUGUCCAAAACAAGGCUCAAA-3'   (SEQ ID NO: 4414)
                3'-CCAUAUGACAGGUUUUGUUCCGAGUUU-5' (SEQ ID NO: 2196)

βc-m3448 Target: 5'-GGTATACTGTCCAAAACAAGGCTCAAA-3' (SEQ ID NO: 3305)
```

TABLE 11-continued

Additional Selected Anti-β-catenin DsiRNAs,
25/27mer Duplexes, Unmodified

```
                5'-GCAACUGGUAUACUGUCCAAAACAA-3'   (SEQ ID NO: 4415)
                3'-UCCGUUGACCAUAUGACAGGUUUUGUU-5' (SEQ ID NO: 2197)

βc-m3456 Target: 5'-AGGCAACTGGTATACTGTCCAAAACAA-3'  (SEQ ID NO: 3306)

5'-GAUAAAAGGCAACUGGUAUACUGUC-3'   (SEQ ID NO: 4416)
                3'-CCCUAUUUUCCGUUGACCAUAUGACAG-5' (SEQ ID NO: 2198)

βc-m3464 Target: 5'-GGGATAAAAGGCAACTGGTATACTGTC-3' (SEQ ID NO: 3307)

5'-GGAUAAAAGGCAACUGGUAUACUGU-3'   (SEQ ID NO: 4417)
                3'-ACCCUAUUUUCCGUUGACCAUAUGACA-5' (SEQ ID NO: 2199)

βc-m3465 Target: 5'-TGGGATAAAAGGCAACTGGTATACTGT-3' (SEQ ID NO: 3308)

5'-AACUUUGGGAUAAAAGGCAACUGGU-3'   (SEQ ID NO: 4418)
                3'-UGUUGAAACCCUAUUUUCCGUUGACCA-5' (SEQ ID NO: 2200)

βc-m3472 Target: 5'-ACAACTTTGGGATAAAAGGCAACTGGT-3' (SEQ ID NO: 3309)

5'-ACAACUUUGGGAUAAAAGGCAACUG-3'   (SEQ ID NO: 4419)
                3'-GUUGUUGAAACCCUAUUUUCCGUUGAC-5' (SEQ ID NO: 2201)

βc-m3474 Target: 5'-CAACAACTTTGGGATAAAAGGCAACTG-3' (SEQ ID NO: 3310)

5'-UUACAACAACUUUGGGAUAAAAGGC-3'   (SEQ ID NO: 4420)
                3'-CCAAUGUUGUUGAAACCCUAUUUUCCG-5' (SEQ ID NO: 2202)

βc-m3479 Target: 5'-GGTTACAACAACTTTGGGATAAAAGGC-3' (SEQ ID NO: 3311)

5'-GUUACAACAACUUUGGGAUAAAAGG-3'   (SEQ ID NO: 4421)
                3'-UCCAAUGUUGUUGAAACCCUAUUUUCC-5' (SEQ ID NO: 2203)

βc-m3480 Target: 5'-AGGTTACAACAACTTTGGGATAAAAGG-3' (SEQ ID NO: 3312)

5'-GGUUACAACAACUUUGGGAUAAAAG-3'   (SEQ ID NO: 4422)
                3'-GUCCAAUGUUGUUGAAACCCUAUUUUC-5' (SEQ ID NO: 2204)

βc-m3481 Target: 5'-CAGGTTACAACAACTTTGGGATAAAAG-3' (SEQ ID NO: 3313)

5'-UCACAGCAGGUUACAACAACUUUGG-3'   (SEQ ID NO: 4423)
                3'-AUAGUGUCGUCCAAUGUUGUUGAAACC-5' (SEQ ID NO: 2205)

βc-m3489 Target: 5'-TATCACAGCAGGTTACAACAACTTTGG-3' (SEQ ID NO: 3314)

5'-AUCACAGCAGGUUACAACAACUUUG-3'   (SEQ ID NO: 4424)
                3'-CAUAGUGUCGUCCAAUGUUGUUGAAAC-5' (SEQ ID NO: 2206)

βc-m3490 Target: 5'-GTATCACAGCAGGTTACAACAACTTTG-3' (SEQ ID NO: 3315)

5'-GUAUCACAGCAGGUUACAACAACUU-3'   (SEQ ID NO: 4425)
                3'-AACAUAGUGUCGUCCAAUGUUGUUGAA-5' (SEQ ID NO: 2207)

βc-m3492 Target: 5'-TTGTATCACAGCAGGTTACAACAACTT-3' (SEQ ID NO: 3316)

5'-GCAUCUGUUGAAGCAUUGUAUCACA-3'   (SEQ ID NO: 4426)
                3'-GGCGUAGACAACUUCGUAACAUAGUGU-5' (SEQ ID NO: 2208)

βc-m3509 Target: 5'-CCGCATCTGTTGAAGCATTGTATCACA-3' (SEQ ID NO: 3317)

5'-UGAACCAUUUCUAUAACCGCAUCUG-3'   (SEQ ID NO: 4427)
                3'-AGACUUGGUAAAGAUAUUGGCGUAGAC-5' (SEQ ID NO: 2209)

βc-m3527 Target: 5'-TCTGAACCATTTCTATAACCGCATCTG-3' (SEQ ID NO: 3318)

5'-AUUCUGAACCAUUUCUAUAACCGCA-3'   (SEQ ID NO: 4428)
                3'-AUUAAGACUUGGUAAAGAUAUUGGCGU-5' (SEQ ID NO: 2210)

βc-m3531 Target: 5'-TAATTCTGAACCATTTCTATAACCGCA-3' (SEQ ID NO: 3319)

5'-UAAUUCUGAACCAUUUCUAUAACCG-3'   (SEQ ID NO: 4429)
                3'-AAAUUAAGACUUGGUAAAGAUAUUGGC-5' (SEQ ID NO: 2211)

βc-m3533 Target: 5'-TTTAATTCTGAACCATTTCTATAACCG-3' (SEQ ID NO: 3320)
```

TABLE 11-continued

Additional Selected Anti-β-catenin DsiRNAs, 25/27mer Duplexes, Unmodified

|  |  |  |  |
|---|---|---|---|
|  | 5'-UUAAUUCUGAACCAUUUCUAUAACC-3' | (SEQ ID NO: 4430) |  |
|  | 3'-CAAAUUAAGACUUGGUAAAGAUAUUGG-5' | (SEQ ID NO: 2212) |  |
| βc-m3534 Target: | 5'-GTTTAATTCTGAACCATTTCTATAACC-3' | (SEQ ID NO: 3321) |  |
|  | 5'-UUUAAUUCUGAACCAUUUCUAUAAC-3' | (SEQ ID NO: 4431) |  |
|  | 3'-UCAAAUUAAGACUUGGUAAAGAUAUUG-5' | (SEQ ID NO: 2213) |  |
| βc-m3535 Target: | 5'-AGTTTAATTCTGAACCATTTCTATAAC-3' | (SEQ ID NO: 3322) |  |
|  | 5'-GUUUAAUUCUGAACCAUUUCUAUAA-3' | (SEQ ID NO: 4432) |  |
|  | 3'-UUCAAAUUAAGACUUGGUAAAGAUAUU-5' | (SEQ ID NO: 2214) |  |
| βc-m3536 Target: | 5'-AAGTTTAATTCTGAACCATTTCTATAA-3' | (SEQ ID NO: 3323) |  |
|  | 5'-UAAAAGUUUAAUUCUGAACCAUUUC-3' | (SEQ ID NO: 4433) |  |
|  | 3'-UAAUUUUCAAAUUAAGACUUGGUAAAG-5' | (SEQ ID NO: 2215) |  |
| βc-m3541 Target: | 5'-ATTAAAGTTTAATTCTGAACCATTTC-3' | (SEQ ID NO: 3324) |  |
|  | 5'-UUAAAAGUUUAAUUCUGAACCAUUU-3' | (SEQ ID NO: 4434) |  |
|  | 3'-UUAAUUUUCAAAUUAAGACUUGGUAAA-5' | (SEQ ID NO: 2216) |  |
| βc-m3542 Target: | 5'-AATTAAAAGTTTAATTCTGAACCATTT-3' | (SEQ ID NO: 3325) |  |
|  | 5'-AAUUAAAAGUUUAAUUCUGAACCAU-3' | (SEQ ID NO: 4435) |  |
|  | 3'-ACUUAAUUUUCAAAUUAAGACUUGGUA-5' | (SEQ ID NO: 2217) |  |
| βc-m3544 Target: | 5'-TGAATTAAAAGTTTAATTCTGAACC-3' | (SEQ ID NO: 3326) |  |
|  | 5'-UGAAUGAAUUAAAAGUUUAAUUCUG-3' | (SEQ ID NO: 4436) |  |
|  | 3'-AAACUUACUUAAUUUUCAAAUUAAGAC-5' | (SEQ ID NO: 2218) |  |
| βc-m3550 Target: | 5'-TTTGAATGAATTAAAAGTTTAATTCTG-3' | (SEQ ID NO: 3327) |  |
|  | 5'-UUUUUGAAUGAAUUAAAAGUUUAAU-3' | (SEQ ID NO: 4437) |  |
|  | 3'-AAAAAAACUUACUUAAUUUUCAAAUUA-5' | (SEQ ID NO: 2219) |  |
| βc-m3554 Target: | 5'-TTTTTTTGAATGAATTAAAAGTTTAAT-3' | (SEQ ID NO: 3328) |  |
|  | 5'-UUUUUUUUUGAAUGAAUUAAAAGUU-3' | (SEQ ID NO: 4438) |  |
|  | 3'-AAAAAAAAAAACUUACUUAAUUUUCAA-5' | (SEQ ID NO: 2220) |  |
| βc-m3558 Target: | 5'-TTTTTTTTTTGAATGAATTAAAAGTT-3' | (SEQ ID NO: 3329) |  |
|  | 5'-UUUUUUUUUUGAAUGAAUUAAAAGU-3' | (SEQ ID NO: 4439) |  |
|  | 3'-AAAAAAAAAAACUUACUUAAUUUUCA-5' | (SEQ ID NO: 2221) |  |
| βc-m3559 Target: | 5'-TTTTTTTTTTTGAATGAATTAAAAGT-3' | (SEQ ID NO: 3330) |  |
|  | 5'-UUUUUUUUUUUGAAUGAAUUAAAAG-3' | (SEQ ID NO: 4440) |  |
|  | 3'-AAAAAAAAAAAACUUACUUAAUUUUC-5' | (SEQ ID NO: 2222) |  |
| βc-m3560 Target: | 5'-TTTTTTTTTTTTGAATGAATTAAAAG-3' | (SEQ ID NO: 3331) |  |
|  | 5'-UUUUUUUUUUUUGAAUGAAUUAAAA-3' | (SEQ ID NO: 4441) |  |
|  | 3'-AAAAAAAAAAAAACUUACUUAAUUUU-5' | (SEQ ID NO: 2223) |  |
| βc-m3561 Target: | 5'-TTTTTTTTTTTTTGAATGAATTAAAA-3' | (SEQ ID NO: 3332) |  |
|  | 5'-UUUUUUUUUUUUUGAAUGAAUUAAA-3' | (SEQ ID NO: 4442) |  |
|  | 3'-AAAAAAAAAAAAAACUUACUUAAUUU-5' | (SEQ ID NO: 2224) |  |
| βc-m3562 Target: | 5'-TTTTTTTTTTTTTTGAATGAATTAAA-3' | (SEQ ID NO: 3333) |  |
|  | 5'-UUUUUUUUUUUUUUGAAUGAAUUAA-3' | (SEQ ID NO: 4443) |  |
|  | 3'-AAAAAAAAAAAAAAACUUACUUAAUU-5' | (SEQ ID NO: 2225) |  |
| βc-m3563 Target: | 5'-TTTTTTTTTTTTTTTGAATGAATTAA-3' | (SEQ ID NO: 3334) |  |

TABLE 12

Additional Selected Anti-β-catenin DsiRNAs, Blunt/Frayed Duplexes

5'-GUUGUAUGGUAUACUUCAAAUACCC$^{CA-3'}$ (SEQ ID NO: 6041)
3'-CAACAUACCAUAUGAAGUUUAUGGG$_{G-5'}$ (SEQ ID NO: 1605)

βc-244 Target: 5'-GTTGTATGGTATACTTCAAATACCCTC-3' (SEQ ID NO: 2714)

5'-CAAAACAGUUGUAUGGUAUACUUCA$^{CC-3'}$ (SEQ ID NO: 6042)
3'-GUUUUGUCAACAUACCAUAUGAAGU$_{U-5'}$ (SEQ ID NO: 1606)

βc-251 Target: 5'-CAAAACAGTTGTATGGTATACTTCAAA-3' (SEQ ID NO: 2715)

5'-UCAAAACAGUUGUAUGGUAUACUUC$^{CC-3'}$ (SEQ ID NO: 6043)
3'-AGUUUUGUCAACAUACCAUAUGAAG$_{U-5'}$ (SEQ ID NO: 1607)

βc-252 Target: 5'-TCAAAACAGTTGTATGGTATACTTCAA-3' (SEQ ID NO: 2716)

5'-UUUCAAAACAGUUGUAUGGUAUACU$^{CA-3'}$ (SEQ ID NO: 6044)
3'-AAAGUUUUGUCAACAUACCAUAUGA$_{G-5'}$ (SEQ ID NO: 1608)

βc-254 Target: 5'-TTTCAAAACAGTTGTATGGTATACTTC-3' (SEQ ID NO: 2717)

5'-UUUUCAAAACAGUUGUAUGGUAUAC$^{CC-3'}$ (SEQ ID NO: 6045)
3'-AAAAGUUUUGUCAACAUACCAUAUG$_{A-5'}$ (SEQ ID NO: 1609)

βc-255 Target: 5'-TTTTCAAAACAGTTGTATGGTATACTT-3' (SEQ ID NO: 2718)

5'-AUUUUCAAAACAGUUGUAUGGUAUA$^{AC-3'}$ (SEQ ID NO: 6046)
3'-UAAAAGUUUUGUCAACAUACCAUAU$_{G-5'}$ (SEQ ID NO: 1610)

βc-256 Target: 5'-ATTTTCAAAACAGTTGTATGGTATACT-3' (SEQ ID NO: 2719)

5'-UUGUCCACGCUGGAUUUUCAAAACA$^{AC-3'}$ (SEQ ID NO: 6047)
3'-AACAGGUGCGACCUAAAAGUUUUGU$_{C-5'}$ (SEQ ID NO: 1611)

βc-269 Target: 5'-TTGTCCACGCTGGATTTTCAAAACAGT-3' (SEQ ID NO: 2720)

5'-AUUGUCCACGCUGGAUUUUCAAAAC$^{A-3'}$ (SEQ ID NO: 6048)
3'-UAACAGGUGCGACCUAAAAGUUUUG$_{C-5'}$ (SEQ ID NO: 1612)

βc-270 Target: 5'-ATTGTCCACGCTGGATTTTCAAAACAG-3' (SEQ ID NO: 2721)

5'-CCAUCAAAUCAGCUUGAGUAGCCAU$^{CA-3'}$ (SEQ ID NO: 6049)
3'-GGUAGUUUAGUCGAACUCAUCGGUA$_{C-5'}$ (SEQ ID NO: 1613)

βc-293 Target: 5'-CCATCAAATCAGCTTGAGTAGCCATTG-3' (SEQ ID NO: 2722)

5'-UGUCCAACUCCAUCAAAUCAGCUUG$^{CA-3'}$ (SEQ ID NO: 6050)
3'-ACAGGUUGAGGUAGUUUAGUCGAAC$_{U-5'}$ (SEQ ID NO: 1614)

βc-302 Target: 5'-TGTCCAACTCCATCAAATCAGCTTGAG-3' (SEQ ID NO: 2723)

5'-CUUCCUCAGGAUUGCCUUUACCACU$^{A-3'}$ (SEQ ID NO: 6051)
3'-GAAGGAGUCCUAACGGAAAUGGUGA$_{U-5'}$ (SEQ ID NO: 1615)

βc-431 Target: 5'-CTTCCTCAGGATTGCCTTTACCACTCA-3' (SEQ ID NO: 2724)

5'-UCUUCCUCAGGAUUGCCUUUACCAC$^{CA-3'}$ (SEQ ID NO: 6052)
3'-AGAAGGAGUCCUAACGGAAAUGGUG$_{G-5'}$ (SEQ ID NO: 1616)

βc-432 Target: 5'-TCTTCCTCAGGATTGCCTTTACCACTC-3' (SEQ ID NO: 2725)

TABLE 12-continued

Additional Selected Anti-β-catenin DsiRNAs, Blunt/Frayed Duplexes

5'-CAUCAAUAUCAGCUACUUGUUCUUG$^{CA-3'}$ (SEQ ID NO: 6053)
3'-GUAGUUAUAGUCGAUGAACAAGAAC$_{UC-5'}$ (SEQ ID NO: 1617)

βc-518 Target: 5'-CATCAATATCAGCTACTTGTTCTTGAG-3' (SEQ ID NO: 2726)

5'-CCAUCAAUAUCAGCUACUUGUUCUU$^{AC-3'}$ (SEQ ID NO: 6054)
3'-GGUAGUUAUAGUCGAUGAACAAGAA$_{CU-5'}$ (SEQ ID NO: 1618)

βc-519 Target: 5'-CCATCAATATCAGCTACTTGTTCTTGA-3' (SEQ ID NO: 2727)

5'-ACUGUCCAUCAAUAUCAGCUACUUG$^{CC-3'}$ (SEQ ID NO: 6055)
3'-UGACAGGUAGUUAUAGUCGAUGAAC$_{AA-5'}$ (SEQ ID NO: 1619)

βc-524 Target: 5'-ACTGTCCATCAATATCAGCTACTTGTT-3' (SEQ ID NO: 2728)

5'-AUUGCAUACUGUCCAUCAAUAUCAG$^{AC-3'}$ (SEQ ID NO: 6056)
3'-UAACGUAUGACAGGUAGUUAUAGUC$_{GA-5'}$ (SEQ ID NO: 1620)

βc-531 Target: 5'-ATTGCATACTGTCCATCAATATCAGCT-3' (SEQ ID NO: 2729)

5'-CGAGUCAUUGCAUACUGUCCAUCAA$^{CC-3'}$ (SEQ ID NO: 6057)
3'-GCUCAGUAACGUAUGACAGGUAGUU$_{AU-5'}$ (SEQ ID NO: 1621)

βc-537 Target: 5'-CGAGTCATTGCATACTGTCCATCAATA-3' (SEQ ID NO: 2730)

5'-CCUCAUCUAAUGUCUCAGGGAACAU$^{CA-3'}$ (SEQ ID NO: 6058)
3'-GGAGUAGAUUACAGAGUCCCUUGUA$_{UC-5'}$ (SEQ ID NO: 1622)

βc-584 Target: 5'-CCTCATCTAATGTCTCAGGGAACATAG-3' (SEQ ID NO: 2731)

5'-UUACAACUGCAUGUUUCAGCAUCUG$^{CA-3'}$ (SEQ ID NO: 6059)
3'-AAUGUUGACGUACAAAGUCGUAGAC$_{AC-5'}$ (SEQ ID NO: 1623)

βc-680 Target: 5'-TTACAACTGCATGTTTCAGCATCTGTG-3' (SEQ ID NO: 2732)

5'-GUUUACAACUGCAUGUUUCAGCAUC$^{CA-3'}$ (SEQ ID NO: 6060)
3'-CAAAUGUUGACGUACAAAGUCGUAG$_{AC-5'}$ (SEQ ID NO: 1624)

βc-682 Target: 5'-GTTTACAACTGCATGTTTCAGCATCTG-3' (SEQ ID NO: 2733)

5'-AGUUAAUCAAGUUUACAACUGCAUG$^{CC-3'}$ (SEQ ID NO: 6061)
3'-UCAAUUAGUUCAAAUGUUGACGUAC$_{AA-5'}$ (SEQ ID NO: 1625)

βc-692 Target: 5'-AGTTAATCAAGTTTACAACTGCATGTT-3' (SEQ ID NO: 2734)

5'-CUUGAUAGUUAAUCAAGUUUACAAC$^{CA-3'}$ (SEQ ID NO: 6062)
3'-GAACUAUCAAUUAGUUCAAAUGUUG$_{AC-5'}$ (SEQ ID NO: 1626)

βc-698 Target: 5'-CTTGATAGTTAATCAAGTTTACAACTG-3' (SEQ ID NO: 2735)

5'-CUGCAUCAUCUUGAUAGUUAAUCAA$^{AC-3'}$ (SEQ ID NO: 6063)
3'-GACGUAGUAGAACUAUCAAUUAGUU$_{CA-5'}$ (SEQ ID NO: 1627)

βc-707 Target: 5'-CTGCATCATCTTGATAGTTAATCAAGT-3' (SEQ ID NO: 2736)

5'-UCUGCAUCAUCUUGAUAGUUAAUCA$^{CA-3'}$ (SEQ ID NO: 6064)
3'-AGACGUAGUAGAACUAUCAAUUAGU$_{UC-5'}$ (SEQ ID NO: 1628)

βc-708 Target: 5'-TCTGCATCATCTTGATAGTTAATCAAG-3' (SEQ ID NO: 2737)

TABLE 12-continued

Additional Selected Anti-β-catenin DsiRNAs, Blunt/Frayed Duplexes

5'-CUGGUCCUCGUCAUUUAGCAGUUUU$^A$$^{C-3'}$ (SEQ ID NO: 6065)
3'-GACCAGGAGCAGUAAAUCGUCAAAA$_C$$_{A-5'}$ (SEQ ID NO: 1629)

βc-763 Target: 5'-CTGGTCCTCGTCATTTAGCAGTTTTGT-3' (SEQ ID NO: 2738)

5'-CAUAACUGCAGCCUUAUUAACCACC$^C$$^{A-3'}$ (SEQ ID NO: 6066)
3'-GUAUUGACGUCGGAAUAAUUGGUGG$_U$$_{G-5'}$ (SEQ ID NO: 1630)

βc-790 Target: 5'-CATAACTGCAGCCTTATTAACCACCAC-3' (SEQ ID NO: 2739)

5'-CCAUAACUGCAGCCUUAUUAACCAC$^A$$^{C-3'}$ (SEQ ID NO: 6067)
3'-GGUAUUGACGUCGGAAUAAUUGGUG$_G$$_{U-5'}$ (SEQ ID NO: 1631)

βc-791 Target: 5'-CCATAACTGCAGCCTTATTAACCACCA-3' (SEQ ID NO: 2740)

5'-GGACCAUAACUGCAGCCUUAUUAAC$^A$$^{C-3'}$ (SEQ ID NO: 6068)
3'-CCUGGUAUUGACGUCGGAAUAAUUG$_G$$_{U-5'}$ (SEQ ID NO: 1632)

βc-794 Target: 5'-GGACCATAACTGCAGCCTTATTAACCA-3' (SEQ ID NO: 2741)

5'-CCUUUUUAGAAAGCUGAUGGACCAU$^C$$^{C-3'}$ (SEQ ID NO: 6069)
3'-GGAAAAAUCUUUCGACUACCUGGUA$_U$$_{U-5'}$ (SEQ ID NO: 1633)

βc-812 Target: 5'-CCTTTTTAGAAAGCTGATGGACCATAA-3' (SEQ ID NO: 2742)

5'-AUGGUACGUACAAUAGCAGACACCA$^C$$^{A-3'}$ (SEQ ID NO: 6070)
3'-UACCAUGCAUGUUAUCGUCUGUGGU$_A$$_{G-5'}$ (SEQ ID NO: 1634)

βc-873 Target: 5'-ATGGTACGTACAATAGCAGACACCATC-3' (SEQ ID NO: 2743)

5'-CAUCAUUUGUAUUCUGCAUGGUACG$^C$$^{C-3'}$ (SEQ ID NO: 6071)
3'-GUAGUAAACAUAAGACGUACCAUGC$_A$$_{U-5'}$ (SEQ ID NO: 1635)

βc-890 Target: 5'-CATCATTTGTATTCTGCATGGTACGTA-3' (SEQ ID NO: 2744)

5'-CUGUUUCUACAUCAUUUGUAUUCUG$^A$$^{C-3'}$ (SEQ ID NO: 6072)
3'-GACAAAGAUGUAGUAAACAUAAGAC$_G$$_{U-5'}$ (SEQ ID NO: 1636)

βc-899 Target: 5'-CTGTTTCTACATCATTTGTATTCTGCA-3' (SEQ ID NO: 2745)

5'-GCUGUUUCUACAUCAUUUGUAUUCU$^A$$^{A-3'}$ (SEQ ID NO: 6073)
3'-CGACAAAGAUGUAGUAAACAUAAGA$_C$$_{G-5'}$ (SEQ ID NO: 1637)

βc-900 Target: 5'-GCTGTTTCTACATCATTTGTATTCTGC-3' (SEQ ID NO: 2746)

5'-GUACAACGAGCUGUUUCUACAUCAU$^C$$^{C-3'}$ (SEQ ID NO: 6074)
3'-CAUGUUGCUCGACAAAGAUGUAGUA$_A$$_{A-5'}$ (SEQ ID NO: 1638)

βc-909 Target: 5'-GTACAACGAGCTGTTTCTACATCATTT-3' (SEQ ID NO: 2747)

5'-CGGUACAACGAGCUGUUUCUACAUC$^C$$^{C-3'}$ (SEQ ID NO: 6075)
3'-GCCAUGUUGCUCGACAAAGAUGUAG$_U$$_{A-5'}$ (SEQ ID NO: 1639)

βc-911 Target: 5'-CGGTACAACGAGCTGTTTCTACATC-3' (SEQ ID NO: 2748)

5'-GCGGUACAACGAGCUGUUUCUACAU$^A$$^{C-3'}$ (SEQ ID NO: 6076)
3'-CGCCAUGUUGCUCGACAAAGAUGUA$_G$$_{U-5'}$ (SEQ ID NO: 1640)

βc-912 Target: 5'-GCGGTACAACGAGCTGTTTCTACATCA-3' (SEQ ID NO: 2749)

TABLE 12-continued

Additional Selected Anti-β-catenin DsiRNAs, Blunt/Frayed Duplexes

5'-GCAUAAAACAACACAGAAUCCACUG$^{A}$$^{C-3'}$ (SEQ ID NO: 6077)
3'-CGUAUUUUGUUGUGUCUUAGGUGAC$_{CA-5'}$ (SEQ ID NO: 1641)

βc-1032 Target: 5'-GCATAAAACAACACAGAATCCACTGGT-3' (SEQ ID NO: 2750)

5'-UGGCAUAAAACAACACAGAAUCCAC$^{CA-3'}$ (SEQ ID NO: 6078)
3'-ACCGUAUUUUGUUGUGUCUUAGGUG$_{AC-5'}$ (SEQ ID NO: 1642)

βc-1034 Target: 5'-TGGCATAAAACAACACAGAATCCACTG-3' (SEQ ID NO: 2751)

5'-AUGGCAUAAAACAACACAGAAUCCA$^{AC-3'}$ (SEQ ID NO: 6079)
3'-UACCGUAUUUUGUUGUGUCUUAGGU$_{GA-5'}$ (SEQ ID NO: 1643)

βc-1035 Target: 5'-ATGGCATAAAACAACACAGAATCCACT-3' (SEQ ID NO: 2752)

5'-UAGCUCCUUCUUGAUGUAAUAAAAG$^{AC-3'}$ (SEQ ID NO: 6080)
3'-AUCGAGGAAGAACUACAUUAUUUUC$_{CA-5'}$ (SEQ ID NO: 1644)

βc-1076 Target: 5'-TAGCTCCTTCTTGATGTAATAAAAGGT-3' (SEQ ID NO: 2753)

5'-UUAGCUCCUUCUUGAUGUAAUAAAA$^{AA-3'}$ (SEQ ID NO: 6081)
3'-AAUCGAGGAAGAACUACAUUAUUUU$_{CC-5'}$ (SEQ ID NO: 1645)

βc-1077 Target: 5'-TTAGCTCCTTCTTGATGTAATAAAAGG-3' (SEQ ID NO: 2754)

5'-UUUAACAUUUGUUUUGUUGAGCAAG$^{AA-3'}$ (SEQ ID NO: 6082)
3'-AAAUUGUAAACAAAACAACUCGUUC$_{CG-5'}$ (SEQ ID NO: 1646)

βc-1144 Target: 5'-TTTAACATTTGTTTTGTTGAGCAAGGC-3' (SEQ ID NO: 2755)

5'-UAGCCAAGAAUUUAACAUUUGUUUU$^{AC-3'}$ (SEQ ID NO: 6083)
3'-AUCGGUUCUUAAAUUGUAAACAAAA$_{CA-5'}$ (SEQ ID NO: 1647)

βc-1154 Target: 5'-TAGCCAAGAATTTAACATTTGTTTTGT-3' (SEQ ID NO: 2756)

5'-CGUAAUAGCCAAGAAUUUAACAUUU$^{AC-3'}$ (SEQ ID NO: 6084)
3'-GCAUUAUCGGUUCUUAAAUUGUAAA$_{CA-5'}$ (SEQ ID NO: 1648)

βc-1159 Target: 5'-CGTAATAGCCAAGAATTTAACATTTGT-3' (SEQ ID NO: 2757)

5'-UCGUAAUAGCCAAGAAUUUAACAUU$^{CA-3'}$ (SEQ ID NO: 6085)
3'-AGCAUUAUCGGUUCUUAAAUUGUAA$_{AC-5'}$ (SEQ ID NO: 1649)

βc-1160 Target: 5'-TCGTAATAGCCAAGAATTTAACATTTG-3' (SEQ ID NO: 2758)

5'-UAAGCUAAAAUUUGAAGGCAGUCUG$^{CA-3'}$ (SEQ ID NO: 6086)
3'-AUUCGAUUUUAAACUUCCGUCAGAC$_{AG-5'}$ (SEQ ID NO: 1650)

βc-1185 Target: 5'-TAAGCTAAAATTTGAAGGCAGTCTGTC-3' (SEQ ID NO: 2759)

5'-UAGGUCCUCAUUAUAUUUACUAAAG$^{AC-3'}$ (SEQ ID NO: 6087)
3'-AUCCAGGAGUAAUAUAAAUGAUUUC$_{GA-5'}$ (SEQ ID NO: 1651)

βc-1260 Target: 5'-TAGGTCCTCATTATATTTACTAAAGCT-3' (SEQ ID NO: 2760)

5'-AAGUAUAGGUCCUCAUUAUAUUUAC$^{CC-3'}$ (SEQ ID NO: 6088)
3'-UUCAUAUCCAGGAGUAAUAUAAAUG$_{AU-5'}$ (SEQ ID NO: 1652)

βc-1265 Target: 5'-AAGTATAGGTCCTCATTATATTTACTA-3' (SEQ ID NO: 2761)

TABLE 12-continued

Additional Selected Anti-β-catenin DsiRNAs, Blunt/Frayed Duplexes

5'-UAAGUAUAGGUCCUCAUUAUAUUUA$^{A}$$^{C-3'}$ (SEQ ID NO: 6089)
3'-AUUCAUAUCCAGGAGUAAUAUAAAU$_{GA-5'}$ (SEQ ID NO: 1653)

βc-1266 Target: 5'-TAAGTATAGGTCCTCATTATATTTACT-3' (SEQ ID NO: 2762)

5'-GUUUUUCGUAAGUAUAGGUCCUCAU$^{C}$$^{C-3'}$ (SEQ ID NO: 6090)
3'-CAAAAAGCAUUCAUAUCCAGGAGUA$_{AU-5'}$ (SEQ ID NO: 1654)

βc-1274 Target: 5'-GTTTTTCGTAAGTATAGGTCCTCATTA-3' (SEQ ID NO: 2763)

5'-AGUUUUUCGUAAGUAUAGGUCCUCA$^{C}$$^{C-3'}$ (SEQ ID NO: 6091)
3'-UCAAAAAGCAUUCAUAUCCAGGAGU$_{AA-5'}$ (SEQ ID NO: 1655)

βc-1275 Target: 5'-AGTTTTTCGTAAGTATAGGTCCTCATT-3' (SEQ ID NO: 2764)

5'-UAGUUUUUCGUAAGUAUAGGUCCUC$^{C}$$^{C-3'}$ (SEQ ID NO: 6092)
3'-AUCAAAAAGCAUUCAUAUCCAGGAG$_{UA-5'}$ (SEQ ID NO: 1656)

βc-1276 Target: 5'-TAGTTTTTCGTAAGTATAGGTCCTC-3' (SEQ ID NO: 2765)

5'-GUAGUUUUUCGUAAGUAUAGGUCCU$^{A}$$^{C-3'}$ (SEQ ID NO: 6093)
3'-CAUCAAAAAGCAUUCAUAUCCAGGA$_{GU-5'}$ (SEQ ID NO: 1657)

βc-1277 Target: 5'-GTAGTTTTTCGTAAGTATAGGTCCTCA-3' (SEQ ID NO: 2766)

5'-GUGGUCCACAGUAGUUUUUCGUAAG$^{C}$$^{C-3'}$ (SEQ ID NO: 6094)
3'-CACCAGGUGUCAUCAAAAAGCAUUC$_{AU-5'}$ (SEQ ID NO: 1658)

βc-1287 Target: 5'-GTGGTCCACAGTAGTTTTTCGTAAGTA-3' (SEQ ID NO: 2767)

5'-UCUACAAUAGCCGGCUUAUUACUAG$^{C}$$^{A-3'}$ (SEQ ID NO: 6095)
3'-AGAUGUUAUCGGCCGAAUAAUGAUC$_{UC-5'}$ (SEQ ID NO: 1659)

βc-1344 Target: 5'-TCTACAATAGCCGGCTTATTACTAGAG-3' (SEQ ID NO: 2768)

5'-CUUCUACAAUAGCCGGCUUAUUACU$^{C}$$^{A-3'}$ (SEQ ID NO: 6096)
3'-GAAGAUGUUAUCGGCCGAAUAAUGA$_{UC-5'}$ (SEQ ID NO: 1660)

βc-1346 Target: 5'-CTTCTACAATAGCCGGCTTATTACTAG-3' (SEQ ID NO: 2769)

5'-AGUCCUAAAGCUUGCAUUCCACCAG$^{A}$$^{C-3'}$ (SEQ ID NO: 6097)
3'-UCAGGAUUUCGAACGUAAGGUGGUC$_{GA-5'}$ (SEQ ID NO: 1661)

βc-1371 Target: 5'-AGTCCTAAAGCTTGCATTCCACCAGCT-3' (SEQ ID NO: 2770)

5'-AAGUCCUAAAGCUUGCAUUCCACCA$^{A}$$^{A-3'}$ (SEQ ID NO: 6098)
3'-UUCAGGAUUUCGAACGUAAGGUGGU$_{CG-5'}$ (SEQ ID NO: 1662)

βc-1372 Target: 5'-AAGTCCTAAAGCTTGCATTCCACCAGC-3' (SEQ ID NO: 2771)

5'-GAAGUCCUAAAGCUUGCAUUCCACC$^{C}$$^{A-3'}$ (SEQ ID NO: 6099)
3'-CUUCAGGAUUUCGAACGUAAGGUGG$_{UC-5'}$ (SEQ ID NO: 1663)

βc-1373 Target: 5'-GAAGTCCTAAAGCTTGCATTCCACCAG-3' (SEQ ID NO: 2772)

5'-CAGUUCUGAACAAGACGUUGACUUG$^{A}$$^{C-3'}$ (SEQ ID NO: 6100)
3'-GUCAAGACUUGUUCUGCAACUGAAC$_{CU-5'}$ (SEQ ID NO: 1664)

βc-1410 Target: 5'-CAGTTCTGAACAAGACGTTGACTTGGA-3' (SEQ ID NO: 2773)

TABLE 12-continued

Additional Selected Anti-β-catenin DsiRNAs, Blunt/Frayed Duplexes

5'-ACAGUUCUGAACAAGACGUUGACUU$^{AA-3'}$ (SEQ ID NO: 6101)
3'-UGUCAAGACUUGUUCUGCAACUGAA$_{C-5'}$ (SEQ ID NO: 1665)

βc-1411 Target: 5'-ACAGTTCTGAACAAGACGTTGACTTGG-3' (SEQ ID NO: 2774)

5'-GAGUCCAAAGACAGUUCUGAACAAG$^{CA-3'}$ (SEQ ID NO: 6102)
3'-CUCAGGUUUCUGUCAAGACUUGUUC$_{UG-5'}$ (SEQ ID NO: 1666)

βc-1421 Target: 5'-GAGTCCAAAGACAGTTCTGAACAAGAC-3' (SEQ ID NO: 2775)

5'-CCUUCCUGUUUAGUUGCAGCAUCUG$^{CC-3'}$ (SEQ ID NO: 6103)
3'-GGAAGGACAAAUCAACGUCGUAGAC$_{UU-5'}$ (SEQ ID NO: 1667)

βc-1458 Target: 5'-CCTTCCTGTTTAGTTGCAGCATCTGAA-3' (SEQ ID NO: 2776)

5'-CCACAUUUAUAUCAUCUGAACCCAG$^{CC-3'}$ (SEQ ID NO: 6104)
3'-GGUGUAAAUAUAGUAGACUUGGGUC$_{UU-5'}$ (SEQ ID NO: 1668)

βc-1517 Target: 5'-CCACATTTATATCATCTGAACCCAGAA-3' (SEQ ID NO: 2777)

5'-UGACCACAUUUAUAUCAUCUGAACC$^{AC-3'}$ (SEQ ID NO: 6105)
3'-ACUGGUGUAAAUAUAGUAGACUUGG$_{GU-5'}$ (SEQ ID NO: 1669)

βc-1520 Target: 5'-TGACCACATTTATATCATCTGAACCCA-3' (SEQ ID NO: 2778)

5'-CUGCACAGGUGACCACAUUUAUAUC$^{CC-3'}$ (SEQ ID NO: 6106)
3'-GACGUGUCCACUGGUGUAAAUAUAG$_{UA-5'}$ (SEQ ID NO: 1670)

βc-1529 Target: 5'-CTGCACAGGTGACCACATTTATATC-3' (SEQ ID NO: 2779)

5'-GCUGCACAGGUGACCACAUUUAUAU$^{AC-3'}$ (SEQ ID NO: 6107)
3'-CGACGUGUCCACUGGUGUAAAUAUA$_{GU-5'}$ (SEQ ID NO: 1671)

βc-1530 Target: 5'-GCTGCACAGGTGACCACATTTATATCA-3' (SEQ ID NO: 2780)

5'-AUUGCAAGUGAGGUUAGAAAGAAUU$^{AA-3'}$ (SEQ ID NO: 6108)
3'-UAACGUUCACUCCAAUCUUUCUUAA$_{G-5'}$ (SEQ ID NO: 1672)

βc-1558 Target: 5'-ATTGCAAGTGAGGTTAGAAAGAATTCC-3' (SEQ ID NO: 2781)

5'-UUAUAAUUAUUGCAAGUGAGGUUAG$^{CC-3'}$ (SEQ ID NO: 6109)
3'-AAUAUUAAUAACGUUCACUCCAAUC$_{UU-5'}$ (SEQ ID NO: 1673)

βc-1566 Target: 5'-TTATAATTATTGCAAGTGAGGTTAGAA-3' (SEQ ID NO: 2782)

5'-CAUCAUCUUGUUCUUAUAAUUAUUG$^{AC-3'}$ (SEQ ID NO: 6110)
3'-GUAGUAGAACAAGAAUAUUAAUAAC$_{GU-5'}$ (SEQ ID NO: 1674)

βc-1579 Target: 5'-CATCATCTTGTTCTTATAATTATTGCA-3' (SEQ ID NO: 2783)

5'-CCAUCAUCUUGUUCUUAUAAUUAUU$^{AA-3'}$ (SEQ ID NO: 6111)
3'-GGUAGUAGAACAAGAAUAUUAAUAA$_{CG-5'}$ (SEQ ID NO: 1675)

βc-1580 Target: 5'-CCATCATCTTGTTCTTATAATTATTGC-3' (SEQ ID NO: 2784)

5'-AGACCAUCAUCUUGUUCUUAUAAUU$^{CC-3'}$ (SEQ ID NO: 6112)
3'-UCUGGUAGUAGAACAAGAAUAUUAA$_{UA-5'}$ (SEQ ID NO: 1676)

βc-1583 Target: 5'-AGACCATCATCTTGTTCTTATAATTAT-3' (SEQ ID NO: 2785)

TABLE 12-continued

Additional Selected Anti-β-catenin DsiRNAs, Blunt/Frayed Duplexes

5'-GCAGACCAUCAUCUUGUUCUUAUAA$^{CC-3'}$  (SEQ ID NO: 6113)
3'-CGUCUGGUAGUAGAACAAGAAUAUU$_{A-5'}^{A}$  (SEQ ID NO: 1677)

βc-1585 Target: 5'-GCAGACCATCATCTTGTTCTTATAATT-3'  (SEQ ID NO: 2786)

5'-UCAAUCCAACAGUAGCCUUUAUCAG$^{CA-3'}$  (SEQ ID NO: 6114)
3'-AGUUAGGUUGUCAUCGGAAAUAGUC$_{C-5'}^{U}$  (SEQ ID NO: 1678)

βc-1808 Target: 5'-TCAATCCAACAGTAGCCTTTATCAGAG-3'  (SEQ ID NO: 2787)

5'-UCGAAUCAAUCCAACAGUAGCCUUU$^{CC-3'}$  (SEQ ID NO: 6115)
3'-AGCUUAGUUAGGUUGUCAUCGGAAA$_{A-5'}^{U}$  (SEQ ID NO: 1679)

βc-1813 Target: 5'-TCGAATCAATCCAACAGTAGCCTTTAT-3'  (SEQ ID NO: 2788)

5'-CCUCCACAAAUUGCUGCUGUGUCCC$^{CA-3'}$  (SEQ ID NO: 6116)
3'-GGAGGUGUUUAACGACGACACAGGG$_{G-5'}^{U}$  (SEQ ID NO: 1680)

βc-1955 Target: 5'-CCTCCACAAATTGCTGCTGTGTCCCAC-3'  (SEQ ID NO: 2789)

5'-GUACAACCUUCAACUAUUUCUUCCA$^{CA-3'}$  (SEQ ID NO: 6117)
3'-CAUGUUGGAAGUUGAUAAAGAAGGU$_{C-5'}^{A}$  (SEQ ID NO: 1681)

βc-1989 Target: 5'-GTACAACCTTCAACTATTTCTTCCATG-3'  (SEQ ID NO: 2790)

5'-GGUACAACCUUCAACUAUUUCUUCC$^{CC-3'}$  (SEQ ID NO: 6118)
3'-CCAUGUUGGAAGUUGAUAAAGAAGG$_{A-5'}^{U}$  (SEQ ID NO: 1682)

βc-1990 Target: 5'-GGTACAACCTTCAACTATTTCTTCC-3'  (SEQ ID NO: 2791)

5'-CGGUACAACCUUCAACUAUUUCUUC$^{AC-3'}$  (SEQ ID NO: 6119)
3'-GCCAUGUUGGAAGUUGAUAAAGAAG$_{U-5'}^{G}$  (SEQ ID NO: 1683)

βc-1991 Target: 5'-CGGTACAACCTTCAACTATTTCTTCCA-3'  (SEQ ID NO: 2792)

5'-CCGGUACAACCUUCAACUAUUUCUU$^{AA-3'}$  (SEQ ID NO: 6120)
3'-GGCCAUGUUGGAAGUUGAUAAAGAA$_{G-5'}^{G}$  (SEQ ID NO: 1684)

βc-1992 Target: 5'-CCGGTACAACCTTCAACTATTTCTTCC-3'  (SEQ ID NO: 2793)

5'-GGGCUCCGGUACAACCUUCAACUAU$^{CC-3'}$  (SEQ ID NO: 6121)
3'-CCCGAGGCCAUGUUGGAAGUUGAUA$_{A-5'}^{A}$  (SEQ ID NO: 1685)

βc-1997 Target: 5'-GGGCTCCGGTACAACCTTCAACTATTT-3'  (SEQ ID NO: 2794)

5'-UAACAAUUCGGUUGUGAACAUCCCG$^{CA-3'}$  (SEQ ID NO: 6122)
3'-AUUGUUAAGCCAACACUUGUAGGGC$_{C-5'}^{U}$  (SEQ ID NO: 1686)

βc-2036 Target: 5'-TAACAATTCGGTTGTGAACATCCCGAG-3'  (SEQ ID NO: 2795)

5'-AUAACAAUUCGGUUGUGAACAUCCC$^{AC-3'}$  (SEQ ID NO: 6123)
3'-UAUUGUUAAGCCAACACUUGUAGGG$_{U-5'}^{C}$  (SEQ ID NO: 1687)

βc-2037 Target: 5'-ATAACAATTCGGTTGTGAACATCCCGA-3'  (SEQ ID NO: 2796)

5'-GAUAACAAUUCGGUUGUGAACAUCC$^{AA-3'}$  (SEQ ID NO: 6124)
3'-CUAUUGUUAAGCCAACACUUGUAGG$_{C-5'}^{G}$  (SEQ ID NO: 1688)

βc-2038 Target: 5'-GATAACAATTCGGTTGTGAACATCCCG-3'  (SEQ ID NO: 2797)

TABLE 12-continued

Additional Selected Anti-β-catenin DsiRNAs, Blunt/Frayed Duplexes

5'-UGAUAACAAUUCGGUUGUGAACAUC$^{AA-3'}$ (SEQ ID NO: 6125)
3'-ACUAUUGUUAAGCCAACACUUGUAG$_{G-5'}$ (SEQ ID NO: 1689)

βc-2039 Target: 5'-TGATAACAATTCGGTTGTGAACATCCC-3' (SEQ ID NO: 2798)

5'-CUGAUAACAAUUCGGUUGUGAACAU$^{AA-3'}$ (SEQ ID NO: 6126)
3'-GACUAUUGUUAAGCCAACACUUGUA$_{G-5'}$ (SEQ ID NO: 1690)

βc-2040 Target: 5'-CTGATAACAATTCGGTTGTGAACATCC-3' (SEQ ID NO: 2799)

5'-UCUGAUAACAAUUCGGUUGUGAACA$^{CA-3'}$ (SEQ ID NO: 6127)
3'-AGACUAUUGUUAAGCCAACACUUGU$_{G-5'}$ (SEQ ID NO: 1691)

βc-2041 Target: 5'-TCTGATAACAATTCGGTTGTGAACATC-3' (SEQ ID NO: 2800)

5'-GUAUUUAGUCCUCUGAUAACAAUUC$^{AA-3'}$ (SEQ ID NO: 6128)
3'-CAUAAAUCAGGAGACUAUUGUUAAG$_{C-5'}$ (SEQ ID NO: 1692)

βc-2052 Target: 5'-GTATTTAGTCCTCTGATAACAATTCGG-3' (SEQ ID NO: 2801)

5'-GGUAUUUAGUCCUCUGAUAACAAUU$^{AA-3'}$ (SEQ ID NO: 6129)
3'-CCAUAAAUCAGGAGACUAUUGUUAA$_{C-5'}$ (SEQ ID NO: 1693)

βc-2053 Target: 5'-GGTATTTAGTCCTCTGATAACAATTCG-3' (SEQ ID NO: 2802)

5'-UGGUAUUUAGUCCUCUGAUAACAAU$^{CA-3'}$ (SEQ ID NO: 6130)
3'-ACCAUAAAUCAGGAGACUAUUGUUA$_{G-5'}$ (SEQ ID NO: 1694)

βc-2054 Target: 5'-TGGTATTTAGTCCTCTGATAACAATTC-3' (SEQ ID NO: 2803)

5'-AUGGUAUUUAGUCCUCUGAUAACAA$^{CC-3'}$ (SEQ ID NO: 6131)
3'-UACCAUAAAUCAGGAGACUAUUGUU$_{A-5'}$ (SEQ ID NO: 1695)

βc-2055 Target: 5'-ATGGTATTTAGTCCTCTGATAACAATT-3' (SEQ ID NO: 2804)

5'-AAACAAUGGAAUGGUAUUUAGUCCU$^{AC-3'}$ (SEQ ID NO: 6132)
3'-UUUGUUACCUUACCAUAAAUCAGGA$_{G-5'}$ (SEQ ID NO: 1696)

βc-2065 Target: 5'-AAACAATGGAATGGTATTTAGTCCTCT-3' (SEQ ID NO: 2805)

5'-GCACAAACAAUGGAAUGGUAUUUAG$^{CA-3'}$ (SEQ ID NO: 6133)
3'-CGUGUUUGUUACCUUACCAUAAAUC$_{G-5'}$ (SEQ ID NO: 1697)

βc-2069 Target: 5'-GCACAAACAATGGAATGGTATTTAGTC-3' (SEQ ID NO: 2806)

5'-CUGCACAAACAAUGGAAUGGUAUUU$^{CA-3'}$ (SEQ ID NO: 6134)
3'-GACGUGUUUGUUACCUUACCAUAAA$_{C-5'}$ (SEQ ID NO: 1698)

βc-2071 Target: 5'-CTGCACAAACAATGGAATGGTATTTAG-3' (SEQ ID NO: 2807)

5'-GCUGCACAAACAAUGGAAUGGUAUU$^{CC-3'}$ (SEQ ID NO: 6135)
3'-CGACGUGUUUGUUACCUUACCAUAA$_{U-5'}$ (SEQ ID NO: 1699)

βc-2072 Target: 5'-GCTGCACAAACAATGGAATGGTATTTA-3' (SEQ ID NO: 2808)

5'-CAGCUACUCUUUGGAUGUUUUCAAU$^{AA-3'}$ (SEQ ID NO: 6136)
3'-GUCGAUGAGAAACCUACAAAAGUUA$_{C-5'}$ (SEQ ID NO: 1700)

βc-2111 Target: 5'-CAGCTACTCTTTGGATGTTTTCAATGG-3' (SEQ ID NO: 2809)

TABLE 12-continued

Additional Selected Anti-β-catenin DsiRNAs, Blunt/Frayed Duplexes

5'-GCAGCUACUCUUUGGAUGUUUUCAA<sup>CA-3'</sup> (SEQ ID NO: 6137)
3'-CGUCGAUGAGAAACCUACAAAAGUU<sub>AC-5'</sub> (SEQ ID NO: 1701)

βc-2112 Target: 5'-GCAGCTACTCTTTGGATGTTTTCAATG-3' (SEQ ID NO: 2810)

5'-CAGCUUCAAUAGCUUCUGCAGCUUC<sup>AC-3'</sup> (SEQ ID NO: 6138)
3'-GUCGAAGUUAUCGAAGACGUCGAAG<sub>GA-5'</sub> (SEQ ID NO: 1702)

βc-2168 Target: 5'-CAGCTTCAATAGCTTCTGCAGCTTCCT-3' (SEQ ID NO: 2811)

5'-GCUCCCUCAGCUUCAAUAGCUUCUG<sup>AC-3'</sup> (SEQ ID NO: 6139)
3'-CGAGGGAGUCGAAGUUAUCGAAGAC<sub>GU-5'</sub> (SEQ ID NO: 1703)

βc-2175 Target: 5'-GCTCCCTCAGCTTCAATAGCTTCTGCA-3' (SEQ ID NO: 2812)

5'-UGGCUCCCUCAGCUUCAAUAGCUUC<sup>CA-3'</sup> (SEQ ID NO: 6140)
3'-ACCGAGGGAGUCGAAGUUAUCGAAG<sub>AC-5'</sub> (SEQ ID NO: 1704)

βc-2177 Target: 5'-TGGCTCCCTCAGCTTCAATAGCTTCTG-3' (SEQ ID NO: 2813)

5'-UCAUUCCUAGAGUGAAGUAACUCUG<sup>CA-3'</sup> (SEQ ID NO: 6141)
3'-AGUAAGGAUCUCACUUCAUUGAGAC<sub>AG-5'</sub> (SEQ ID NO: 1705)

βc-2214 Target: 5'-TCATTCCTAGAGTGAAGTAACTCTGTC-3' (SEQ ID NO: 2814)

5'-CUUCAUUCCUAGAGUGAAGUAACUC<sup>CA-3'</sup> (SEQ ID NO: 6142)
3'-GAAGUAAGGAUCUCACUUCAUUGAG<sub>AC-5'</sub> (SEQ ID NO: 1706)

βc-2216 Target: 5'-CTTCATTCCTAGAGTGAAGTAACTCTG-3' (SEQ ID NO: 2815)

5'-CCUUCAUUCCUAGAGUGAAGUAACU<sup>AC-3'</sup> (SEQ ID NO: 6143)
3'-GGAAGUAAGGAUCUCACUUCAUUGA<sub>GA-5'</sub> (SEQ ID NO: 1707)

βc-2217 Target: 5'-CCTTCATTCCTAGAGTGAAGTAACTCT-3' (SEQ ID NO: 2816)

5'-UGUCCUCAGACAUUCGGAACAAAAC<sup>CA-3'</sup> (SEQ ID NO: 6144)
3'-ACAGGAGUCUGUAAGCCUUGUUUUG<sub>UC-5'</sub> (SEQ ID NO: 1708)

βc-2264 Target: 5'-TGTCCTCAGACATTCGGAACAAAACAG-3' (SEQ ID NO: 2817)

5'-CUUGUCCUCAGACAUUCGGAACAAA<sup>CA-3'</sup> (SEQ ID NO: 6145)
3'-GAACAGGAGUCUGUAAGCCUUGUUU<sub>UG-5'</sub> (SEQ ID NO: 1709)

βc-2266 Target: 5'-CTTGTCCTCAGACATTCGGAACAAAC-3' (SEQ ID NO: 2818)

5'-CCGUUUCUUGUAAUCUUGUGGCUUG<sup>CA-3'</sup> (SEQ ID NO: 6146)
3'-GGCAAAGAACAUUAGAACACCGAAC<sub>AG-5'</sub> (SEQ ID NO: 1710)

βc-2287 Target: 5'-CCGTTTCTTGTAATCTTGTGGCTTGTC-3' (SEQ ID NO: 2819)

5'-ACUGAAAGCCGUUUCUUGUAAUCUU<sup>AC-3'</sup> (SEQ ID NO: 6147)
3'-UGACUUUCGGCAAAGAACAUUAGAA<sub>CA-5'</sub> (SEQ ID NO: 1711)

βc-2295 Target: 5'-ACTGAAAGCCGTTTCTTGTAATCTTGT-3' (SEQ ID NO: 2820)

5'-CAGCUCAACUGAAAGCCGUUUCUUG<sup>CC-3'</sup> (SEQ ID NO: 6148)
3'-GUCGAGUUGACUUUCGGCAAAGAAC<sub>AU-5'</sub> (SEQ ID NO: 1712)

βc-2302 Target: 5'-CAGCTCAACTGAAAGCCGTTTCTTGTA-3' (SEQ ID NO: 2821)

TABLE 12-continued

Additional Selected Anti-β-catenin DsiRNAs, Blunt/Frayed Duplexes

5'-CAAGUCCAAGAUCAGCAGUCUCAUU$^{AA\text{-}3'}$ (SEQ ID NO: 6149)
3'-GUUCAGGUUCUAGUCGUCAGAGUAA$_{G\text{-}5'}$ (SEQ ID NO: 1713)

βc-2363 Target: 5'-CAAGTCCAAGATCAGCAGTCTCATTCC-3' (SEQ ID NO: 2822)

5'-GCACCAAUAUCAAGUCCAAGAUCAG$^{AC\text{-}3'}$ (SEQ ID NO: 6150)
3'-CGUGGUUAUAGUUCAGGUUCUAGUC$_{GU\text{-}5'}$ (SEQ ID NO: 1714)

βc-2373 Target: 5'-GCACCAATATCAAGTCCAAGATCAGCA-3' (SEQ ID NO: 2823)

5'-AAAGAACGAUAGCUAGGAUCAUCCU$^{AA\text{-}3'}$ (SEQ ID NO: 6151)
3'-UUUCUUGCUAUCGAUCCUAGUAGGA$_{C\text{-}5'}$ (SEQ ID NO: 1715)

βc-2424 Target: 5'-AAAGAACGATAGCTAGGATCATCCTGG-3' (SEQ ID NO: 2824)

5'-CAUAUCCACCAGAGUGAAAAGAACG$^{CC\text{-}3'}$ (SEQ ID NO: 6152)
3'-GUAUAGGUGGUCUCACUUUUCUUGC$_{UA\text{-}5'}$ (SEQ ID NO: 1716)

βc-2441 Target: 5'-CATATCCACCAGAGTGAAAAGAACGAT-3' (SEQ ID NO: 2825)

5'-UGAUUUACAGGUCAGUAUCAAACCA$^{AA\text{-}3'}$ (SEQ ID NO: 6153)
3'-ACUAAAUGUCCAGUCAUAGUUUGGU$_{C\text{-}5'}$ (SEQ ID NO: 1717)

βc-2618 Target: 5'-TGATTTACAGGTCAGTATCAAACCAGG-3' (SEQ ID NO: 2826)

5'-AUGAUUUACAGGUCAGUAUCAAACC$^{CA\text{-}3'}$ (SEQ ID NO: 6154)
3'-UACUAAAUGUCCAGUCAUAGUUUGG$_{UC\text{-}5'}$ (SEQ ID NO: 1718)

βc-2619 Target: 5'-ATGATTTACAGGTCAGTATCAAACCAG-3' (SEQ ID NO: 2827)

5'-GAUGAUUUACAGGUCAGUAUCAAAC$^{AC\text{-}3'}$ (SEQ ID NO: 6155)
3'-CUACUAAAUGUCCAGUCAUAGUUUG$_{GU\text{-}5'}$ (SEQ ID NO: 1719)

βc-2620 Target: 5'-GATGATTTACAGGTCAGTATCAAACCA-3' (SEQ ID NO: 2828)

5'-CUUCUUACCUAAAGGAUGAUUUACA$^{AA\text{-}3'}$ (SEQ ID NO: 6156)
3'-GAAGAAUGGAUUUCCUACUAAAUGU$_{C\text{-}5'}$ (SEQ ID NO: 1720)

βc-2634 Target: 5'-CTTCTTACCTAAAGGATGATTTACAGG-3' (SEQ ID NO: 2829)

5'-ACUUCUUACCUAAAGGAUGAUUUAC$^{CA\text{-}3'}$ (SEQ ID NO: 6157)
3'-UGAAGAAUGGAUUUCCUACUAAAUG$_{UC\text{-}5'}$ (SEQ ID NO: 1721)

βc-2635 Target: 5'-ACTTCTTACCTAAAGGATGATTTACAG-3' (SEQ ID NO: 2830)

5'-AAACUUCUUACCUAAAGGAUGAUUU$^{CA\text{-}3'}$ (SEQ ID NO: 6158)
3'-UUUGAAGAAUGGAUUUCCUACUAAA$_{UG\text{-}5'}$ (SEQ ID NO: 1722)

βc-2637 Target: 5'-AAACTTCTTACCTAAAGGATGATTTAC-3' (SEQ ID NO: 2831)

5'-GCUUUUUAAAACUUCUUACCUAAAG$^{AC\text{-}3'}$ (SEQ ID NO: 6159)
3'-CGAAAAAUUUUGAAGAAUGGAUUUC$_{U\text{-}5'}$ (SEQ ID NO: 1723)

βc-2645 Target: 5'-GCTTTTTAAAACTTCTTACCTAAGGA-3' (SEQ ID NO: 2832)

5'-UGGCUUUUUAAAACUUCUUACCUAA$^{CA\text{-}3'}$ (SEQ ID NO: 6160)
3'-ACCGAAAAAUUUUGAAGAAUGGAUU$_{UC\text{-}5'}$ (SEQ ID NO: 1724)

βc-2647 Target: 5'-TGGCTTTTTAAAACTTCTTACCTAAAG-3' (SEQ ID NO: 2833)

TABLE 12-continued

Additional Selected Anti-β-catenin DsiRNAs, Blunt/Frayed Duplexes

5'-CCAAACUGGCUUUUUAAAACUUCUU<sup>CA-3'</sup> (SEQ ID NO: 6161)
3'-GGUUUGACCGAAAAAUUUUGAAGAA<sub>UG-5'</sub> (SEQ ID NO: 1725)

βc-2653 Target: 5'-CCAAACTGGCTTTTTAAAACTTCTTAC-3' (SEQ ID NO: 2834)

5'-UUACCCAAACUGGCUUUUUAAAACU<sup>CA-3'</sup> (SEQ ID NO: 6162)
3'-AAUGGGUUUGACCGAAAAAUUUUGA<sub>AG-5'</sub> (SEQ ID NO: 1726)

βc-2657 Target: 5'-TTACCCAAACTGGCTTTTTAAAACTTC-3' (SEQ ID NO: 2835)

5'-UUUACCCAAACUGGCUUUUUAAAAC<sup>CC-3'</sup> (SEQ ID NO: 6163)
3'-AAAUGGGUUUGACCGAAAAAUUUUG<sub>AA-5'</sub> (SEQ ID NO: 1727)

βc-2658 Target: 5'-TTTACCCAAACTGGCTTTTTAAAACTT-3' (SEQ ID NO: 2836)

5'-UUUUACCCAAACUGGCUUUUUAAAA<sup>AC-3'</sup> (SEQ ID NO: 6164)
3'-AAAAUGGGUUUGACCGAAAAAUUUU<sub>GA-5'</sub> (SEQ ID NO: 1728)

βc-2659 Target: 5'-TTTTACCCAAACTGGCTTTTTAAAACT-3' (SEQ ID NO: 2837)

5'-AUUUUACCCAAACUGGCUUUUUAAA<sup>CA-3'</sup> (SEQ ID NO: 6165)
3'-UAAAAUGGGUUUGACCGAAAAAUUU<sub>UG-5'</sub> (SEQ ID NO: 1729)

βc-2660 Target: 5'-ATTTTACCCAAACTGGCTTTTTAAAAC-3' (SEQ ID NO: 2838)

5'-CCAACCAAGUCUUUCUGAAGUUCUG<sup>CC-3'</sup> (SEQ ID NO: 6166)
3'-GGUUGGUUCAGAAAGACUUCAAGAC<sub>AU-5'</sub> (SEQ ID NO: 1730)

βc-2701 Target: 5'-CCAACCAAGTCTTTCTGAAGTTCTGTA-3' (SEQ ID NO: 2839)

5'-CCACCCUACCAACCAAGUCUUUCUG<sup>CC-3'</sup> (SEQ ID NO: 6167)
3'-GGUGGGAUGGUUGGUUCAGAAAGAC<sub>UU-5'</sub> (SEQ ID NO: 1731)

βc-2709 Target: 5'-CCACCCTACCAACCAAGTCTTTCTGAA-3' (SEQ ID NO: 2840)

5'-AUUUACAAAUAGCCUAAACCACUCC<sup>AC-3'</sup> (SEQ ID NO: 6168)
3'-UAAAUGUUUAUCGGAUUUGGUGAGG<sub>GU-5'</sub> (SEQ ID NO: 1732)

βc-2733 Target: 5'-ATTTACAAATAGCCTAAACCACTCCCA-3' (SEQ ID NO: 2841)

5'-GAUUUACAAAUAGCCUAAACCACUC<sup>AA-3'</sup> (SEQ ID NO: 6169)
3'-CUAAAUGUUUAUCGGAUUUGGUGAG<sub>GG-5'</sub> (SEQ ID NO: 1733)

βc-2734 Target: 5'-GATTTACAAATAGCCTAAACCACTCCC-3' (SEQ ID NO: 2842)

5'-AGAUUUACAAAUAGCCUAAACCACU<sup>AA-3'</sup> (SEQ ID NO: 6170)
3'-UCUAAAUGUUUAUCGGAUUUGGUGA<sub>GG-5'</sub> (SEQ ID NO: 1734)

βc-2735 Target: 5'-AGATTTACAAATAGCCTAAACCACTCC-3' (SEQ ID NO: 2843)

5'-CAGAUUUACAAAUAGCCUAAACCAC<sup>CA-3'</sup> (SEQ ID NO: 6171)
3'-GUCUAAAUGUUUAUCGGAUUUGGUG<sub>AG-5'</sub> (SEQ ID NO: 1735)

βc-2736 Target: 5'-CAGATTTACAAATAGCCTAAACCACTC-3' (SEQ ID NO: 2844)

5'-UGUUUUUGUGGCAGAUUUACAAAUA<sup>AA-3'</sup> (SEQ ID NO: 6172)
3'-ACAAAAACACCGUCUAAAUGUUUAU<sub>CG-5'</sub> (SEQ ID NO: 1736)

βc-2747 Target: 5'-TGTTTTTGTGGCAGATTTACAAATAGC-3' (SEQ ID NO: 2845)

TABLE 12-continued

Additional Selected Anti-β-catenin DsiRNAs, Blunt/Frayed Duplexes

5'-CUGUUUUUGUGGCAGAUUUACAAAU<sup>CA-3'</sup> (SEQ ID NO: 6173)
3'-GACAAAAACACCGUCUAAAUGUUUA<sub>UC-5'</sub> (SEQ ID NO: 1737)

βc-2748 Target: 5'-CTGTTTTTGTGGCAGATTTACAAATAG-3' (SEQ ID NO: 2846)

5'-CCUGUUUUUGUGGCAGAUUUACAAA<sup>CC-3'</sup> (SEQ ID NO: 6174)
3'-GGACAAAAACACCGUCUAAAUGUUU<sub>AU-5'</sub> (SEQ ID NO: 1738)

βc-2749 Target: 5'-CCTGTTTTTGTGGCAGATTTACAAATA-3' (SEQ ID NO: 2847)

5'-AUAUACCUGUUUUUGUGGCAGAUUU<sup>CA-3'</sup> (SEQ ID NO: 6175)
3'-UAUAUGGACAAAAACACCGUCUAAA<sub>UG-5'</sub> (SEQ ID NO: 1739)

βc-2754 Target: 5'-ATATACCTGTTTTTGTGGCAGATTTAC-3' (SEQ ID NO: 2848)

5'-CUUUCAAAGUAUAUACCUGUUUUUG<sup>CA-3'</sup> (SEQ ID NO: 6176)
3'-GAAAGUUUCAUAUAUGGACAAAAAC<sub>AC-5'</sub> (SEQ ID NO: 1740)

βc-2764 Target: 5'-CTTTCAAAGTATATACCTGTTTTTGTG-3' (SEQ ID NO: 2849)

5'-CAUCUCCUUUCAAAGUAUAUACCUG<sup>CC-3'</sup> (SEQ ID NO: 6177)
3'-GUAGAGGAAAGUUUCAUAUAUGGAC<sub>AA-5'</sub> (SEQ ID NO: 1741)

βc-2770 Target: 5'-CATCTCCTTTCAAAGTATATACCTGTT-3' (SEQ ID NO: 2850)

5'-ACAUCUCCUUUCAAAGUAUAUACCU<sup>AC-3'</sup> (SEQ ID NO: 6178)
3'-UGUAGAGGAAAGUUUCAUAUAUGGA<sub>CA-5'</sub> (SEQ ID NO: 1742)

βc-2771 Target: 5'-ACATCTCCTTTCAAAGTATATACCTGT-3' (SEQ ID NO: 2851)

5'-AGACAUCUCCUUUCAAAGUAUAUAC<sup>AC-3'</sup> (SEQ ID NO: 6179)
3'-UCUGUAGAGGAAAGUUUCAUAUAUG<sub>GA-5'</sub> (SEQ ID NO: 1743)

βc-2773 Target: 5'-AGACATCTCCTTTCAAAGTATATACCT-3' (SEQ ID NO: 2852)

5'-AAGACAUCUCCUUUCAAAGUAUAUA<sup>AA-3'</sup> (SEQ ID NO: 6180)
3'-UUCUGUAGAGGAAAGUUUCAUAUAU<sub>GG-5'</sub> (SEQ ID NO: 1744)

βc-2774 Target: 5'-AAGACATCTCCTTTCAAAGTATATACC-3' (SEQ ID NO: 2853)

5'-CAAGACAUCUCCUUUCAAAGUAUAU<sup>CA-3'</sup> (SEQ ID NO: 6181)
3'-GUUCUGUAGAGGAAAGUUUCAUAUA<sub>UG-5'</sub> (SEQ ID NO: 1745)

βc-2775 Target: 5'-CAAGACATCTCCTTTCAAAGTATATAC-3' (SEQ ID NO: 2854)

5'-UGUUCCAAGACAUCUCCUUUCAAAG<sup>CC-3'</sup> (SEQ ID NO: 6182)
3'-ACAAGGUUCUGUAGAGGAAAGUUUC<sub>AU-5'</sub> (SEQ ID NO: 1746)

βc-2780 Target: 5'-TGTTCCAAGACATCTCCTTTCAAAGTA-3' (SEQ ID NO: 2855)

5'-CAUUCCAAUGUUCCAAGACAUCUCC<sup>CC-3'</sup> (SEQ ID NO: 6183)
3'-GUAAGGUUACAAGGUUCUGUAGAGG<sub>AA-5'</sub> (SEQ ID NO: 1747)

βc-2788 Target: 5'-CATTCCAATGTTCCAAGACATCTCCTT-3' (SEQ ID NO: 2856)

5'-ACAUUCCAAUGUUCCAAGACAUCUC<sup>AC-3'</sup> (SEQ ID NO: 6184)
3'-UGUAAGGUUACAAGGUUCUGUAGAG<sub>GA-5'</sub> (SEQ ID NO: 1748)

βc-2789 Target: 5'-ACATTCCAATGTTCCAAGACATCTCCT-3' (SEQ ID NO: 2857)

TABLE 12-continued

Additional Selected Anti-β-catenin DsiRNAs, Blunt/Frayed Duplexes

5'-GAACAUUCCAAUGUUCCAAGACAUC$^{CA-3'}$   (SEQ ID NO: 6185)
3'-CUUGUAAGGUUACAAGGUUCUGUAG$_{AG-5'}$   (SEQ ID NO: 1749)

βc-2791 Target: 5'-GAACATTCCAATGTTCCAAGACATCTC-3'   (SEQ ID NO: 2858)

5'-CCAGAAAUCUGAGAACAUUCCAAUG$^{CC-3'}$   (SEQ ID NO: 6186)
3'-GGUCUUUAGACUCUUGUAAGGUUAC$_{AA-5'}$   (SEQ ID NO: 1750)

βc-2803 Target: 5'-CCAGAAATCTGAGAACATTCCAATGTT-3'   (SEQ ID NO: 2859)

5'-ACAACCAGAAAUCUGAGAACAUUCC$^{CC-3'}$   (SEQ ID NO: 6187)
3'-UGUUGGUCUUUAGACUCUUGUAAGG$_{UU-5'}$   (SEQ ID NO: 1751)

βc-2807 Target: 5'-ACAACCAGAAATCTGAGAACATTCCAA-3'   (SEQ ID NO: 2860)

5'-UAACAACCAGAAAUCUGAGAACAUU$^{AA-3'}$   (SEQ ID NO: 6188)
3'-AUUGUUGGUCUUUAGACUCUUGUAA$_{AG-5'}$   (SEQ ID NO: 1752)

βc-2809 Target: 5'-TAACAACCAGAAATCTGAGAACATTCC-3'   (SEQ ID NO: 2861)

5'-AUAACAACCAGAAAUCUGAGAACAU$^{CA-3'}$   (SEQ ID NO: 6189)
3'-UAUUGUUGGUCUUUAGACUCUUGUA$_{AG-5'}$   (SEQ ID NO: 1753)

βc-2810 Target: 5'-ATAACAACCAGAAATCTGAGAACATTC-3'   (SEQ ID NO: 2862)

5'-CAUAACAACCAGAAAUCUGAGAACA$^{CC-3'}$   (SEQ ID NO: 6190)
3'-GUAUUGUUGGUCUUUAGACUCUUGU$_{AA-5'}$   (SEQ ID NO: 1754)

βc-2811 Target: 5'-CATAACAACCAGAAATCTGAGAACATT-3'   (SEQ ID NO: 2863)

5'-UGAUCACAUAACAACCAGAAAUCUG$^{CA-3'}$   (SEQ ID NO: 6191)
3'-ACUAGUGUAUUGUUGGUCUUUAGAC$_{UC-5'}$   (SEQ ID NO: 1755)

βc-2817 Target: 5'-TGATCACATAACAACCAGAAATCTGAG-3'   (SEQ ID NO: 2864)

5'-AUGAUCACAUAACAACCAGAAAUCU$^{AC-3'}$   (SEQ ID NO: 6192)
3'-UACUAGUGUAUUGUUGGUCUUUAGA$_{CU-5'}$   (SEQ ID NO: 1756)

βc-2818 Target: 5'-ATGATCACATAACAACCAGAAATCTGA-3'   (SEQ ID NO: 2865)

5'-CCACACAUGAUCACAUAACAACCAG$^{CC-3'}$   (SEQ ID NO: 6193)
3'-GGUGUGUACUAGUGUAUUGUUGGUC$_{UU-5'}$   (SEQ ID NO: 1757)

βc-2824 Target: 5'-CCACACATGATCACATAACAACCAGAA-3'   (SEQ ID NO: 2866)

5'-CUUCCACACAUGAUCACAUAACAAC$^{AC-3'}$   (SEQ ID NO: 6194)
3'-GAAGGUGUGUACUAGUGUAUUGUUG$_{GU-5'}$   (SEQ ID NO: 1758)

βc-2827 Target: 5'-CTTCCACACATGATCACATAACAACCA-3'   (SEQ ID NO: 2867)

5'-AAUAACUUCCACACAUGAUCACAUA$^{CA-3'}$   (SEQ ID NO: 6195)
3'-UUAUUGAAGGUGUGUACUAGUGUAU$_{UG-5'}$   (SEQ ID NO: 1759)

βc-2832 Target: 5'-AATAACTTCCACACATGATCACATAAC-3'   (SEQ ID NO: 2868)

5'-UAAUAACUUCCACACAUGAUCACAU$^{CC-3'}$   (SEQ ID NO: 6196)
3'-AUUAUUGAAGGUGUGUACUAGUGUA$_{UU-5'}$   (SEQ ID NO: 1760)

βc-2833 Target: 5'-TAATAACTTCCACACATGATCACATAA-3'   (SEQ ID NO: 2869)

TABLE 12-continued

Additional Selected Anti-β-catenin DsiRNAs, Blunt/Frayed Duplexes

5'-UUAAUAACUUCCACACAUGAUCACA$^{CC\text{-}3'}$ (SEQ ID NO: 6197)
3'-AAUUAUUGAAGGUGUGUACUAGUGU$_{AU\text{-}5'}$ (SEQ ID NO: 1761)

βc-2834 Target: 5'-TTAATAACTTCCACACATGATCACATA-3' (SEQ ID NO: 2870)

5'-GUUAAUAACUUCCACACAUGAUCAC$^{CC\text{-}3'}$ (SEQ ID NO: 6198)
3'-CAAUUAUUGAAGGUGUGUACUAGUG$_{AU\text{-}5'}$ (SEQ ID NO: 1762)

βc-2835 Target: 5'-GTTAATAACTTCCACACATGATCAC-3' (SEQ ID NO: 2871)

5'-CAUUAAAGUUAAUAACUUCCACACA$^{CA\text{-}3'}$ (SEQ ID NO: 6199)
3'-GUAAUUUCAAUUAUUGAAGGUGUGU$_{AC\text{-}5'}$ (SEQ ID NO: 1763)

βc-2842 Target: 5'-CATTAAAGTTAATAACTTCCACACATG-3' (SEQ ID NO: 2872)

5'-ACAUUAAAGUUAAUAACUUCCACAC$^{CC\text{-}3'}$ (SEQ ID NO: 6200)
3'-UGUAAUUUCAAUUAUUGAAGGUGUG$_{UA\text{-}5'}$ (SEQ ID NO: 1764)

βc-2843 Target: 5'-ACATTAAAGTTAATAACTTCCACAC-3' (SEQ ID NO: 2873)

5'-AAACAUUAAAGUUAAUAACUUCCAC$^{CA\text{-}3'}$ (SEQ ID NO: 6201)
3'-UUUGUAAUUUCAAUUAUUGAAGGUG$_{UG\text{-}5'}$ (SEQ ID NO: 1765)

βc-2845 Target: 5'-AAACATTAAAGTTAATAACTTCCACAC-3' (SEQ ID NO: 2874)

5'-AAAACAUUAAAGUUAAUAACUUCCA$^{AC\text{-}3'}$ (SEQ ID NO: 6202)
3'-UUUUGUAAUUUCAAUUAUUGAAGGU$_{GU\text{-}5'}$ (SEQ ID NO: 1766)

βc-2846 Target: 5'-AAACATTAAAGTTAATAACTTCCACA-3' (SEQ ID NO: 2875)

5'-AAAAACAUUAAAGUUAAUAACUUCC$^{CA\text{-}3'}$ (SEQ ID NO: 6203)
3'-UUUUUGUAAUUUCAAUUAUUGAAGG$_{UG\text{-}5'}$ (SEQ ID NO: 1767)

βc-2847 Target: 5'-AAAACATTAAAGTTAATAACTTCCAC-3' (SEQ ID NO: 2876)

5'-AAAAAACAUUAAAGUUAAUAACUUC$^{AC\text{-}3'}$ (SEQ ID NO: 6204)
3'-UUUUUUGUAAUUUCAAUUAUUGAAG$_{GU\text{-}5'}$ (SEQ ID NO: 1768)

βc-2848 Target: 5'-AAAAACATTAAAGTTAATAACTTCCA-3' (SEQ ID NO: 2877)

5'-CAAAAAACAUUAAAGUUAAUAACUU$^{AA\text{-}3'}$ (SEQ ID NO: 6205)
3'-GUUUUUUGUAAUUUCAAUUAUUGAA$_{GG\text{-}5'}$ (SEQ ID NO: 1769)

βc-2849 Target: 5'-CAAAAACATTAAAGTTAATAACTTCC-3' (SEQ ID NO: 2878)

5'-GCAAAAAACAUUAAAGUUAAUAACU$^{CA\text{-}3'}$ (SEQ ID NO: 6206)
3'-CGUUUUUUGUAAUUUCAAUUAUUGA$_{AG\text{-}5'}$ (SEQ ID NO: 1770)

βc-2850 Target: 5'-GCAAAAACATTAAAGTTAATAACTTC-3' (SEQ ID NO: 2879)

5'-UGGCAAAAAACAUUAAAGUUAAUAA$^{AC\text{-}3'}$ (SEQ ID NO: 6207)
3'-ACCGUUUUUUGUAAUUUCAAUUAUU$_{GA\text{-}5'}$ (SEQ ID NO: 1771)

βc-2852 Target: 5'-TGGCAAAAACATTAAAGTTAATAACT-3' (SEQ ID NO: 2880)

5'-GUGGCAAAAAACAUUAAAGUUAAUA$^{CA\text{-}3'}$ (SEQ ID NO: 6208)
3'-CACCGUUUUUUGUAAUUUCAAUUAU$_{UG\text{-}5'}$ (SEQ ID NO: 1772)

βc-2853 Target: 5'-GTGGCAAAAACATTAAAGTTAATAAC-3' (SEQ ID NO: 2881)

TABLE 12-continued

Additional Selected Anti-β-catenin DsiRNAs, Blunt/Frayed Duplexes

5'-UUGCAAAAGCUGUGGCAAAAAACAU$^{CC-3'}$ (SEQ ID NO: 6209)
3'-AACGUUUUCGACACCGUUUUUUGUA$_{AU-5'}$ (SEQ ID NO: 1773)

βc-2864 Target: 5'-TTGCAAAAGCTGTGGCAAAAAACATTA-3' (SEQ ID NO: 2882)

5'-GUUGCAAAAGCUGUGGCAAAAAACA$^{CC-3'}$ (SEQ ID NO: 6210)
3'-CAACGUUUUCGACACCGUUUUUUGU$_{AA-5'}$ (SEQ ID NO: 1774)

βc-2865 Target: 5'-GTTGCAAAAGCTGTGGCAAAAAACATT-3' (SEQ ID NO: 2883)

5'-ACUCAUUUGAGUAUUAAGUUGCAAA$^{CA-3'}$ (SEQ ID NO: 6211)
3'-UGAGUAAACUCAUAAUUCAACGUUU$_{UC-5'}$ (SEQ ID NO: 1775)

βc-2882 Target: 5'-ACTCATTTGAGTATTAAGTTGCAAAG-3' (SEQ ID NO: 2884)

5'-UUAAAACAGCAAAUGUUACUCAUUU$^{AC-3'}$ (SEQ ID NO: 6212)
3'-AAUUUUGUCGUUUACAAUGAGUAAA$_{CU-5'}$ (SEQ ID NO: 1776)

βc-2899 Target: 5'-TTAAAACAGCAAATGTTACTCATTTGA-3' (SEQ ID NO: 2885)

5'-UUUAAAACAGCAAAUGUUACUCAUU$^{CA-3'}$ (SEQ ID NO: 6213)
3'-AAAUUUUGUCGUUUACAAUGAGUAA$_{AC-5'}$ (SEQ ID NO: 1777)

βc-2900 Target: 5'-TTTAAAACAGCAAATGTTACTCATTTG-3' (SEQ ID NO: 2886)

5'-GUUUAAAACAGCAAAUGUUACUCAU$^{CC-3'}$ (SEQ ID NO: 6214)
3'-CAAAUUUUGUCGUUUACAAUGAGUA$_{AA-5'}$ (SEQ ID NO: 1778)

βc-2901 Target: 5'-GTTTAAAACAGCAAATGTTACTCATTT-3' (SEQ ID NO: 2887)

5'-UGUUUAAAACAGCAAAUGUUACUCA$^{CC-3'}$ (SEQ ID NO: 6215)
3'-ACAAAUUUUGUCGUUUACAAUGAGU$_{AA-5'}$ (SEQ ID NO: 1779)

βc-2902 Target: 5'-TGTTTAAAACAGCAAATGTTACTCATT-3' (SEQ ID NO: 2888)

5'-AUGUUUAAAACAGCAAAUGUUACUC$^{CC-3'}$ (SEQ ID NO: 6216)
3'-UACAAAUUUUGUCGUUUACAAUGAG$_{UA-5'}$ (SEQ ID NO: 1780)

βc-2903 Target: 5'-ATGTTTAAAACAGCAAATGTTACTC-3' (SEQ ID NO: 2889)

5'-AAUGUUUAAAACAGCAAAUGUUACU$^{AC-3'}$ (SEQ ID NO: 6217)
3'-UUACAAAUUUUGUCGUUUACAAUGA$_{GU-5'}$ (SEQ ID NO: 1781)

βc-2904 Target: 5'-AATGTTTAAAACAGCAAATGTTACTCA-3' (SEQ ID NO: 2890)

5'-CUAUUAAUGUUUAAAACAGCAAAUG$^{CC-3'}$ (SEQ ID NO: 6218)
3'-GAUAAUUACAAAUUUUGUCGUUUAC$_{AA-5'}$ (SEQ ID NO: 1782)

βc-2909 Target: 5'-CTATTAATGTTTAAAACAGCAAATGTT-3' (SEQ ID NO: 2891)

5'-AGAGAAAGGCUGCUAUUAAUGUUUA$^{CC-3'}$ (SEQ ID NO: 6219)
3'-UCUCUUUCCGACGAUAAUUACAAAU$_{UU-5'}$ (SEQ ID NO: 1783)

βc-2921 Target: 5'-AGAGAAAGGCTGCTATTAATGTTTAAA-3' (SEQ ID NO: 2892)

5'-CAAGUUCAGACAAUACAGCUGUAUA$^{CC-3'}$ (SEQ ID NO: 6220)
3'-GUUCAAGUCUGUUAUGUCGACAUAU$_{UU-5'}$ (SEQ ID NO: 1784)

βc-2949 Target: 5'-CAAGTTCAGACAATACAGCTGTATAAA-3' (SEQ ID NO: 2893)

TABLE 12-continued

Additional Selected Anti-β-catenin DsiRNAs, Blunt/Frayed Duplexes

5'-UCACAAUGCAAGUUCAGACAAUACA$^{AA}$-3' (SEQ ID NO: 6221)
3'-AGUGUUACGUUCAAGUCUGUUAUGU$_{G}$-5' (SEQ ID NO: 1785)

βc-2957 Target: 5'-TCACAATGCAAGTTCAGACAATACAGC-3' (SEQ ID NO: 2894)

5'-AAUCACAAUGCAAGUUCAGACAAUA$^{AC}$-3' (SEQ ID NO: 6222)
3'-UUAGUGUUACGUUCAAGUCUGUUAU$_{GU}$-5' (SEQ ID NO: 1786)

βc-2959 Target: 5'-AATCACAATGCAAGTTCAGACAATACA-3' (SEQ ID NO: 2895)

5'-CCAAUCACAAUGCAAGUUCAGACAA$^{CC}$-3' (SEQ ID NO: 6223)
3'-GGUUAGUGUUACGUUCAAGUCUGUU$_{AU}$-5' (SEQ ID NO: 1787)

βc-2961 Target: 5'-CCAATCACAATGCAAGTTCAGACAATA-3' (SEQ ID NO: 2896)

5'-CAGGCCAAUCACAAUGCAAGUUCAG$^{CA}$-3' (SEQ ID NO: 6224)
3'-GUCCGGUUAGUGUUACGUUCAAGUC$_{UG}$-5' (SEQ ID NO: 1788)

βc-2965 Target: 5'-CAGGCCAATCACAATGCAAGTTCAGAC-3' (SEQ ID NO: 2897)

5'-UUGUUCCCAUAGGAAACUCAGCUUG$^{AC}$-3' (SEQ ID NO: 6225)
3'-AACAAGGGUAUCCUUUGAGUCGAAC$_{CA}$-5' (SEQ ID NO: 1789)

βc-3052 Target: 5'-TTGTTCCCATAGGAAACTCAGCTTGGT-3' (SEQ ID NO: 2898)

5'-CUUCAAUUGUUCCCAUAGGAAACUC$^{CA}$-3' (SEQ ID NO: 6226)
3'-GAAGUUAACAAGGGUAUCCUUUGAG$_{UC}$-5' (SEQ ID NO: 1790)

βc-3058 Target: 5'-CTTCAATTGTTCCCATAGGAAACTCAG-3' (SEQ ID NO: 2899)

5'-ACUUCAAUUGUUCCCAUAGGAAACU$^{AC}$-3' (SEQ ID NO: 6227)
3'-UGAAGUUAACAAGGGUAUCCUUUGA$_{GU}$-5' (SEQ ID NO: 1791)

βc-3059 Target: 5'-ACTTCAATTGTTCCCATAGGAAACTCA-3' (SEQ ID NO: 2900)

5'-AAGUUUACUUCAAUUGUUCCCAUAG$^{AC}$-3' (SEQ ID NO: 6228)
3'-UUCAAAUGAAGUUAACAAGGGUAUC$_{CU}$-5' (SEQ ID NO: 1792)

βc-3065 Target: 5'-AAGTTTACTTCAATTGTTCCCATAGGA-3' (SEQ ID NO: 2901)

5'-AAAGUUUACUUCAAUUGUUCCCAUA$^{AA}$-3' (SEQ ID NO: 6229)
3'-UUUCAAAUGAAGUUAACAAGGGUAU$_{CC}$-5' (SEQ ID NO: 1793)

βc-3066 Target: 5'-AAAGTTTACTTCAATTGTTCCCATAGG-3' (SEQ ID NO: 2902)

5'-ACAAAAGUUUACUUCAAUUGUUCC$^{AC}$-3' (SEQ ID NO: 6230)
3'-UGUUUUCAAAUGAAGUUAACAAGG$_{GU}$-5' (SEQ ID NO: 1794)

βc-3070 Target: 5'-ACAAAAGTTTACTTCAATTGTTCCCA-3' (SEQ ID NO: 2903)

5'-CAGAACAAAAGUUUACUUCAAUUG$^{CC}$-3' (SEQ ID NO: 6231)
3'-GUCUUGUUUUCAAAUGAAGUUAAC$_{AA}$-5' (SEQ ID NO: 1795)

βc-3074 Target: 5'-CAGAACAAAAGTTTACTTCAATTGTT-3' (SEQ ID NO: 2904)

5'-AGGACCAGAACAAAAGUUUACUUC$^{CC}$-3' (SEQ ID NO: 6232)
3'-UCCUGGUCUUGUUUUCAAAUGAAG$_{U}$-5' (SEQ ID NO: 1796)

βc-3079 Target: 5'-AGGACCAGAACAAAAGTTTACTTCAA-3' (SEQ ID NO: 2905)

TABLE 12-continued

Additional Selected Anti-β-catenin DsiRNAs, Blunt/Frayed Duplexes

5'-AAGGACCAGAACAAAAAGUUUACUUA$^{AC-3'}$ (SEQ ID NO: 6233)
3'-UUCCUGGUCUUGUUUUUCAAAUGAA$_{GU-5'}$ (SEQ ID NO: 1797)

βc-3080 Target: 5'-AAGGACCAGAACAAAAAGTTTACTTCA-3' (SEQ ID NO: 2906)

5'-CGACCAAAAAGGACCAGAACAAAAA$^{AC-3'}$ (SEQ ID NO: 6234)
3'-GCUGGUUUUUCCUGGUCUUGUUUUU$_{CA-5'}$ (SEQ ID NO: 1798)

βc-3088 Target: 5'-CGACCAAAAAGGACCAGAACAAAAAGT-3' (SEQ ID NO: 2907)

5'-UCGACCAAAAAGGACCAGAACAAAA$^{CA-3'}$ (SEQ ID NO: 6235)
3'-AGCUGGUUUUUCCUGGUCUUGUUUU$_{UC-5'}$ (SEQ ID NO: 1799)

βc-3089 Target: 5'-TCGACCAAAAAGGACCAGAACAAAAG-3' (SEQ ID NO: 2908)

5'-UUACUCCUCGACCAAAAAGGACCAG$^{CC-3'}$ (SEQ ID NO: 6236)
3'-AAUGAGGAGCUGGUUUUUCCUGGUC$_{UU-5'}$ (SEQ ID NO: 1800)

βc-3096 Target: 5'-TTACTCCTCGACCAAAAAGGACCAGAA-3' (SEQ ID NO: 2909)

5'-AAUCCAUUUGUAUUGUUACUCCUCG$^{CA-3'}$ (SEQ ID NO: 6237)
3'-UUAGGUAAACAUAACAAUGAGGAGC$_{UG-5'}$ (SEQ ID NO: 1801)

βc-3111 Target: 5'-AATCCATTTGTATTGTTACTCCTCGAC-3' (SEQ ID NO: 2910)

5'-AAAUCCAUUUGUAUUGUUACUCCUC$^{AC-3'}$ (SEQ ID NO: 6238)
3'-UUUAGGUAAACAUAACAAUGAGGAG$_{CU-5'}$ (SEQ ID NO: 1802)

βc-3112 Target: 5'-AAATCCATTTGTATTGTTACTCCTCGA-3' (SEQ ID NO: 2911)

5'-AAAAUCCAUUUGUAUUGUUACUCCU$^{AA-3'}$ (SEQ ID NO: 6239)
3'-UUUUAGGUAAACAUAACAAUGAGGA$_{GC-5'}$ (SEQ ID NO: 1803)

βc-3113 Target: 5'-AAAATCCATTTGTATTGTTACTCCTCG-3' (SEQ ID NO: 2912)

5'-CAAAAUCCAUUUGUAUUGUUACUCC$^{CA-3'}$ (SEQ ID NO: 6240)
3'-GUUUUAGGUAAACAUAACAAUGAGG$_{AG-5'}$ (SEQ ID NO: 1804)

βc-3114 Target: 5'-CAAAATCCATTTGTATTGTTACTCCTC-3' (SEQ ID NO: 2913)

5'-CCAAAAUCCAUUUGUAUUGUUACUC$^{AC-3'}$ (SEQ ID NO: 6241)
3'-GGUUUUAGGUAAACAUAACAAUGAG$_{GA-5'}$ (SEQ ID NO: 1805)

βc-3115 Target: 5'-CCAAAATCCATTTGTATTGTTACTCCT-3' (SEQ ID NO: 2914)

5'-UCACUCCCAAAAUCCAUUUGUAUUG$^{CC-3'}$ (SEQ ID NO: 6242)
3'-AGUGAGGGUUUUAGGUAAACAUAAC$_{AA-5'}$ (SEQ ID NO: 1806)

βc-3121 Target: 5'-TCACTCCCAAAATCCATTTGTATTGTT-3' (SEQ ID NO: 2915)

5'-UCUUCACUUCUUGAGUCACUCCCAA$^{CC-3'}$ (SEQ ID NO: 6243)
3'-AGAAGUGAAGAACUCAGUGAGGGUU$_{UU-5'}$ (SEQ ID NO: 1807)

βc-3136 Target: 5'-TCTTCACTTCTTGAGTCACTCCCAAAA-3' (SEQ ID NO: 2916)

5'-AUUCUUCACUUCUUGAGUCACUCCC$^{CC-3'}$ (SEQ ID NO: 6244)
3'-UAAGAAGUGAAGAACUCAGUGAGGG$_{UU-5'}$ (SEQ ID NO: 1808)

βc-3138 Target: 5'-ATTCTTCACTTCTTGAGTCACTCCCAA-3' (SEQ ID NO: 2917)

TABLE 12-continued

Additional Selected Anti-β-catenin DsiRNAs, Blunt/Frayed Duplexes

5'-CAUUCUUCACUUCUUGAGUCACUCC$^{AC-3'}$ (SEQ ID NO: 6245)
3'-GUAAGAAGUGAAGAACUCAGUGAGG$_{GU-5'}$ (SEQ ID NO: 1809)

βc-3139 Target: 5'-CATTCTTCACTTCTTGAGTCACTCCCA-3' (SEQ ID NO: 2918)

5'-GCAUUCUUCACUUCUUGAGUCACUC$^{AA-3'}$ (SEQ ID NO: 6246)
3'-CGUAAGAAGUGAAGAACUCAGUGAG$_{G-5'}$ (SEQ ID NO: 1810)

βc-3140 Target: 5'-GCATTCTTCACTTCTTGAGTCACTCCC-3' (SEQ ID NO: 2919)

5'-GUGCAUUCUUCACUUCUUGAGUCAC$^{CA-3'}$ (SEQ ID NO: 6247)
3'-CACGUAAGAAGUGAAGAACUCAGUG$_{AG-5'}$ (SEQ ID NO: 1811)

βc-3142 Target: 5'-GTGCATTCTTCACTTCTTGAGTCACTC-3' (SEQ ID NO: 2920)

5'-CCAUUCUUGUGCAUUCUUCACUUCU$^{CA-3'}$ (SEQ ID NO: 6248)
3'-GGUAAGAACACGUAAGAAGUGAAGA$_{AC-5'}$ (SEQ ID NO: 1812)

βc-3150 Target: 5'-CCATTCTTGTGCATTCTTCACTTCTTG-3' (SEQ ID NO: 2921)

5'-GAUCCAUUCUUGUGCAUUCUUCACU$^{CA-3'}$ (SEQ ID NO: 6249)
3'-CUAGGUAAGAACACGUAAGAAGUGA$_{AG-5'}$ (SEQ ID NO: 1813)

βc-3153 Target: 5'-GATCCATTCTTGTGCATTCTTCACTTC-3' (SEQ ID NO: 2922)

5'-UGAUCCAUUCUUGUGCAUUCUUCAC$^{CC-3'}$ (SEQ ID NO: 6250)
3'-ACUAGGUAAGAACACGUAAGAAGUG$_{AA-5'}$ (SEQ ID NO: 1814)

βc-3154 Target: 5'-TGATCCATTCTTGTGCATTCTTCACTT-3' (SEQ ID NO: 2923)

5'-GUGAUCCAUUCUUGUGCAUUCUUCA$^{AC-3'}$ (SEQ ID NO: 6251)
3'-CACUAGGUAAGAACACGUAAGAAGU$_{GA-5'}$ (SEQ ID NO: 1815)

βc-3155 Target: 5'-GTGATCCATTCTTGTGCATTCTTCACT-3' (SEQ ID NO: 2924)

5'-UAAAUUCCAUCUUGUGAUCCAUUCU$^{CA-3'}$ (SEQ ID NO: 6252)
3'-AUUUAAGGUAGAACACUAGGUAAGA$_{AC-5'}$ (SEQ ID NO: 1816)

βc-3168 Target: 5'-TAAATTCCATCTTGTGATCCATTCTTG-3' (SEQ ID NO: 2925)

5'-GAUAAAUUCCAUCUUGUGAUCCAUU$^{AC-3'}$ (SEQ ID NO: 6253)
3'-CUAUUUAAGGUAGAACACUAGGUAA$_{GA-5'}$ (SEQ ID NO: 1817)

βc-3170 Target: 5'-GATAAATTCCATCTTGTGATCCATTCT-3' (SEQ ID NO: 2926)

5'-UGAUAAAUUCCAUCUUGUGAUCCAU$^{CA-3'}$ (SEQ ID NO: 6254)
3'-ACUAUUUAAGGUAGAACACUAGGUA$_{AG-5'}$ (SEQ ID NO: 1818)

βc-3171 Target: 5'-TGATAAATTCCATCTTGTGATCCATTC-3' (SEQ ID NO: 2927)

5'-UUGAUAAAUUCCAUCUUGUGAUCCA$^{CC-3'}$ (SEQ ID NO: 6255)
3'-AACUAUUUAAGGUAGAACACUAGGU$_{AA-5'}$ (SEQ ID NO: 1819)

βc-3172 Target: 5'-TTGATAAATTCCATCTTGTGATCCATT-3' (SEQ ID NO: 2928)

5'-UUUGAUAAAUUCCAUCUUGUGAUCC$^{CC-3'}$ (SEQ ID NO: 6256)
3'-AAACUAUUUAAGGUAGAACACUAGG$_{UA-5'}$ (SEQ ID NO: 1820)

βc-3173 Target: 5'-TTTGATAAATTCCATCTTGTGATCC-3' (SEQ ID NO: 2929)

TABLE 12-continued

Additional Selected Anti-β-catenin DsiRNAs, Blunt/Frayed Duplexes

5'-AAGGCUAGGGUUUGAUAAAUUCCAU$^{AC-3'}$ (SEQ ID NO: 6257)
3'-UUCCGAUCCCAAACUAUUUAAGGUA$_{GA-5'}$ (SEQ ID NO: 1821)

βc-3183 Target: 5'-AAGGCTAGGGTTTGATAAATTCCATCT-3' (SEQ ID NO: 2930)

5'-AAAAAAAUUUAACAAGCAAGGCUAG$^{AA-3'}$ (SEQ ID NO: 6258)
3'-UUUUUUUAAAUUGUUCGUUCCGAUC$_{CC-5'}$ (SEQ ID NO: 1822)

βc-3200 Target: 5'-AAAAAAATTTAACAAGCAAGGCTAGGG-3' (SEQ ID NO: 2931)

5'-AAAAAAAAAAAAAAAUUUAACAAG$^{AC-3'}$ (SEQ ID NO: 6259)
3'-UUUUUUUUUUUUUUUAAAUUGUUC$_{GU-5'}$ (SEQ ID NO: 1823)

βc-3209 Target: 5'-AAAAAAAAAAAAAAATTTAACAAGCA-3' (SEQ ID NO: 2932)

5'-AAAAAAAAAAAAAAAAUUUAACAA$^{AA-3'}$ (SEQ ID NO: 6260)
3'-UUUUUUUUUUUUUUUUAAAUUGUU$_{CG-5'}$ (SEQ ID NO: 1824)

βc-3210 Target: 5'-AAAAAAAAAAAAAAAATTTAACAAGC-3' (SEQ ID NO: 2933)

5'-AAAAAAAAAAAAAAAAAUUUAACA$^{CA-3'}$ (SEQ ID NO: 6261)
3'-UUUUUUUUUUUUUUUUUAAAUUGU$_{UC-5'}$ (SEQ ID NO: 1825)

βc-3211 Target: 5'-AAAAAAAAAAAAAAAAATTTAACAAG-3' (SEQ ID NO: 2934)

5'-AAAAAAAAAAAAAAAAAAUUUAAC$^{CC-3'}$ (SEQ ID NO: 6262)
3'-UUUUUUUUUUUUUUUUUUAAAUUG$_{UU-5'}$ (SEQ ID NO: 1826)

βc-3212 Target: 5'-AAAAAAAAAAAAAAAAAATTTAACAA-3' (SEQ ID NO: 2935)

5'-UAAAAAAAAAAAAAAAAAAUUUAA$^{AC-3'}$ (SEQ ID NO: 6263)
3'-AUUUUUUUUUUUUUUUUUUAAAUU$_{GU-5'}$ (SEQ ID NO: 1827)

βc-3213 Target: 5'-TAAAAAAAAAAAAAAAAAATTTAACA-3' (SEQ ID NO: 2936)

5'-UUAAAAAAAAAAAAAAAAAAUUUA$^{CA-3'}$ (SEQ ID NO: 6264)
3'-AAUUUUUUUUUUUUUUUUUUAAAU$_{UG-5'}$ (SEQ ID NO: 1828)

βc-3214 Target: 5'-TTAAAAAAAAAAAAAAAAAATTTAAC-3' (SEQ ID NO: 2937)

5'-CUUAAAAAAAAAAAAAAAAAAUUU$^{CC-3'}$ (SEQ ID NO: 6265)
3'-GAAUUUUUUUUUUUUUUUUUUAAA$_{UU-5'}$ (SEQ ID NO: 1829)

βc-3215 Target: 5'-CTTAAAAAAAAAAAAAAAAAATTTAA-3' (SEQ ID NO: 2938)

5'-UCUUAAAAAAAAAAAAAAAAAAUU$^{CC-3'}$ (SEQ ID NO: 6266)
3'-AGAAUUUUUUUUUUUUUUUUUUAA$_{AU-5'}$ (SEQ ID NO: 1830)

βc-3216 Target: 5'-TCTTAAAAAAAAAAAAAAAAAATTTA-3' (SEQ ID NO: 2939)

5'-AUUCUUAAAAAAAAAAAAAAAAAA$^{CC-3'}$ (SEQ ID NO: 6267)
3'-UAAGAAUUUUUUUUUUUUUUUUUU$_{AA-5'}$ (SEQ ID NO: 1831)

βc-3218 Target: 5'-ATTCTTAAAAAAAAAAAAAAAAAATT-3' (SEQ ID NO: 2940)

5'-UAUUCUUAAAAAAAAAAAAAAAAA$^{CC-3'}$ (SEQ ID NO: 6268)
3'-AUAAGAAUUUUUUUUUUUUUUUUU$_{UA-5'}$ (SEQ ID NO: 1832)

βc-3219 Target: 5'-TATTCTTAAAAAAAAAAAAAAAAAAT-3' (SEQ ID NO: 2941)

TABLE 12-continued

Additional Selected Anti-β-catenin DsiRNAs, Blunt/Frayed Duplexes

5'-AUAUUCUUAAAAAAAAAAAAAAAAA$^{CC-3'}$ (SEQ ID NO: 6269)
3'-UAUAAGAAUUUUUUUUUUUUUUUU$_{U-5'}$ (SEQ ID NO: 1833)

βc-3220 Target: 5'-ATATTCTTAAAAAAAAAAAAAAAAA-3' (SEQ ID NO: 2942)

5'-GAUAUUCUUAAAAAAAAAAAAAAAA$^{CC-3'}$ (SEQ ID NO: 6270)
3'-CUAUAAGAAUUUUUUUUUUUUUUU$_{U-5'}$ (SEQ ID NO: 1834)

βc-3221 Target: 5'-GATATTCTTAAAAAAAAAAAAAAAA-3' (SEQ ID NO: 2943)

5'-AGAUAUUCUUAAAAAAAAAAAAAAA$^{CC-3'}$ (SEQ ID NO: 6271)
3'-UCUAUAAGAAUUUUUUUUUUUUUU$_{U-5'}$ (SEQ ID NO: 1835)

βc-3222 Target: 5'-AGATATTCTTAAAAAAAAAAAAAAA-3' (SEQ ID NO: 2944)

5'-CAGAUAUUCUUAAAAAAAAAAAAAA$^{CC-3'}$ (SEQ ID NO: 6272)
3'-GUCUAUAAGAAUUUUUUUUUUUUU$_{U-5'}$ (SEQ ID NO: 1836)

βc-3223 Target: 5'-CAGATATTCTTAAAAAAAAAAAAAA-3' (SEQ ID NO: 2945)

5'-ACAGAUAUUCUUAAAAAAAAAAAAA$^{CC-3'}$ (SEQ ID NO: 6273)
3'-UGUCUAUAAGAAUUUUUUUUUUUU$_{U-5'}$ (SEQ ID NO: 1837)

βc-3224 Target: 5'-ACAGATATTCTTAAAAAAAAAAAAA-3' (SEQ ID NO: 2946)

5'-CAUUACAGAUAUUCUUAAAAAAAAA$^{CC-3'}$ (SEQ ID NO: 6274)
3'-GUAAUGUCUAUAAGAAUUUUUUUU$_{U-5'}$ (SEQ ID NO: 1838)

βc-3228 Target: 5'-CATTACAGATATTCTTAAAAAAAAA-3' (SEQ ID NO: 2947)

5'-CCAUUACAGAUAUUCUUAAAAAAAA$^{CC-3'}$ (SEQ ID NO: 6275)
3'-GGUAAUGUCUAUAAGAAUUUUUUU$_{U-5'}$ (SEQ ID NO: 1839)

βc-3229 Target: 5'-CCATTACAGATATTCTTAAAAAAAA-3' (SEQ ID NO: 2948)

5'-AGUACCAUUACAGAUAUUCUUAAAA$^{CC-3'}$ (SEQ ID NO: 6276)
3'-UCAUGGUAAUGUCUAUAAGAAUUUU$_{U-5'}$ (SEQ ID NO: 1840)

βc-3233 Target: 5'-AGTACCATTACAGATATTCTTAAAAAA-3' (SEQ ID NO: 2949)

5'-CAGUACCAUUACAGAUAUUCUUAAA$^{CC-3'}$ (SEQ ID NO: 6277)
3'-GUCAUGGUAAUGUCUAUAAGAAUUU$_{U-5'}$ (SEQ ID NO: 1841)

βc-3234 Target: 5'-CAGTACCATTACAGATATTCTTAAAAA-3' (SEQ ID NO: 2950)

5'-UCAGUACCAUUACAGAUAUUCUUAA$^{CC-3'}$ (SEQ ID NO: 6278)
3'-AGUCAUGGUAAUGUCUAUAAGAAUU$_{U-5'}$ (SEQ ID NO: 1842)

βc-3235 Target: 5'-TCAGTACCATTACAGATATTCTTAAAA-3' (SEQ ID NO: 2951)

5'-AAAGUCAGUACCAUUACAGAUAUUC$^{CC-3'}$ (SEQ ID NO: 6279)
3'-UUUCAGUCAUGGUAAUGUCUAUAAG$_{A-5'}$ (SEQ ID NO: 1843)

βc-3239 Target: 5'-AAAGTCAGTACCATTACAGATATTCTT-3' (SEQ ID NO: 2952)

5'-GCUACUUCAAAGCAAGCAAAGUCAG$^{CC-3'}$ (SEQ ID NO: 6280)
3'-CGAUGAAGUUUCGUUCGUUUCAGUC$_{A-5'}$ (SEQ ID NO: 1844)

βc-3256 Target: 5'-GCTACTTCAAAGCAAGCAAAGTCAGTA-3' (SEQ ID NO: 2953)

TABLE 12-continued

Additional Selected Anti-β-catenin DsiRNAs, Blunt/Frayed Duplexes

5'-AAAAAAGAGCUACUUCAAAGCAAG$^{AC-3'}$ (SEQ ID NO: 6281)
3'-UUUUUUCUCGAUGAAGUUUCGUUC$_{G-5'}$ (SEQ ID NO: 1845)

βc-3265 Target: 5'-AAAAAAGAGCTACTTCAAAGCAAGCA-3' (SEQ ID NO: 2954)

5'-AAAAAAAAAAAGAGCUACUUCAAA$^{AA-3'}$ (SEQ ID NO: 6282)
3'-UUUUUUUUUUUCUCGAUGAAGUUU$_{G-5'}$ (SEQ ID NO: 1846)

βc-3270 Target: 5'-AAAAAAAAAAAGAGCTACTTCAAAGC-3' (SEQ ID NO: 2955)

5'-AAAAAAAAAAAAGAGCUACUUCAA$^{CA-3'}$ (SEQ ID NO: 6283)
3'-UUUUUUUUUUUUCUCGAUGAAGUU$_{C-5'}$ (SEQ ID NO: 1847)

βc-3271 Target: 5'-AAAAAAAAAAAAGAGCTACTTCAAAG-3' (SEQ ID NO: 2956)

5'-AAAAAAAAAAAAAAGAGCUACUUC$^{CC-3'}$ (SEQ ID NO: 6284)
3'-UUUUUUUUUUUUUUCUCGAUGAAG$_{U-5'}$ (SEQ ID NO: 1848)

βc-3273 Target: 5'-AAAAAAAAAAAAAAGAGCTACTTCAA-3' (SEQ ID NO: 2957)

5'-AAAAAAAAAAAAAAAGAGCUACUU$^{AC-3'}$ (SEQ ID NO: 6285)
3'-UUUUUUUUUUUUUUUCUCGAUGAA$_{G-5'}$ (SEQ ID NO: 1849)

βc-3274 Target: 5'-AAAAAAAAAAAAAAAGAGCTACTTCA-3' (SEQ ID NO: 2958)

5'-AAAAAAAAAAAAAAAAGAGCUACU$^{CA-3'}$ (SEQ ID NO: 6286)
3'-UUUUUUUUUUUUUUUUCUCGAUGA$_{G-5'}$ (SEQ ID NO: 1850)

βc-3275 Target: 5'-AAAAAAAAAAAAAAAAGAGCTACTTC-3' (SEQ ID NO: 2959)

5'-AAAAAAAAAAAAAAAAAGAGCUAC$^{CC-3'}$ (SEQ ID NO: 6287)
3'-UUUUUUUUUUUUUUUUUCUCGAUG$_{A-5'}$ (SEQ ID NO: 1851)

βc-3276 Target: 5'-AAAAAAAAAAAAAAAAAGAGCTACTT-3' (SEQ ID NO: 2960)

5'-AAAAAAAAAAAAAAAAAAAAAAAG$^{CA-3'}$ (SEQ ID NO: 6288)
3'-UUUUUUUUUUUUUUUUUUUUUUUC$_{U-5'}$ (SEQ ID NO: 1852)

βc-3282 Target: 5'-AAAAAAAAAAAAAAAAAAAAAAAGAG-3' (SEQ ID NO: 2961)

5'-AAAAAAAAAAAAAAAAAAAAAAAA$^{AC-3'}$ (SEQ ID NO: 6289)
3'-UUUUUUUUUUUUUUUUUUUUUUUU$_{C-5'}$ (SEQ ID NO: 1853)

βc-3283 Target: 5'-AAAAAAAAAAAAAAAAAAAAAAAAGA-3' (SEQ ID NO: 2962)

5'-CAAAAAAAAAAAAAAAAAAAAAAA$^{CA-3'}$ (SEQ ID NO: 6290)
3'-GUUUUUUUUUUUUUUUUUUUUUUU$_{C-5'}$ (SEQ ID NO: 1854)

βc-3284 Target: 5'-CAAAAAAAAAAAAAAAAAAAAAAAAG-3' (SEQ ID NO: 2963)

5'-GCAAAAAAAAAAAAAAAAAAAAAA$^{CC-3'}$ (SEQ ID NO: 6291)
3'-CGUUUUUUUUUUUUUUUUUUUUUU$_{U-5'}$ (SEQ ID NO: 1855)

βc-3285 Target: 5'-GCAAAAAAAAAAAAAAAAAAAAAAAA-3' (SEQ ID NO: 2964)

5'-CUGCAAAAAAAAAAAAAAAAAAAA$^{CC-3'}$ (SEQ ID NO: 6292)
3'-GACGUUUUUUUUUUUUUUUUUUUU$_{U-5'}$ (SEQ ID NO: 1856)

βc-3287 Target: 5'-CTGCAAAAAAAAAAAAAAAAAAAAAA-3' (SEQ ID NO: 2965)

TABLE 12-continued

Additional Selected Anti-β-catenin DsiRNAs, Blunt/Frayed Duplexes

5'-ACUGCAAAAAAAAAAAAAAAAAAAA<sup>CC-3'</sup> (SEQ ID NO: 6293)
3'-UGACGUUUUUUUUUUUUUUUUUUU<sub>U-5'</sub> (SEQ ID NO: 1857)

βc-3288 Target: 5'-ACTGCAAAAAAAAAAAAAAAAAAAA-3' (SEQ ID NO: 2966)

5'-AGUUACUGCAAAAAAAAAAAAAAA<sup>CC-3'</sup> (SEQ ID NO: 6294)
3'-UCAAUGACGUUUUUUUUUUUUUUU<sub>U-5'</sub> (SEQ ID NO: 1858)

βc-3292 Target: 5'-AGTTACTGCAAAAAAAAAAAAAAA-3' (SEQ ID NO: 2967)

5'-CAGUUACUGCAAAAAAAAAAAAAA<sup>CC-3'</sup> (SEQ ID NO: 6295)
3'-GUCAAUGACGUUUUUUUUUUUUUU<sub>U-5'</sub> (SEQ ID NO: 1859)

βc-3293 Target: 5'-CAGTTACTGCAAAAAAAAAAAAAA-3' (SEQ ID NO: 2968)

5'-ACAGUUACUGCAAAAAAAAAAAAA<sup>CC-3'</sup> (SEQ ID NO: 6296)
3'-UGUCAAUGACGUUUUUUUUUUUUU<sub>U-5'</sub> (SEQ ID NO: 1860)

βc-3294 Target: 5'-ACAGTTACTGCAAAAAAAAAAAAA-3' (SEQ ID NO: 2969)

5'-AAAAACAGUUACUGCAAAAAAAAA<sup>CC-3'</sup> (SEQ ID NO: 6297)
3'-UUUUUGUCAAUGACGUUUUUUUUU<sub>U-5'</sub> (SEQ ID NO: 1861)

βc-3298 Target: 5'-AAAAACAGTTACTGCAAAAAAAAA-3' (SEQ ID NO: 2970)

5'-AAAAAACAGUUACUGCAAAAAAAA<sup>CC-3'</sup> (SEQ ID NO: 6298)
3'-UUUUUUGUCAAUGACGUUUUUUUU<sub>U-5'</sub> (SEQ ID NO: 1862)

βc-3299 Target: 5'-AAAAAACAGTTACTGCAAAAAAAA-3' (SEQ ID NO: 2971)

5'-UAAAAAACAGUUACUGCAAAAAAA<sup>CC-3'</sup> (SEQ ID NO: 6299)
3'-AUUUUUUGUCAAUGACGUUUUUUU<sub>U-5'</sub> (SEQ ID NO: 1863)

βc-3300 Target: 5'-TAAAAAACAGTTACTGCAAAAAAA-3' (SEQ ID NO: 2972)

5'-CUUAAAAAACAGUUACUGCAAAAA<sup>CC-3'</sup> (SEQ ID NO: 6300)
3'-GAAUUUUUUGUCAAUGACGUUUUU<sub>U-5'</sub> (SEQ ID NO: 1864)

βc-3302 Target: 5'-CTTAAAAAACAGTTACTGCAAAAA-3' (SEQ ID NO: 2973)

5'-ACUUAAAAAACAGUUACUGCAAAA<sup>CC-3'</sup> (SEQ ID NO: 6301)
3'-UGAAUUUUUUGUCAAUGACGUUUU<sub>U-5'</sub> (SEQ ID NO: 1865)

βc-3303 Target: 5'-ACTTAAAAAACAGTTACTGCAAAA-3' (SEQ ID NO: 2974)

5'-AGACUUAAAAAACAGUUACUGCAA<sup>CC-3'</sup> (SEQ ID NO: 6302)
3'-UCUGAAUUUUUUGUCAAUGACGUU<sub>U-5'</sub> (SEQ ID NO: 1866)

βc-3305 Target: 5'-AGACTTAAAAAACAGTTACTGCAAAAA-3' (SEQ ID NO: 2975)

5'-ACACUACGAGAGACUUAAAAAACAG<sup>CC-3'</sup> (SEQ ID NO: 6303)
3'-UGUGAUGCUCUCUGAAUUUUUUGUC<sub>A-5'</sub> (SEQ ID NO: 1867)

βc-3315 Target: 5'-ACACTACGAGAGACTTAAAAAACAGTT-3' (SEQ ID NO: 2976)

5'-UAACACUACGAGAGACUUAAAAAAC<sup>A-3'</sup> (SEQ ID NO: 6304)
3'-AUUGUGAUGCUCUCUGAAUUUUUUG<sub>C-5'</sub> (SEQ ID NO: 1868)

βc-3317 Target: 5'-TAACACTACGAGAGACTTAAAAAACAG-3' (SEQ ID NO: 2977)

TABLE 12-continued

Additional Selected Anti-β-catenin DsiRNAs, Blunt/Frayed Duplexes

5'-UUAACACUACGAGAGACUUAAAAAA$^{AC-3'}$  (SEQ ID NO: 6305)
3'-AAUUGUGAUGCUCUCUGAAUUUUU$_{GU-5'}$  (SEQ ID NO: 1869)

βc-3318 Target: 5'-TTAACACTACGAGAGACTTAAAAAACA-3' (SEQ ID NO: 2978)

5'-ACUUAACACUACGAGAGACUUAAAA$^{CC-3'}$  (SEQ ID NO: 6306)
3'-UGAAUUGUGAUGCUCUCUGAAUUUU$_{UU-5'}$  (SEQ ID NO: 1870)

βc-3320 Target: 5'-ACTTAACACTACGAGAGACTTAAAAAA-3' (SEQ ID NO: 2979)

5'-AUAACUUAACACUACGAGAGACUUA$^{CC-3'}$  (SEQ ID NO: 6307)
3'-UAUUGAAUUGUGAUGCUCUCUGAAU$_{UU-5'}$  (SEQ ID NO: 1871)

βc-3323 Target: 5'-ATAACTTAACACTACGAGAGACTTAAA-3' (SEQ ID NO: 2980)

5'-UAUAACUUAACACUACGAGAGACUU$^{CC-3'}$  (SEQ ID NO: 6308)
3'-AUAUUGAAUUGUGAUGCUCUCUGAA$_{UU-5'}$  (SEQ ID NO: 1872)

βc-3324 Target: 5'-TATAACTTAACACTACGAGAGACTTAA-3' (SEQ ID NO: 2981)

5'-GUAUUCACUAUAACUUAACACUACG$^{CA-3'}$  (SEQ ID NO: 6309)
3'-CAUAAGUGAUAUUGAAUUGUGAUGC$_{UC-5'}$  (SEQ ID NO: 1873)

βc-3332 Target: 5'-GTATTCACTATAACTTAACACTACGAG-3' (SEQ ID NO: 2982)

5'-AGUAUUCACUAUAACUUAACACUAC$^{AC-3'}$  (SEQ ID NO: 6310)
3'-UCAUAAGUGAUAUUGAAUUGUGAUG$_{CU-5'}$  (SEQ ID NO: 1874)

βc-3333 Target: 5'-AGTATTCACTATAACTTAACACTACGA-3' (SEQ ID NO: 2983)

5'-CAGUAUUCACUAUAACUUAACACUA$^{AA-3'}$  (SEQ ID NO: 6311)
3'-GUCAUAAGUGAUAUUGAAUUGUGAU$_{GC-5'}$  (SEQ ID NO: 1875)

βc-3334 Target: 5'-CAGTATTCACTATAACTTAACACTACG-3' (SEQ ID NO: 2984)

5'-GCAGUAUUCACUAUAACUUAACACU$^{CA-3'}$  (SEQ ID NO: 6312)
3'-CGUCAUAAGUGAUAUUGAAUUGUGA$_{UG-5'}$  (SEQ ID NO: 1876)

βc-3335 Target: 5'-GCAGTATTCACTATAACTTAACACTAC-3' (SEQ ID NO: 2985)

5'-AGAAAUUGCUGUAGCAGUAUUCACU$^{CC-3'}$  (SEQ ID NO: 6313)
3'-UCUUUAACGACAUCGUCAUAAGUGA$_{UA-5'}$  (SEQ ID NO: 1877)

βc-3348 Target: 5'-AGAAATTGCTGTAGCAGTATTCACTAT-3' (SEQ ID NO: 2986)

5'-UAGAAAUUGCUGUAGCAGUAUUCAC$^{CC-3'}$  (SEQ ID NO: 6314)
3'-AUCUUUAACGACAUCGUCAUAAGUG$_{AU-5'}$  (SEQ ID NO: 1878)

βc-3349 Target: 5'-TAGAAATTGCTGTAGCAGTATTCACTA-3' (SEQ ID NO: 2987)

5'-UUAGAAAUUGCUGUAGCAGUAUUCA$^{AC-3'}$  (SEQ ID NO: 6315)
3'-AAUCUUUAACGACAUCGUCAUAAGU$_{GA-5'}$  (SEQ ID NO: 1879)

βc-3350 Target: 5'-TTAGAAATTGCTGTAGCAGTATTCACT-3' (SEQ ID NO: 2988)

5'-ACUCAAUUCUUAAAAAUUAGAAAUU$^{AA-3'}$  (SEQ ID NO: 6316)
3'-UGAGUUAAGAAUUUUUAAUCUUUAA$_{CG-5'}$  (SEQ ID NO: 1880)

βc-3366 Target: 5'-ACTCAATTCTTAAAAATTAGAAATTGC-3' (SEQ ID NO: 2989)

TABLE 12-continued

Additional Selected Anti-β-catenin DsiRNAs, Blunt/Frayed Duplexes

5'-CCAUUACUCAAUUCUUAAAAAUUAG$^{CC}$-3' (SEQ ID NO: 6317)
3'-GGUAAUGAGUUAAGAAUUUUUAAUC$_{U-5'}^{U}$ (SEQ ID NO: 1881)

βc-3371 Target: 5'-CCATTACTCAATTCTTAAAAATTAGAA-3' (SEQ ID NO: 2990)

5'-ACACCAUUACUCAAUUCUUAAAAAU$^{CC}$-3' (SEQ ID NO: 6318)
3'-UGUGGUAAUGAGUUAAGAAUUUUUA$_{U-5'}^{A}$ (SEQ ID NO: 1882)

βc-3374 Target: 5'-ACACCATTACTCAATTCTTAAAAATTA-3' (SEQ ID NO: 2991)

5'-CUACACCAUUACUCAAUUCUUAAAA$^{CC}$-3' (SEQ ID NO: 6319)
3'-GAUGUGGUAAUGAGUUAAGAAUUUU$_{A-5'}^{U}$ (SEQ ID NO: 1883)

βc-3376 Target: 5'-CTACACCATTACTCAATTCTTAAAAAT-3' (SEQ ID NO: 2992)

5'-UCUACACCAUUACUCAAUUCUUAAA$^{CC}$-3' (SEQ ID NO: 6320)
3'-AGAUGUGGUAAUGAGUUAAGAAUUU$_{U-5'}^{U}$ (SEQ ID NO: 1884)

βc-3377 Target: 5'-TCTACACCATTACTCAATTCTTAAAAA-3' (SEQ ID NO: 2993)

5'-GUUCUACACCAUUACUCAAUUCUUA$^{CC}$-3' (SEQ ID NO: 6321)
3'-CAAGAUGUGGUAAUGAGUUAAGAAU$_{U-5'}^{U}$ (SEQ ID NO: 1885)

βc-3379 Target: 5'-GTTCTACACCATTACTCAATTCTTAAA-3' (SEQ ID NO: 2994)

5'-GUGUUCUACACCAUUACUCAAUUCU$^{CC}$-3' (SEQ ID NO: 6322)
3'-CACAAGAUGUGGUAAUGAGUUAAGA$_{U-5'}^{A}$ (SEQ ID NO: 1886)

βc-3381 Target: 5'-GTGTTCTACACCATTACTCAATTCTTA-3' (SEQ ID NO: 2995)

5'-AUGAAUUAGUGUUCUACACCAUUAC$^{CA}$-3' (SEQ ID NO: 6323)
3'-UACUUAAUCACAAGAUGUGGUAAUG$_{G-5'}^{A}$ (SEQ ID NO: 1887)

βc-3389 Target: 5'-ATGAATTAGTGTTCTACACCATTACTC-3' (SEQ ID NO: 2996)

5'-UGAUUAUGAAUUAGUGUUCUACACC$^{CC}$-3' (SEQ ID NO: 6324)
3'-ACUAAUACUUAAUCACAAGAUGUGG$_{A-5'}^{U}$ (SEQ ID NO: 1888)

βc-3394 Target: 5'-TGATTATGAATTAGTGTTCTACACC-3' (SEQ ID NO: 2997)

5'-GUGAUUAUGAAUUAGUGUUCUACAC$^{AC}$-3' (SEQ ID NO: 6325)
3'-CACUAAUACUUAAUCACAAGAUGUG$_{U-5'}^{G}$ (SEQ ID NO: 1889)

βc-3395 Target: 5'-GTGATTATGAATTAGTGTTCTACACCA-3' (SEQ ID NO: 2998)

5'-AGUGAUUAUGAAUUAGUGUUCUACA$^{AA}$-3' (SEQ ID NO: 6326)
3'-UCACUAAUACUUAAUCACAAGAUGU$_{G-5'}^{G}$ (SEQ ID NO: 1890)

βc-3396 Target: 5'-AGTGATTATGAATTAGTGTTCTACACC-3' (SEQ ID NO: 2999)

5'-AUUAAUUAGAGUGAUUAUGAAUUAG$^{CA}$-3' (SEQ ID NO: 6327)
3'-UAAUUAAUCUCACUAAUACUUAAUC$_{A-5'}^{A}$ (SEQ ID NO: 1891)

βc-3405 Target: 5'-ATTAATTAGAGTGATTATGAATTAGTG-3' (SEQ ID NO: 3000)

5'-AAUUAAUUAGAGUGAUUAUGAAUUA$^{AC}$-3' (SEQ ID NO: 6328)
3'-UUAAUUAAUCUCACUAAUACUUAAU$_{A-5'}^{C}$ (SEQ ID NO: 1892)

βc-3406 Target: 5'-AATTAATTAGAGTGATTATGAATTAGT-3' (SEQ ID NO: 3001)

TABLE 12-continued

Additional Selected Anti-β-catenin DsiRNAs, Blunt/Frayed Duplexes

5'-CAAUUAAUUAGAGUGAUUAUGAAUU$^{CA\text{-}3'}$ (SEQ ID NO: 6329)
3'-GUUAAUUAAUCUCACUAAUACUUAA$_{UC\text{-}5'}$ (SEQ ID NO: 1893)

βc-3407 Target: 5'-CAATTAATTAGAGTGATTATGAATTAG-3' (SEQ ID NO: 3002)

5'-AUUACAAUUAAUUAGAGUGAUUAUG$^{CC\text{-}3'}$ (SEQ ID NO: 6330)
3'-UAAUGUUAAUUAAUCUCACUAAUAC$_{UU\text{-}5'}$ (SEQ ID NO: 1894)

βc-3411 Target: 5'-ATTACAATTAATTAGAGTGATTATGAA-3' (SEQ ID NO: 3003)

5'-GAUUACAAUUAAUUAGAGUGAUUAU$^{AC\text{-}3'}$ (SEQ ID NO: 6331)
3'-CUAAUGUUAAUUAAUCUCACUAAUA$_{CU\text{-}5'}$ (SEQ ID NO: 1895)

βc-3412 Target: 5'-GATTACAATTAATTAGAGTGATTATGA-3' (SEQ ID NO: 3004)

5'-AGAUUACAAUUAAUUAGAGUGAUUA$^{CA\text{-}3'}$ (SEQ ID NO: 6332)
3'-UCUAAUGUUAAUUAAUCUCACUAAU$_{AC\text{-}5'}$ (SEQ ID NO: 1896)

βc-3413 Target: 5'-AGATTACAATTAATTAGAGTGATTATG-3' (SEQ ID NO: 3005)

5'-CUUUAUUCAGAUUACAAUUAAUUAG$^{CA\text{-}3'}$ (SEQ ID NO: 6333)
3'-GAAAUAAGUCUAAUGUUAAUUAAUC$_{UC\text{-}5'}$ (SEQ ID NO: 1897)

βc-3421 Target: 5'-CTTTATTCAGATTACAATTAATTAGAG-3' (SEQ ID NO: 3006)

5'-ACUUUAUUCAGAUUACAAUUAAUUA$^{AC\text{-}3'}$ (SEQ ID NO: 6334)
3'-UGAAAUAAGUCUAAUGUUAAUUAAU$_{CU\text{-}5'}$ (SEQ ID NO: 1898)

βc-3422 Target: 5'-ACTTTATTCAGATTACAATTAATTAGA-3' (SEQ ID NO: 3007)

5'-UUACACUUUAUUCAGAUUACAAUUA$^{CC\text{-}3'}$ (SEQ ID NO: 6335)
3'-AAUGUGAAAUAAGUCUAAUGUUAAU$_{UA\text{-}5'}$ (SEQ ID NO: 1899)

βc-3426 Target: 5'-TTACACTTTATTCAGATTACAATTAAT-3' (SEQ ID NO: 3008)

5'-GUUACACUUUAUUCAGAUUACAAUU$^{CC\text{-}3'}$ (SEQ ID NO: 6336)
3'-CAAUGUGAAAUAAGUCUAAUGUUAA$_{UU\text{-}5'}$ (SEQ ID NO: 1900)

βc-3427 Target: 5'-GTTACACTTTATTCAGATTACAATTAA-3' (SEQ ID NO: 3009)

5'-UGUUACACUUUAUUCAGAUUACAAU$^{CC\text{-}3'}$ (SEQ ID NO: 6337)
3'-ACAAUGUGAAAUAAGUCUAAUGUUA$_{AU\text{-}5'}$ (SEQ ID NO: 1901)

βc-3428 Target: 5'-TGTTACACTTTATTCAGATTACAATTA-3' (SEQ ID NO: 3010)

5'-UUGUUACACUUUAUUCAGAUUACAA$^{CC\text{-}3'}$ (SEQ ID NO: 6338)
3'-AACAAUGUGAAAUAAGUCUAAUGUU$_{AA\text{-}5'}$ (SEQ ID NO: 1902)

βc-3429 Target: 5'-TTGTTACACTTTATTCAGATTACAATT-3' (SEQ ID NO: 3011)

5'-AUUGUUACACUUUAUUCAGAUUACA$^{CC\text{-}3'}$ (SEQ ID NO: 6339)
3'-UAACAAUGUGAAAUAAGUCUAAUGU$_{UA\text{-}5'}$ (SEQ ID NO: 1903)

βc-3430 Target: 5'-ATTGTTACACTTTATTCAGATTACAAT-3' (SEQ ID NO: 3012)

5'-CUACACAAUUGUUACACUUUAUUCA$^{AC\text{-}3'}$ (SEQ ID NO: 6340)
3'-GAUGUGUUAACAAUGUGAAAUAAGU$_{CU\text{-}5'}$ (SEQ ID NO: 1904)

βc-3437 Target: 5'-CTACACAATTGTTACACTTTATTCAGA-3' (SEQ ID NO: 3013)

TABLE 12-continued

Additional Selected Anti-β-catenin DsiRNAs, Blunt/Frayed Duplexes

5'-AAGGCUACACAAUUGUUACACUUUA$^{CC-3'}$ (SEQ ID NO: 6341)
3'-UUCCGAUGUGUUAACAAUGUGAAAU$_{A-5'}^A$ (SEQ ID NO: 1905)

βc-3441 Target: 5'-AAGGCTACACAATTGTTACACTTTATT-3' (SEQ ID NO: 3014)

5'-ACAAAAAGGCUACACAAUUGUUACA$^{AC-3'}$ (SEQ ID NO: 6342)
3'-UGUUUUUCCGAUGUGUUAACAAUGU$_{A-5'}^G$ (SEQ ID NO: 1906)

βc-3446 Target: 5'-ACAAAAGGCTACACAATTGTTACACT-3' (SEQ ID NO: 3015)

5'-UUUUAUACAAAAAGGCUACACAAUU$^{AC-3'}$ (SEQ ID NO: 6343)
3'-AAAAUAUGUUUUUCCGAUGUGUUAA$_{A-5'}^C$ (SEQ ID NO: 1907)

βc-3452 Target: 5'-TTTTATACAAAAGGCTACACAATTGT-3' (SEQ ID NO: 3016)

5'-AUUUUAUACAAAAAGGCUACACAAU$^{CA-3'}$ (SEQ ID NO: 6344)
3'-UAAAAUAUGUUUUUCCGAUGUGUUA$_{C-5'}^A$ (SEQ ID NO: 1908)

βc-3453 Target: 5'-ATTTTATACAAAAGGCTACACAATTG-3' (SEQ ID NO: 3017)

5'-CUAUUUUAUACAAAAAGGCUACACA$^{CC-3'}$ (SEQ ID NO: 6345)
3'-GAUAAAAUAUGUUUUUCCGAUGUGU$_{A-5'}^U$ (SEQ ID NO: 1909)

βc-3455 Target: 5'-CTATTTTATACAAAAGGCTACACAAT-3' (SEQ ID NO: 3018)

5'-UCUAUUUUAUACAAAAAGGCUACAC$^{CC-3'}$ (SEQ ID NO: 6346)
3'-AGAUAAAAUAUGUUUUUCCGAUGUG$_{U-5'}^U$ (SEQ ID NO: 1910)

βc-3456 Target: 5'-TCTATTTTATACAAAAGGCTACACAA-3' (SEQ ID NO: 3019)

5'-UGUCUAUUUUAUACAAAAAGGCUAC$^{CA-3'}$ (SEQ ID NO: 6347)
3'-ACAGAUAAAAUAUGUUUUUCCGAUG$_{U-5'}^G$ (SEQ ID NO: 1911)

βc-3458 Target: 5'-TGTCTATTTTATACAAAAGGCTACAC-3' (SEQ ID NO: 3020)

5'-UCUAUUUGUCUAUUUUAUACAAAAA$^{AA-3'}$ (SEQ ID NO: 6348)
3'-AGAUAAACAGAUAAAAUAUGUUUUU$_{C-5'}^C$ (SEQ ID NO: 1912)

βc-3464 Target: 5'-TCTATTTGTCTATTTTATACAAAAGG-3' (SEQ ID NO: 3021)

5'-UUUCUAUUUGUCUAUUUUAUACAAA$^{CC-3'}$ (SEQ ID NO: 6349)
3'-AAAGAUAAACAGAUAAAAUAUGUUU$_{U-5'}^U$ (SEQ ID NO: 1913)

βc-3466 Target: 5'-TTTCTATTTGTCTATTTTATACAAAA-3' (SEQ ID NO: 3022)

5'-UUUUCUAUUUGUCUAUUUUAUACAA$^{CC-3'}$ (SEQ ID NO: 6350)
3'-AAAAGAUAAACAGAUAAAAUAUGUU$_{U-5'}^U$ (SEQ ID NO: 1914)

βc-3467 Target: 5'-TTTTCTATTTGTCTATTTTATACAAA-3' (SEQ ID NO: 3023)

5'-AUUUUCUAUUUGUCUAUUUUAUACA$^{CC-3'}$ (SEQ ID NO: 6351)
3'-UAAAAGAUAAACAGAUAAAAUAUGU$_{U-5'}^U$ (SEQ ID NO: 1915)

βc-3468 Target: 5'-ATTTTCTATTTGTCTATTTTATACAA-3' (SEQ ID NO: 3024)

5'-CAUUUUCUAUUUGUCUAUUUUAUAC$^{CC-3'}$ (SEQ ID NO: 6352)
3'-GUAAAAGAUAAACAGAUAAAAUAUG$_{U-5'}^U$ (SEQ ID NO: 1916)

βc-3469 Target: 5'-CATTTTCTATTTGTCTATTTTATACAA-3' (SEQ ID NO: 3025)

TABLE 12-continued

Additional Selected Anti-β-catenin DsiRNAs, Blunt/Frayed Duplexes

5'-CCAUUUUCUAUUUGUCUAUUUUAUA$^{AC-3'}$ (SEQ ID NO: 6353)
3'-GGUAAAAGAUAAACAGAUAAAAUAU$_{GU-5'}$ (SEQ ID NO: 1917)

βc-3470 Target: 5'-CCATTTTCTATTTGTCTATTTTATACA-3' (SEQ ID NO: 3026)

5'-GGACCAUUUUCUAUUUGUCUAUUUU$^{CC-3'}$ (SEQ ID NO: 6354)
3'-CCUGGUAAAAGAUAAACAGAUAAAA$_{UA-5'}$ (SEQ ID NO: 1918)

βc-3473 Target: 5'-GGACCATTTTCTATTTGTCTATTTTAT-3' (SEQ ID NO: 3027)

5'-UGGACCAUUUUCUAUUUGUCUAUUU$^{CC-3'}$ (SEQ ID NO: 6355)
3'-ACCUGGUAAAAGAUAAACAGAUAAAA$_{AU-5'}$ (SEQ ID NO: 1919)

βc-3474 Target: 5'-TGGACCATTTTCTATTTGTCTATTTTA-3' (SEQ ID NO: 3028)

5'-UUGGACCAUUUUCUAUUUGUCUAUU$^{CC-3'}$ (SEQ ID NO: 6356)
3'-AACCUGGUAAAAGAUAAACAGAUAA$_{AA-5'}$ (SEQ ID NO: 1920)

βc-3475 Target: 5'-TTGGACCATTTTCTATTTGTCTATTTT-3' (SEQ ID NO: 3029)

5'-AAACUAAUUGGACCAUUUUCUAUUU$^{AC-3'}$ (SEQ ID NO: 6357)
3'-UUUGAUUAACCUGGUAAAAGAUAAA$_{CA-5'}$ (SEQ ID NO: 1921)

βc-3482 Target: 5'-AAACTAATTGGACCATTTTCTATTTGT-3' (SEQ ID NO: 3030)

5'-GAAACUAAUUGGACCAUUUUCUAUU$^{CA-3'}$ (SEQ ID NO: 6358)
3'-CUUUGAUUAACCUGGUAAAAGAUAA$_{AC-5'}$ (SEQ ID NO: 1922)

βc-3483 Target: 5'-GAAACTAATTGGACCATTTTCTATTTG-3' (SEQ ID NO: 3031)

5'-GGAAACUAAUUGGACCAUUUUCUAU$^{CC-3'}$ (SEQ ID NO: 6359)
3'-CCUUUGAUUAACCUGGUAAAAGAUA$_{AA-5'}$ (SEQ ID NO: 1923)

βc-3484 Target: 5'-GGAAACTAATTGGACCATTTTCTATTT-3' (SEQ ID NO: 3032)

5'-AGGAAACUAAUUGGACCAUUUUCUA$^{CC-3'}$ (SEQ ID NO: 6360)
3'-UCCUUUGAUUAACCUGGUAAAAGAU$_{AA-5'}$ (SEQ ID NO: 1924)

βc-3485 Target: 5'-AGGAAACTAATTGGACCATTTTCTATT-3' (SEQ ID NO: 3033)

5'-UUAAAAAGGAAACUAAUUGGACCAU$^{CC-3'}$ (SEQ ID NO: 6361)
3'-AAUUUUUCCUUUGAUUAACCUGGUA$_{AA-5'}$ (SEQ ID NO: 1925)

βc-3491 Target: 5'-TTAAAAGGAAACTAATTGGACCATTT-3' (SEQ ID NO: 3034)

5'-AUUAAAAAGGAAACUAAUUGGACCA$^{CC-3'}$ (SEQ ID NO: 6362)
3'-UAAUUUUUCCUUUGAUUAACCUGGU$_{AA-5'}$ (SEQ ID NO: 1926)

βc-3492 Target: 5'-ATTAAAAGGAAACTAATTGGACCATT-3' (SEQ ID NO: 3035)

5'-AAGCAUAUUAAAAAGGAAACUAAUU$^{AA-3'}$ (SEQ ID NO: 6363)
3'-UUCGUAUAAUUUUUCCUUUGAUUAA$_{C-5'}$ (SEQ ID NO: 1927)

βc-3498 Target: 5'-AAGCATATTAAAAGGAAACTAATTGG-3' (SEQ ID NO: 3036)

5'-UAAGCAUAUUAAAAAGGAAACUAAU$^{CA-3'}$ (SEQ ID NO: 6364)
3'-AUUCGUAUAAUUUUUCCUUUGAUUA$_{AC-5'}$ (SEQ ID NO: 1928)

βc-3499 Target: 5'-TAAGCATATTAAAAGGAAACTAATTG-3' (SEQ ID NO: 3037)

TABLE 12-continued

Additional Selected Anti-β-catenin DsiRNAs, Blunt/Frayed Duplexes

5'-AUUUUAAGCAUAUUAAAAAGGAAAC$^{CC}$-3'    (SEQ ID NO: 6365)
3'-UAAAAUUCGUAUAAUUUUUCCUUUG$_{AU}$-5'    (SEQ ID NO: 1929)

βc-3503 Target: 5'-ATTTTAAGCATATTAAAAAGGAAACTA-3'    (SEQ ID NO: 3038)

5'-CUGCUUAUUUUAAGCAUAUUAAAAA$^{AA}$-3'    (SEQ ID NO: 6366)
3'-GACGAAUAAAAUUCGUAUAAUUUUU$_{CC}$-5'    (SEQ ID NO: 1930)

βc-3509 Target: 5'-CTGCTTATTTTAAGCATATTAAAAGG-3'    (SEQ ID NO: 3039)

5'-CCUGCUUAUUUUAAGCAUAUUAAAA$^{CA}$-3'    (SEQ ID NO: 6367)
3'-GGACGAAUAAAAUUCGUAUAAUUUU$_{UC}$-5'    (SEQ ID NO: 1931)

βc-3510 Target: 5'-CCTGCTTATTTTAAGCATATTAAAAG-3'    (SEQ ID NO: 3040)

5'-GAUCCACCUGCUUAUUUUAAGCAUA$^{CC}$-3'    (SEQ ID NO: 6368)
3'-CUAGGUGGACGAAUAAAAUUCGUAU$_{AA}$-5'    (SEQ ID NO: 1932)

βc-3516 Target: 5'-GATCCACCTGCTTATTTTAAGCATATT-3'    (SEQ ID NO: 3041)

5'-CAAAACAUGAAAUAGAUCCACCUG$^{AC}$-3'    (SEQ ID NO: 6369)
3'-GUUUUUGUACUUUAUCUAGGUGGAC$_{GA}$-5'    (SEQ ID NO: 1933)

βc-3531 Target: 5'-CAAAAACATGAAATAGATCCACCTGCT-3'    (SEQ ID NO: 3042)

5'-UCAAAAACAUGAAAUAGAUCCACCU$^{AA}$-3'    (SEQ ID NO: 6370)
3'-AGUUUUUGUACUUUAUCUAGGUGGA$_{CG}$-5'    (SEQ ID NO: 1934)

βc-3532 Target: 5'-TCAAAAACATGAAATAGATCCACCTGC-3'    (SEQ ID NO: 3043)

5'-GAUCAAAAACAUGAAAUAGAUCCAC$^{AC}$-3'    (SEQ ID NO: 6371)
3'-CUAGUUUUUGUACUUUAUCUAGGUG$_{GA}$-5'    (SEQ ID NO: 1935)

βc-3534 Target: 5'-GATCAAAAACATGAAATAGATCCACCT-3'    (SEQ ID NO: 044)

5'-UGAUCAAAAACAUGAAAUAGAUCCA$^{AA}$-3'    (SEQ ID NO: 6372)
3'-ACUAGUUUUUGUACUUUAUCUAGGU$_{GG}$-5'    (SEQ ID NO: 1936)

βc-3535 Target: 5'-TGATCAAAAACATGAAATAGATCCACC-3'    (SEQ ID NO: 3045)

5'-UUGAUCAAAAACAUGAAAUAGAUCC$^{CA}$-3'    (SEQ ID NO: 6373)
3'-AACUAGUUUUUGUACUUUAUCUAGG$_{UG}$-5'    (SEQ ID NO: 1937)

βc-3536 Target: 5'-TTGATCAAAAACATGAAATAGATCCAC-3'    (SEQ ID NO: 3046)

5'-AGUUUUUGAUCAAAAACAUGAAAUA$^{AC}$-3'    (SEQ ID NO: 6374)
3'-UCAAAAACUAGUUUUUGUACUUUAU$_{CU}$-5'    (SEQ ID NO: 1938)

βc-3541 Target: 5'-AGTTTTTGATCAAAAACATGAAATAGA-3'    (SEQ ID NO: 3047)

5'-CCAAAUAGUUUUUGAUCAAAAACAU$^{AC}$-3'    (SEQ ID NO: 6375)
3'-GGUUUAUCAAAAACUAGUUUUUGUA$_{CU}$-5'    (SEQ ID NO: 1939)

βc-3547 Target: 5'-CCAAATAGTTTTTGATCAAAAACATGA-3'    (SEQ ID NO: 3048)

5'-UAUCCCAAAUAGUUUUUGAUCAAAA$^{CA}$-3'    (SEQ ID NO: 6376)
3'-AUAGGGUUUAUCAAAAACUAGUUUU$_{UG}$-5'    (SEQ ID NO: 1940)

βc-3551 Target: 5'-TATCCCAAATAGTTTTTGATCAAAAC-3'    (SEQ ID NO: 3049)

TABLE 12-continued

Additional Selected Anti-β-catenin DsiRNAs, Blunt/Frayed Duplexes

5'-AUAUCCCAAAUAGUUUUUGAUCAAA$^{CC-3'}$ (SEQ ID NO: 6377)
3'-UAUAGGGUUUAUCAAAAACUAGUUU$_{U-5'}$ (SEQ ID NO: 1941)

βc-3552 Target: 5'-ATATCCCAAATAGTTTTTGATCAAAAA-3' (SEQ ID NO: 3050)

5'-CAUAUCCCAAAUAGUUUUUGAUCAA$^{CC-3'}$ (SEQ ID NO: 6378)
3'-GUAUAGGGUUUAUCAAAAACUAGUU$_{U-5'}$ (SEQ ID NO: 1942)

βc-3553 Target: 5'-CATATCCCAAATAGTTTTTGATCAAAA-3' (SEQ ID NO: 3051)

5'-ACAUAUCCCAAAUAGUUUUUGAUCA$^{CC-3'}$ (SEQ ID NO: 6379)
3'-UGUAUAGGGUUUAUCAAAAACUAGU$_{U-5'}$ (SEQ ID NO: 1943)

βc-3554 Target: 5'-ACATATCCCAAATAGTTTTTGATCAAA-3' (SEQ ID NO: 3052)

5'-CCAUACAUAUCCCAAAUAGUUUUUG$^{CC-3'}$ (SEQ ID NO: 6380)
3'-GGUAUGUAUAGGGUUUAUCAAAAAC$_{U_{A}-5'}$ (SEQ ID NO: 1944)

βc-3558 Target: 5'-CCATACATATCCCAAATAGTTTTTGAT-3' (SEQ IDNO: 3053)

5'-UUACCCUACCCAUACAUAUCCCAAA$^{CC-3'}$ (SEQ ID NO: 6381)
3'-AAUGGGAUGGGUAUGUAUAGGGUUU$_{A_{U}-5'}$ (SEQ ID NO: 1945)

βc-3567 Target: 5'-TTACCCTACCCATACATATCCCAAATA-3' (SEQ ID NO: 3054)

5'-UUUACCCUACCCAUACAUAUCCCAA$^{CC-3'}$ (SEQ ID NO: 6382)
3'-AAAUGGGAUGGGUAUGUAUAGGGUU$_{U_{A}-5'}$ (SEQ ID NO: 1946)

βc-3568 Target: 5'-TTTACCCTACCCATACATATCCCAAAT-3' (SEQ ID NO: 3055)

5'-AUUUACCCUACCCAUACAUAUCCCA$^{CC-3'}$ (SEQ ID NO: 6383)
3'-UAAAUGGGAUGGGUAUGUAUAGGGU$_{U_{U}-5'}$ (SEQ ID NO: 1947)

βc-3569 Target: 5'-ATTTACCCTACCCATACATATCCCAAA-3' (SEQ ID NO: 3056)

5'-ACACCUCUUACUGAUUUACCCUACC$^{AC-3'}$ (SEQ ID NO: 6384)
3'-UGUGGAGAAUGACUAAAUGGGAUGG$_{G_{U}-5'}$ (SEQ ID NO: 1948)

βc-3582 Target: 5'-ACACCTCTTACTGATTTACCCTACCCA-3' (SEQ ID NO: 3057)

5'-UAACACCUCUUACUGAUUUACCCUA$^{AA-3'}$ (SEQ ID NO: 6385)
3'-AUUGUGGAGAAUGACUAAAUGGGAU$_{G_{G}-5'}$ (SEQ ID NO: 1949)

βc-3584 Target: 5'-TAACACCTCTTACTGATTTACCCTACC-3' SEQ ID NO: 3058)

5'-AUAACACCUCUUACUGAUUUACCCU$^{CA-3'}$ (SEQ ID NO: 6386)
3'-UAUUGUGGAGAAUGACUAAAUGGGA$_{U_{G}-5'}$ (SEQ ID NO: 1950)

βc-3585 Target: 5'-ATAACACCTCTTACTGATTTACCCTAC-3' (SEQ ID NO: 3059)

5'-AAUAACACCUCUUACUGAUUUACCC$^{CC-3'}$ (SEQ ID NO: 6387)
3'-UUAUUGUGGAGAAUGACUAAAUGGG$_{A_{U}-5'}$ (SEQ ID NO: 1951)

βc-3586 Target: 5'-AATAACACCTCTTACTGATTTACCCTA-3' (SEQ ID NO: 3060)

5'-AAAUAACACCUCUUACUGAUUUACC$^{AC-3'}$ (SEQ ID NO: 6388)
3'-UUUAUUGUGGAGAAUGACUAAAUGG$_{G_{A}-5'}$ (SEQ ID NO: 1952)

βc-3587 Target: 5'-AAATAACACCTCTTACTGATTTACCCT-3' (SEQ ID NO: 3061)

TABLE 12-continued

Additional Selected Anti-β-catenin DsiRNAs, Blunt/Frayed Duplexes

5'-CAAAUAACACCUCUUACUGAUUUAC$^{AA-3'}$ (SEQ ID NO: 6389)
3'-GUUUAUUGUGGAGAAUGACUAAAUG$_{G-5'}$ (SEQ ID NO: 1953)

βc-3588 Target: 5'-CAAATAACACCTCTTACTGATTTACCC-3' (SEQ ID NO: 3062)

5'-AGGUUCCAAAUAACACCUCUUACUG$^{CC-3'}$ (SEQ ID NO: 6390)
3'-UCCAAGGUUUAUUGUGGAGAAUGAC$_{UA-5'}$ (SEQ ID NO: 1954)

βc-3594 Target: 5'-AGGTTCCAAATAACACCTCTTACTGAT-3' (SEQ ID NO: 3063)

5'-AAAACAAGGUUCCAAAUAACACCUC$^{CC-3'}$ (SEQ ID NO: 6391)
3'-UUUUGUUCCAAGGUUUAUUGUGGAG$_{AA-5'}$ (SEQ ID NO: 1955)

βc-3600 Target: 5'-AAAACAAGGTTCCAAATAACACCTCTT-3' (SEQ ID NO: 3064)

5'-CAAAACAAGGUUCCAAAUAACACCU$^{AC-3'}$ (SEQ ID NO: 6392)
3'-GUUUUGUUCCAAGGUUUAUUGUGGA$_{GA-5'}$ (SEQ ID NO: 1956)

βc-3601 Target: 5'-CAAAACAAGGTTCCAAATAACACCTCT-3' (SEQ ID NO: 3065)

5'-CCAAAACAAGGUUCCAAAUAACACC$^{CA-3'}$ (SEQ ID NO: 6393)
3'-GGUUUUGUUCCAAGGUUUAUUGUGG$_{AG-5'}$ (SEQ ID NO: 1957)

βc-3602 Target: 5'-CCAAAACAAGGTTCCAAATAACACCTC-3' (SEQ ID NO: 3066)

5'-ACUGUCCAAAACAAGGUUCCAAAUA$^{CA-3'}$ (SEQ ID NO: 6394)
3'-UGACAGGUUUUGUUCCAAGGUUUAU$_{UG-5'}$ (SEQ ID NO: 1958)

βc-3607 Target: 5'-ACTGTCCAAAACAAGGTTCCAAATAAC-3' (SEQ ID NO: 3067)

5'-GUAAACUGUCCAAAACAAGGUUCCA$^{CC-3'}$ (SEQ ID NO: 6395)
3'-CAUUUGACAGGUUUUGUUCCAAGGU$_{UU-5'}$ (SEQ ID NO: 1959)

βc-3611 Target: 5'-GTAAACTGTCCAAAACAAGGTTCCAAA-3' (SEQ ID NO: 3068)

5'-GGUAAACUGUCCAAAACAAGGUUCC$^{CC-3'}$ (SEQ ID NO: 6396)
3'-CCAUUUGACAGGUUUUGUUCCAAGG$_{UU-5'}$ (SEQ ID NO: 1960)

βc-3612 Target: 5'-GGTAAACTGTCCAAAACAAGGTTCCAA-3' (SEQ ID NO: 3069)

5'-AGGCAACUGGUAAACUGUCCAAAAC$^{CC-3'}$ (SEQ ID NO: 6397)
3'-UCCGUUGACCAUUUGACAGGUUUUG$_{UU-5'}$ (SEQ ID NO: 1961)

βc-3620 Target: 5'-AGGCAACTGGTAAACTGTCCAAAACAA-3' (SEQ ID NO: 3070)

5'-GGGAUAAAAGGCAACUGGUAAACUG$^{CA-3'}$ (SEQ ID NO: 6398)
3'-CCCUAUUUUCCGUUGACCAUUUGAC$_{AG-5'}$ (SEQ ID NO: 1962)

βc-3628 Target: 5'-GGGATAAAAGGCAACTGGTAAACTGTC-3' (SEQ ID NO: 3071)

5'-UGGGAUAAAAGGCAACUGGUAAACU$^{AC-3'}$ (SEQ ID NO: 6399)
3'-ACCCUAUUUUCCGUUGACCAUUUGA$_{CA-5'}$ (SEQ ID NO: 1963)

βc-3629 Target: 5'-TGGGATAAAAGGCAACTGGTAAACTGT-3' (SEQ ID NO: 3072)

5'-ACAACUUUGGGAUAAAAGGCAACUG$^{AC-3'}$ (SEQ ID NO: 6400)
3'-UGUUGAAACCCUAUUUUCCGUUGAC$_{CA-5'}$ (SEQ ID NO: 1964)

βc-3636 Target: 5'-ACAACTTTGGGATAAAAGGCAACTGGT-3' (SEQ ID NO: 3073)

TABLE 12-continued

Additional Selected Anti-β-catenin DsiRNAs, Blunt/Frayed Duplexes

5'-CAACAACUUUGGGAUAAAAGGCAAC$^{CA}$-3'  (SEQ ID NO: 6401)
3'-GUUGUUGAAACCCUAUUUUCCGUUG$_{AC}$-5'  (SEQ ID NO: 1965)

βc-3638 Target: 5'-CAACAACTTTGGGATAAAAGGCAACTG-3' (SEQ ID NO: 3074)

5'-GGUUACAACAACUUUGGGAUAAAAG$^{AA}$-3'  (SEQ ID NO: 6402)
3'-CCAAUGUUGUUGAAACCCUAUUUUC$_{CG}$-5'  (SEQ ID NO: 1966)

βc-3643 Target: 5'-GGTTACAACAACTTTGGGATAAAAGGC-3' (SEQ ID NO: 3075)

5'-AGGUUACAACAACUUUGGGAUAAAA$^{AA}$-3'  (SEQ ID NO: 6403)
3'-UCCAAUGUUGUUGAAACCCUAUUUU$_{CC}$-5'  (SEQ ID NO: 1967)

βc-3644 Target: 5'-AGGTTACAACAACTTTGGGATAAAAGG-3' (SEQ ID NO: 3076)

5'-CAGGUUACAACAACUUUGGGAUAAA$^{CA}$-3'  (SEQ ID NO: 6404)
3'-GUCCAAUGUUGUUGAAACCCUAUUU$_{UC}$-5'  (SEQ ID NO: 1968)

βc-3645 Target: 5'-CAGGTTACAACAACTTTGGGATAAAAG-3' (SEQ ID NO: 3077)

5'-UAUCACAGCAGGUUACAACAACUUU$^{AA}$-3'  (SEQ ID NO: 6405)
3'-AUAGUGUCGUCCAAUGUUGUUGAAA$_{CC}$-5'  (SEQ ID NO: 1969)

βc-3653 Target: 5'-TATCACAGCAGGTTACAACAACTTTGG-3' (SEQ ID NO: 3078)

5'-GUAUCACAGCAGGUUACAACAACUU$^{CA}$-3'  (SEQ ID NO: 6406)
3'-CAUAGUGUCGUCCAAUGUUGUUGAA$_{AC}$-5'  (SEQ ID NO: 1970)

βc-3654 Target: 5'-GTATCACAGCAGGTTACAACAACTTTG-3' (SEQ ID NO: 3079)

5'-UCGUAUCACAGCAGGUUACAACAAC$^{CC}$-3'  (SEQ ID NO: 6407)
3'-AGCAUAGUGUCGUCCAAUGUUGUUG$_{AA}$-5'  (SEQ ID NO: 1971)

βc-3656 Target: 5'-TCGTATCACAGCAGGTTACAACAACTT-3' (SEQ ID NO: 3080)

5'-UUUCUCUUGAAGCAUCGUAUCACAG$^{AC}$-3'  (SEQ ID NO: 6408)
3'-AAAGAGAACUUCGUAGCAUAGUGUC$_{GU}$-5'  (SEQ ID NO: 1972)

βc-3670 Target: 5'-TTTCTCTTGAAGCATCGTATCACAGCA-3' (SEQ ID NO: 3081)

5'-UUUUCUCUUGAAGCAUCGUAUCACA$^{AA}$-3'  (SEQ ID NO: 6409)
3'-AAAAGAGAACUUCGUAGCAUAGUGU$_{CG}$-5'  (SEQ ID NO: 1973)

βc-3671 Target: 5'-TTTTCTCTTGAAGCATCGTATCACAGC-3' (SEQ ID NO: 3082)

5'-CAUUUUCUCUUGAAGCAUCGUAUCA$^{AC}$-3'  (SEQ ID NO: 6410)
3'-GUAAAAGAGAACUUCGUAGCAUAGU$_{GU}$-5'  (SEQ ID NO: 1974)

βc-3673 Target: 5'-CATTTTCTCTTGAAGCATCGTATCACA-3' (SEQ ID NO: 3083)

5'-UUUUUUAUAACCGCAUUUUCUCUUG$^{CC}$-3'  (SEQ ID NO: 6411)
3'-AAAAAAUAUUGGCGUAAAAGAGAAC$_{UU}$-5'  (SEQ ID NO: 1975)

βc-3686 Target: 5'-TTTTTTATAACCGCATTTTCTCTTGAA-3' (SEQ ID NO: 3084)

5'-AUUUUUUAUAACCGCAUUUUCUCUU$^{AC}$-3'  (SEQ ID NO: 6412)
3'-UAAAAAAUAUUGGCGUAAAAGAGAA$_{CU}$-5'  (SEQ ID NO: 1976)

βc-3687 Target: 5'-ATTTTTTATAACCGCATTTTCTCTTGA-3' (SEQ ID NO: 3085)

TABLE 12-continued

Additional Selected Anti-β-catenin DsiRNAs, Blunt/Frayed Duplexes

5'-CAUUUUUUAUAACCGCAUUUUCUCU<sup>CA-3'</sup> (SEQ ID NO: 6413)
3'-GUAAAAAAUAUUGGCGUAAAAGAGA<sub>AC-5'</sub> (SEQ ID NO: 1977)

βc-3688 Target: 5'-CATTTTTTATAACCGCATTTTCTCTTG-3' (SEQ ID NO: 3086)

5'-CCAUUUUUUAUAACCGCAUUUUCUC<sup>CC-3'</sup> (SEQ ID NO: 6414)
3'-GGUAAAAAAUAUUGGCGUAAAAGAG<sub>AA-5'</sub> (SEQ ID NO: 1978)

βc-3689 Target: 5'-CCATTTTTTATAACCGCATTTTCTCTT-3' (SEQ ID NO: 3087)

5'-CUGAACCAUUUUUUAUAACCGCAUU<sup>CC-3'</sup> (SEQ ID NO: 6415)
3'-GACUUGGUAAAAAAUAUUGGCGUAA<sub>AA-5'</sub> (SEQ ID NO: 1979)

βc-3694 Target: 5'-CTGAACCATTTTTTATAACCGCATTT-3' (SEQ ID NO: 3088)

5'-UAAUUCUGAACCAUUUUUUAUAACC<sup>AA-3'</sup> (SEQ ID NO: 6416)
3'-AUUAAGACUUGGUAAAAAAUAUUGG<sub>CG-5'</sub> (SEQ ID NO: 1980)

βc-3699 Target: 5'-TAATTCTGAACCATTTTTTATAACCGC-3' (SEQ ID NO: 3089)

5'-UUAAUUCUGAACCAUUUUUUAUAAC<sup>AA-3'</sup> (SEQ ID NO: 6417)
3'-AAUUAAGACUUGGUAAAAAAUAUUG<sub>GC-5'</sub> (SEQ ID NO: 1981)

βc-3700 Target: 5'-TTAATTCTGAACCATTTTTTATAACCG-3' (SEQ ID NO: 3090)

5'-UUUAAUUCUGAACCAUUUUUUAUAA<sup>AA-3'</sup> (SEQ ID NO: 6418)
3'-AAAUUAAGACUUGGUAAAAAAUAUU<sub>GG-5'</sub> (SEQ ID NO: 1982)

βc-3701 Target: 5'-TTTAATTCTGAACCATTTTTTATAACC-3' (SEQ ID NO: 3091)

5'-GUUUAAUUCUGAACCAUUUUUUAUA<sup>CA-3'</sup> (SEQ ID NO: 6419)
3'-CAAAUUAAGACUUGGUAAAAAAUAU<sub>UG-5'</sub> (SEQ ID NO: 1983)

βc-3702 Target: 5'-GTTTAATTCTGAACCATTTTTTATAAC-3' (SEQ ID NO: 3092)

5'-AGUUUAAUUCUGAACCAUUUUUUAU<sup>CC-3'</sup> (SEQ ID NO: 6420)
3'-UCAAAUUAAGACUUGGUAAAAAAUA<sub>UU-5'</sub> (SEQ ID NO: 1984)

βc-3703 Target: 5'-AGTTTAATTCTGAACCATTTTTTATAA-3' (SEQ ID NO: 3093)

5'-AAGUUUAAUUCUGAACCAUUUUUUA<sup>CC-3'</sup> (SEQ ID NO: 6421)
3'-UUCAAAUUAAGACUUGGUAAAAAAU<sub>AU-5'</sub> (SEQ ID NO: 1985)

βc-3704 Target: 5'-AAGTTTAATTCTGAACCATTTTTTATA-3' (SEQ ID NO: 3094)

5'-AUUAAAAGUUUAAUUCUGAACCAUU<sup>CC-3'</sup> (SEQ ID NO: 6422)
3'-UAAUUUUCAAAUUAAGACUUGGUAA<sub>AA-5'</sub> (SEQ ID NO: 1986)

βc-3709 Target: 5'-ATTAAAAGTTTAATTCTGAACCATTT-3' (SEQ ID NO: 3095)

5'-AAUUAAAAGUUUAAUUCUGAACCAU<sup>CC-3'</sup> (SEQ ID NO: 6423)
3'-UUAAUUUUCAAAUUAAGACUUGGUA<sub>AA-5'</sub> (SEQ ID NO: 1987)

βc-3710 Target: 5'-AATTAAAAGTTTAATTCTGAACCATTT-3' (SEQ ID NO: 3096)

5'-UGAAUUAAAAGUUUAAUUCUGAACC<sup>CC-3'</sup> (SEQ ID NO: 6424)
3'-ACUUAAUUUUCAAAUUAAGACUUGG<sub>UA-5'</sub> (SEQ ID NO: 1988)

βc-3712 Target: 5'-TGAATTAAAAGTTTAATTCTGAACC-3' (SEQ ID NO: 3097)

TABLE 12-continued

Additional Selected Anti-β-catenin DsiRNAs, Blunt/Frayed Duplexes

5'-CAAUACAGCUAAAGGAUGAUUUACA$^{AA}$-3' (SEQ ID NO: 6425)
3'-GUUAUGUCGAUUUCCUACUAAAUGU$_{CC}$-5' (SEQ ID NO: 1989)

βc-2634t2 Target: 5'-CAATACAGCTAAAGGATGATTTACAGG-3' (SEQ ID NO: 3098)

5'-ACAAUACAGCUAAAGGAUGAUUUAC$^{CA}$-3' (SEQ ID NO: 6426)
3'-UGUUAUGUCGAUUUCCUACUAAAUG$_{UC}$-5' (SEQ ID NO: 1990)

βc-2635t2 Target: 5'-ACAATACAGCTAAAGGATGATTTACAG-3' (SEQ ID NO: 3099)

5'-AGACAAUACAGCUAAAGGAUGAUUU$^{CA}$-3' (SEQ ID NO: 6427)
3'-UCUGUUAUGUCGAUUUCCUACUAAA$_{UG}$-5' (SEQ ID NO: 1991)

βc-2637t2 Target: 5'-AGACAATACAGCTAAAGGATGATTTAC-3' (SEQ ID NO: 3100)

5'-GUUACUCCUAAAGGAUGAUUUACAG$^{AC}$-3' (SEQ ID NO: 6428)
3'-CAAUGAGGAUUUCCUACUAAAUGUC$_{CA}$-5' (SEQ ID NO: 1992)

βc-2633t3 Target: 5'-GTTACTCCTAAAGGATGATTTACAGGT-3' (SEQ ID NO: 3101)

5'-UGUUACUCCUAAAGGAUGAUUUACA$^{AA}$-3' (SEQ ID NO: 6429)
3'-ACAAUGAGGAUUUCCUACUAAAUGU$_{CC}$-5' (SEQ ID NO: 1993)

βc-2634t3 Target: 5'-TGTTACTCCTAAAGGATGATTTACAGG-3' (SEQ ID NO: 3102)

5'-UUGUUACUCCUAAAGGAUGAUUUAC$^{CA}$-3' (SEQ ID NO: 6430)
3'-AACAAUGAGGAUUUCCUACUAAAUG$_{UC}$-5' (SEQ ID NO: 1994)

βc-2635t3 Target: 5'-TTGTTACTCCTAAAGGATGATTTACAG-3' (SEQ ID NO: 3103)

5'-AUUGUUACUCCUAAAGGAUGAUUUA$^{AC}$-3' (SEQ ID NO: 6431)
3'-UAACAAUGAGGAUUUCCUACUAAAU$_{GU}$-5' (SEQ ID NO: 1995)

βc-2636t3 Target: 5'-ATTGTTACTCCTAAAGGATGATTTACA-3' (SEQ ID NO: 3104)

5'-GGAUUCCAGAAUCCAAGUAAGACUG$^{AC}$-3' (SEQ ID NO: 6432)
3'-CCUAAGGUCUUAGGUUCAUUCUGAC$_{GA}$-5' (SEQ ID NO: 1996)

βc-m318 Target: 5'-GGATTCCAGAATCCAAGTAAGACTGCT-3' (SEQ ID NO: 3105)

5'-CUUGCUCCCAUUCAUAAAGGACUUG$^{AA}$-3' (SEQ ID NO: 6433)
3'-GAACGAGGGUAAGUAUUUCCUGAAC$_{CC}$-5' (SEQ ID NO: 1997)

βc-m417 Target: 5'-CTTGCTCCCATTCATAAAGGACTTGGG-3' (SEQ ID NO: 3106)

5'-CGUCAAUAUCAGCUACUUGCUCUUG$^{AA}$-3' (SEQ ID NO: 6434)
3'-GCAGUUAUAGUCGAUGAACGAGAAC$_{GC}$-5' (SEQ ID NO: 1998)

βc-m462 Target: 5'-CGTCAATATCAGCTACTTGCTCTTGCG-3' (SEQ ID NO: 3107)

5'-CCGUCAAUAUCAGCUACUUGCUCUU$^{AA}$-3' (SEQ ID NO: 6435)
3'-GGCAGUUAUAGUCGAUGAACGAGAA$_{CG}$-5' (SEQ ID NO: 1999)

βc-m463 Target: 5'-CCGTCAATATCAGCTACTTGCTCTTGC-3' (SEQ ID NO: 3108)

5'-ACUGCCCGUCAAUAUCAGCUACUUG$^{AC}$-3' (SEQ ID NO: 6436)
3'-UGACGGGCAGUUAUAGUCGAUGAAC$_{GA}$-5' (SEQ ID NO: 2000)

βc-m468 Target: 5'-ACTGCCCGTCAATATCAGCTACTTGCT-3' (SEQ ID NO: 3109)

TABLE 12-continued

Additional Selected Anti-β-catenin DsiRNAs, Blunt/Frayed Duplexes

5'-UGUUUCAACAUCUGUGAUGGUUCAG$^{AA\text{-}3'}$ (SEQ ID NO: 6437)
3'-ACAAAGUUGUAGACACUACCAAGUC$_{G\text{-}5'}$ (SEQ ID NO: 2001)

βc-m613 Target: 5'-TGTTTCAACATCTGTGATGGTTCAGCC-3' (SEQ ID NO: 3110)

5'-AUGUUUCAACAUCUGUGAUGGUUCA$^{AA\text{-}3'}$ (SEQ ID NO: 6438)
3'-UACAAAGUUGUAGACACUACCAAGU$_{C G\text{-}5'}$ (SEQ ID NO: 2002)

βc-m614 Target: 5'-ATGTTTCAACATCTGTGATGGTTCAGC-3' (SEQ ID NO: 3111)

5'-UGACAACUGCAUGUUUCAACAUCUG$^{CA\text{-}3'}$ (SEQ ID NO: 6439)
3'-ACUGUUGACGUACAAAGUUGUAGAC$_{A C\text{-}5'}$ (SEQ ID NO: 2003)

βc-m624 Target: 5'-TGACAACTGCATGTTTCAACATCTGTG-3' (SEQ ID NO: 3112)

5'-AUUGACAACUGCAUGUUUCAACAUC$^{CA\text{-}3'}$ (SEQ ID NO: 6440)
3'-UAACUGUUGACGUACAAAGUUGUAG$_{A C\text{-}5'}$ (SEQ ID NO: 2004)

βc-m626 Target: 5'-ATTGACAACTGCATGTTTCAACATCTG-3' (SEQ ID NO: 3113)

5'-UCAAAUUGACAACUGCAUGUUUCAA$^{AC\text{-}3'}$ (SEQ ID NO: 6441)
3'-AGUUUAACUGUUGACGUACAAAGUU$_{G U\text{-}5'}$ (SEQ ID NO: 2005)

βc-m630 Target: 5'-TCAAATTGACAACTGCATGTTTCAACA-3' (SEQ ID NO: 3114)

5'-AGUUAAUCAAAUUGACAACUGCAUG$^{CC\text{-}3'}$ (SEQ ID NO: 6442)
3'-UCAAUUAGUUUAACUGUUGACGUAC$_{A\text{-}5'}$ (SEQ ID NO: 2006)

βc-m636 Target: 5'-AGTTAATCAAATTGACAACTGCATGTT-3' (SEQ ID NO: 3115)

5'-CCUGAUAGUUAAUCAAAUUGACAAC$^{CA\text{-}3'}$ (SEQ ID NO: 6443)
3'-GGACUAUCAAUUAGUUUAACUGUUG$_{A C\text{-}5'}$ (SEQ ID NO: 2007)

βc-m642 Target: 5'-CCTGATAGTTAATCAAATTGACAACTG-3' (SEQ ID NO: 3116)

5'-CGUCAUCCUGAUAGUUAAUCAAAUU$^{AC\text{-}3'}$ (SEQ ID NO: 6444)
3'-GCAGUAGGACUAUCAAUUAGUUUAA$_{C U\text{-}5'}$ (SEQ ID NO: 2008)

βc-m648 Target: 5'-CGTCATCCTGATAGTTAATCAAATTGA-3' (SEQ ID NO: 3117)

5'-GCGUCAUCCUGAUAGUUAAUCAAAU$^{CA\text{-}3'}$ (SEQ ID NO: 6445)
3'-CGCAGUAGGACUAUCAAUUAGUUUA$_{A C\text{-}5'}$ (SEQ ID NO: 2009)

βc-m649 Target: 5'-GCGTCATCCTGATAGTTAATCAAATTG-3' (SEQ ID NO: 3118)

5'-CCUCAUCGUUUAGCAGUUUUGUCAG$^{AC\text{-}3'}$ (SEQ ID NO: 6446)
3'-GGAGUAGCAAAUCGUCAAAACAGUC$_{G A\text{-}5'}$ (SEQ ID NO: 2010)

βc-m702 Target: 5'-CCTCATCGTTTAGCAGTTTTGTCAGCT-3' (SEQ ID NO: 3119)

5'-CUGGUCCUCAUCGUUUAGCAGUUUU$^{AC\text{-}3'}$ (SEQ ID NO: 6447)
3'-GACCAGGAGUAGCAAAUCGUCAAAA$_{C A\text{-}5'}$ (SEQ ID NO: 2011)

βc-m707 Target: 5'-CTGGTCCTCATCGTTTAGCAGTTTTGT-3' (SEQ ID NO: 3120)

5'-CAUAACAGCAGCUUUAUUAACUACC$^{CA\text{-}3'}$ (SEQ ID NO: 6448)
3'-GUAUUGUCGUCGAAAUAAUUGAUGG$_{U G\text{-}5'}$ (SEQ ID NO: 2012)

βc-m734 Target: 5'-CATAACAGCAGCTTTATTAACTACCAC-3' (SEQ ID NO: 3121)

TABLE 12-continued

Additional Selected Anti-β-catenin DsiRNAs, Blunt/Frayed Duplexes

5'-CCAUAACAGCAGCUUUAUUAACUAC$^{AC-3'}$ (SEQ ID NO: 6449)
3'-GGUAUUGUCGUCGAAAUAAUUGAUG$_{GU-5'}$ (SEQ ID NO: 2013)

βc-m735 Target: 5'-CCATAACAGCAGCTTTATTAACTACCA-3' (SEQ ID NO: 3122)

5'-GGACCAUAACAGCAGCUUUAUUAAC$^{CC-3'}$ (SEQ ID NO: 6450)
3'-CCUGGUAUUGUCGUCGAAAUAAUUG$_{AU-5'}$ (SEQ ID NO: 2014)

βc-m738 Target: 5'-GGACCATAACAGCAGCTTTATTAACTA-3' (SEQ ID NO: 3123)

5'-UGGACCAUAACAGCAGCUUUAUUAA$^{AC-3'}$ (SEQ ID NO: 6451)
3'-ACCUGGUAUUGUCGUCGAAAUAAUU$_{GA-5'}$ (SEQ ID NO: 2015)

βc-m739 Target: 5'-TGGACCATAACAGCAGCTTTATTAACT-3' (SEQ ID NO: 3124)

5'-CUGUCUCUACAUCAUUUGUAUUCUG$^{AC-3'}$ (SEQ ID NO: 6452)
3'-GACAGAGAUGUAGUAAACAUAAGAC$_{GU-5'}$ (SEQ ID NO: 2016)

βc-m843 Target: 5'-CTGTCTCTACATCATTTGTATTCTGCA-3' (SEQ ID NO: 3125)

5'-GCUGUCUCUACAUCAUUUGUAUUCU$^{AA-3'}$ (SEQ ID NO: 6453)
3'-CGACAGAGAUGUAGUAAACAUAAGA$_{CG-5'}$ (SEQ ID NO: 2017)

βc-m844 Target: 5'-GCTGTCTCTACATCATTTGTATTCTGC-3' (SEQ ID NO: 3126)

5'-GCAACCAUUUUCUGCAGUCCACCAG$^{AC-3'}$ (SEQ ID NO: 6454)
3'-CGUUGGUAAAAGACGUCAGGUGGUC$_{GA-5'}$ (SEQ ID NO: 2018)

βc-m1063 Target: 5'-GCAACCATTTTCTGCAGTCCACCAGCT-3' (SEQ ID NO: 3127)

5'-AAGCAACCAUUUUCUGCAGUCCACC$^{CA-3'}$ (SEQ ID NO: 6455)
3'-UUCGUUGGUAAAAGACGUCAGGUGG$_{UC-5'}$ (SEQ ID NO: 2019)

βc-m1065 Target: 5'-AAGCAACCATTTTCTGCAGTCCACCAG-3' (SEQ ID NO: 3128)

5'-UUGUUUUGUUGAGCAAAGCAACCAU$^{CC-3'}$ (SEQ ID NO: 6456)
3'-AACAAAACAACUCGUUUCGUUGGUA$_{AA-5'}$ (SEQ ID NO: 2020)

βc-m1080 Target: 5'-TTGTTTTGTTGAGCAAAGCAACCATTT-3' (SEQ ID NO: 3129)

5'-UUUGUUUUGUUGAGCAAAGCAACCA$^{CC-3'}$ (SEQ ID NO: 6457)
3'-AAACAAAACAACUCGUUUCGUUGGU$_{AA-5'}$ (SEQ ID NO: 2021)

βc-m1081 Target: 5'-TTTGTTTTGTTGAGCAAAGCAACCATT-3' (SEQ ID NO: 3130)

5'-UAGCCAAGAAUUUCACGUUUGUUUU$^{AC-3'}$ (SEQ ID NO: 6458)
3'-AUCGGUUCUUAAAGUGCAAACAAAA$_{CA-5'}$ (SEQ ID NO: 2022)

βc-m1098 Target: 5'-TAGCCAAGAATTTCACGTTTGTTTTGT-3' (SEQ ID NO: 3131)

5'-CUUGAUUGCCAUAAGCUAAGAUCUG$^{CC-3'}$ (SEQ ID NO: 6459)
3'-GAACUAACGGUAUUCGAUUCUAGAC$_{UU-5'}$ (SEQ ID NO: 2023)

βc-m1140 Target: 5'-CTTGATTGCCATAAGCTAAGATCTGAA-3' (SEQ ID NO: 3132)

5'-GCUCUCUUGAUUGCCAUAAGCUAAG$^{CC-3'}$ (SEQ ID NO: 6460)
3'-CGAGAGAACUAACGGUAUUCGAUUC$_{UA-5'}$ (SEQ ID NO: 2024)

βc-m1145 Target: 5'-GCTCTCTTGATTGCCATAAGCTAAGAT-3' (SEQ ID NO: 3133)

TABLE 12-continued

Additional Selected Anti-β-catenin DsiRNAs, Blunt/Frayed Duplexes

5'-CUUCUCAUAAGUGUAGGUCCUCAUU$^{CC\text{-}3'}$ (SEQ ID NO: 6461)
3'-GAAGAGUAUUCACAUCCAGGAGUAA$_{UA\text{-}5'}$ (SEQ ID NO: 2025)

βc-m1217 Target: 5'-CTTCTCATAAGTGTAGGTCCTCATTAT-3' (SEQ ID NO: 3134)

5'-GCUUCUCAUAAGUGUAGGUCCUCAU$^{CC\text{-}3'}$ (SEQ ID NO: 6462)
3'-CGAAGAGUAUUCACAUCCAGGAGUA$_{AU\text{-}5'}$ (SEQ ID NO: 2026)

βc-m1218 Target: 5'-GCTTCTCATAAGTGTAGGTCCTCATTA-3' (SEQ ID NO: 3135)

5'-AAGCUUCUCAUAAGUGUAGGUCCUC$^{CC\text{-}3'}$ (SEQ ID NO: 6463)
3'-UUCGAAGAGUAUUCACAUCCAGGAG$_{UA\text{-}5'}$ (SEQ ID NO: 2027)

βc-m1220 Target: 5'-AAGCTTCTCATAAGTGTAGGTCCTC-3' (SEQ ID NO: 3136)

5'-GAAGCUUCUCAUAAGUGUAGGUCCU$^{AC\text{-}3'}$ (SEQ ID NO: 6464)
3'-CUUCGAAGAGUAUUCACAUCCAGGA$_{GU\text{-}5'}$ (SEQ ID NO: 2028)

βc-m1221 Target: 5'-GAAGCTTCTCATAAGTGTAGGTCCTCA-3' (SEQ ID NO: 3137)

5'-GAGUCCAAAGACAGUUUUGAACAAG$^{CA\text{-}3'}$ (SEQ ID NO: 6465)
3'-CUCAGGUUUCUGUCAAAACUUGUUC$_{AG\text{-}5'}$ (SEQ ID NO: 2029)

βc-m1365 Target: 5'-GAGTCCAAAGACAGTTTTGAACAAGTC-3' (SEQ ID NO: 3138)

5'-AGAGUCCAAAGACAGUUUUGAACAA$^{AC\text{-}3'}$ (SEQ ID NO: 6466)
3'-UCUCAGGUUUCUGUCAAAACUUGUU$_{CA\text{-}5'}$ (SEQ ID NO: 2030)

βc-m1366 Target: 5'-AGAGTCCAAAGACAGTTTTGAACAAGT-3' (SEQ ID NO: 3139)

5'-CCACAUUUAUAUCAUCGGAACCCAG$^{CC\text{-}3'}$ (SEQ ID NO: 6467)
3'-GGUGUAAAUAUAGUAGCCUUGGGUC$_{UU\text{-}5'}$ (SEQ ID NO: 2031)

βc-m1461 Target: 5'-CCACATTTATATCATCGGAACCCAGAA-3' (SEQ ID NO: 3140)

5'-UGACCACAUUUAUAUCAUCGGAACC$^{AC\text{-}3'}$ (SEQ ID NO: 6468)
3'-ACUGGUGUAAAUAUAGUAGCCUUGG$_{GU\text{-}5'}$ (SEQ ID NO: 2032)

βc-m1464 Target: 5'-TGACCACATTTATATCATCGGAACCCA-3' (SEQ ID NO: 3141)

5'-CUGCACAGGUGACCACAUUUAUAUC$^{CC\text{-}3'}$ (SEQ ID NO: 6469)
3'-GACGUGUCCACUGGUGUAAAUAUAG$_{UA\text{-}5'}$ (SEQ ID NO: 2033)

βc-m1473 Target: 5'-CTGCACAGGTGACCACATTTATATC-3' (SEQ ID NO: 3142)

5'-GCUGCACAGGUGACCACAUUUAUAU$^{AC\text{-}3'}$ (SEQ ID NO: 6470)
3'-CGACGUGUCCACUGGUGUAAAUAUA$_{GU\text{-}5'}$ (SEQ ID NO: 2034)

βc-m1474 Target: 5'-GCTGCACAGGTGACCACATTTATATCA-3' (SEQ ID NO: 3143)

5'-UUGUAAUUAUUGCAAGUGAGGUUAG$^{CA\text{-}3'}$ (SEQ ID NO: 6471)
3'-AACAUUAAUAACGUUCACUCCAAUC$_{UC\text{-}5'}$ (SEQ ID NO: 2035)

βc-m1510 Target: 5'-TTGTAATTATTGCAAGTGAGGTTAGAG-3' (SEQ ID NO: 3144)

5'-CAUCAUCUUGUUUUUGUAAUUAUUG$^{AC\text{-}3'}$ (SEQ ID NO: 6472)
3'-GUAGUAGAACAAAAACAUUAAUAAC$_{GU\text{-}5'}$ (SEQ ID NO: 2036)

βc-m1523 Target: 5'-CATCATCTTGTTTTTGTAATTATTGCA-3' (SEQ ID NO: 3145)

TABLE 12-continued

Additional Selected Anti-β-catenin DsiRNAs, Blunt/Frayed Duplexes

5'-CCAUCAUCUUGUUUUUGUAAUUAUU$^{AA}$-3' (SEQ ID NO: 6473)
3'-GGUAGUAGAACAAAAACAUUAAUAA$_{CG}$-5' (SEQ ID NO: 2037)

βc-m1524 Target: 5'-CCATCATCTTGTTTTTGTAATTATTGC-3' (SEQ ID NO: 3146)

5'-ACACCAUCAUCUUGUUUUUGUAAUU$^{CC}$-3' (SEQ ID NO: 6474)
3'-UGUGGUAGUAGAACAAAAACAUUAA$_{UA}$-5' (SEQ ID NO: 2038)

βc-m1527 Target: 5'-ACACCATCATCTTGTTTTTGTAATTAT-3' (SEQ ID NO: 3147)

5'-UUGGCACACCAUCAUCUUGUUUUUG$^{CC}$-3' (SEQ ID NO: 6475)
3'-AACCGUGUGGUAGUAGAACAAAAAC$_{AU}$-5' (SEQ ID NO: 2039)

βc-m1532 Target: 5'-TTGGCACACCATCATCTTGTTTTTGTA-3' (SEQ ID NO: 3148)

5'-UCAAUCCAACAGUUGCCUUUAUCAG$^{CA}$-3' (SEQ ID NO: 6476)
3'-AGUUAGGUUGUCAACGGAAAUAGUC$_{UC}$-5' (SEQ ID NO: 2040)

βc-m1752 Target: 5'-TCAATCCAACAGTTGCCTTTATCAGAG-3' (SEQ ID NO: 3149)

5'-UCGAAUCAAUCCAACAGUUGCCUUU$^{CC}$-3' (SEQ ID NO: 6477)
3'-AGCUUAGUUAGGUUGUCAACGGAAA$_{UA}$-5' (SEQ ID NO: 2041)

βc-m1757 Target: 5'-TCGAATCAATCCAACAGTTGCCTTTAT-3' (SEQ ID NO: 3150)

5'-GCUGAACUAGUCGUGGAAUAGCACC$^{AC}$-3' (SEQ ID NO: 6478)
3'-CGACUUGAUCAGCACCUUAUCGUGG$_{GA}$-5' (SEQ ID NO: 2042)

βc-m1827 Target: 5'-GCTGAACTAGTCGTGGAATAGCACCCT-3' (SEQ ID NO: 3151)

5'-AGUACACCCUUCUACUAUCUCCUCC$^{CC}$-3' (SEQ ID NO: 6479)
3'-UCAUGUGGGAAGAUGAUAGAGGAGG$_{UA}$-5' (SEQ ID NO: 2043)

βc-m1934 Target: 5'-AGTACACCCTTCTACTATCTCCTCC-3' (SEQ ID NO: 3152)

5'-CAGUACACCCUUCUACUAUCUCCUC$^{AC}$-3' (SEQ ID NO: 6480)
3'-GUCAUGUGGGAAGAUGAUAGAGGAG$_{GU}$-5' (SEQ ID NO: 2044)

βc-m1935 Target: 5'-CAGTACACCCTTCTACTATCTCCTCCA-3' (SEQ ID NO: 3153)

5'-CCAGUACACCCUUCUACUAUCUCCU$^{AA}$-3' (SEQ ID NO: 6481)
3'-GGUCAUGUGGGAAGAUGAUAGAGGA$_{GG}$-5' (SEQ ID NO: 2045)

βc-m1936 Target: 5'-CCAGTACACCCTTCTACTATCTCCTCC-3' (SEQ ID NO: 3154)

5'-GAGCUCCAGUACACCCUUCUACUAU$^{AC}$-3' (SEQ ID NO: 6482)
3'-CUCGAGGUCAUGUGGGAAGAUGAUA$_{GA}$-5' (SEQ ID NO: 2046)

βc-m1941 Target: 5'-GAGCTCCAGTACACCCTTCTACTATCT-3' (SEQ ID NO: 3155)

5'-AAACAAUGGAAUGGUAUUGAGUCCU$^{AA}$-3' (SEQ ID NO: 6483)
3'-UUUGUUACCUUACCAUAACUCAGGA$_{GC}$-5' (SEQ ID NO: 2047)

βc-m2009 Target: 5'-AAACAATGGAATGGTATTGAGTCCTCG-3' (SEQ ID NO: 3156)

5'-CUGCACAAACAAUGGAAUGGUAUUG$^{CA}$-3' (SEQ ID NO: 6484)
3'-GACGUGUUUGUUACCUUACCAUAAC$_{UC}$-5' (SEQ ID NO: 2048)

βc-m2015 Target: 5'-CTGCACAAACAATGGAATGGTATTGAG-3' (SEQ ID NO: 3157)

TABLE 12-continued

Additional Selected Anti-β-catenin DsiRNAs, Blunt/Frayed Duplexes

5'-ACUGCACAAACAAUGGAAUGGUAUU<sup>AC-3'</sup> (SEQ ID NO: 6485)
3'-UGACGUGUUUGUUACCUUACCAUAA<sub>CU-5'</sub> (SEQ ID NO: 2049)

βc-m2016 Target: 5'-ACTGCACAAACAATGGAATGGTATTGA-3' (SEQ ID NO: 3158)

5'-AAGCAACUGCACAAACAAUGGAAUG<sup>AC-3'</sup> (SEQ ID NO: 6486)
3'-UUCGUUGACGUGUUUGUUACCUUAC<sub>A-5'</sub> (SEQ ID NO: 2050)

βc-m2021 Target: 5'-AAGCAACTGCACAAACAATGGAATGGT-3' (SEQ ID NO: 3159)

5'-GAGAAUAAAGCAACUGCACAAACAA<sup>CA-3'</sup> (SEQ ID NO: 6487)
3'-CUCUUAUUUCGUUGACGUGUUUGUU<sub>AC-5'</sub> (SEQ ID NO: 2051)

βc-m2028 Target: 5'-GAGAATAAAGCAACTGCACAAACAATG-3' (SEQ ID NO: 3160)

5'-UUUCAAUGGGAGAAUAAAGCAACUG<sup>AC-3'</sup> (SEQ ID NO: 6488)
3'-AAAGUUACCCUCUUAUUUCGUUGAC<sub>GU-5'</sub> (SEQ ID NO: 2052)

βc-m2037 Target: 5'-TTTCAATGGGAGAATAAAGCAACTGCA-3' (SEQ ID NO: 3161)

5'-UUUUCAAUGGGAGAAUAAAGCAACU<sup>AA-3'</sup> (SEQ ID NO: 6489)
3'-AAAAGUUACCCUCUUAUUUCGUUGA<sub>CG-5'</sub> (SEQ ID NO: 2053)

βc-m2038 Target: 5'-TTTTCAATGGGAGAATAAAGCAACTGC-3' (SEQ ID NO: 3162)

5'-AUUUUCAAUGGGAGAAUAAAGCAAC<sup>CA-3'</sup> (SEQ ID NO: 6490)
3'-UAAAAGUUACCCUCUUAUUUCGUUG<sub>AC-5'</sub> (SEQ ID NO: 2054)

βc-m2039 Target: 5'-ATTTTCAATGGGAGAATAAAGCAACTG-3' (SEQ ID NO: 3163)

5'-GGAUAUUUUCAAUGGGAGAAUAAAG<sup>AC-3'</sup> (SEQ ID NO: 6491)
3'-CCUAUAAAAGUUACCCUCUUAUUUC<sub>GU-5'</sub> (SEQ ID NO: 2055)

βc-m2043 Target: 5'-GGATATTTTCAATGGGAGAATAAAGCA-3' (SEQ ID NO: 3164)

5'-UGGAUAUUUUCAAUGGGAGAAUAAA<sup>AA-3'</sup> (SEQ ID NO: 6492)
3'-ACCUAUAAAAGUUACCCUCUUAUUU<sub>CG-5'</sub> (SEQ ID NO: 2056)

βc-m2044 Target: 5'-TGGATATTTTCAATGGGAGAATAAAGC-3' (SEQ ID NO: 3165)

5'-UUGGAUAUUUUCAAUGGGAGAAUAA<sup>CA-3'</sup> (SEQ ID NO: 6493)
3'-AACCUAUAAAAGUUACCCUCUUAUU<sub>UC-5'</sub> (SEQ ID NO: 2057)

βc-m2045 Target: 5'-TTGGATATTTTCAATGGGAGAATAAAG-3' (SEQ ID NO: 3166)

5'-CAGCUACUCUUUGGAUAUUUUCAAU<sup>AA-3'</sup> (SEQ ID NO: 6494)
3'-GUCGAUGAGAAACCUAUAAAAGUUA<sub>CC-5'</sub> (SEQ ID NO: 2058)

βc-m2055 Target: 5'-CAGCTACTCTTTGGATATTTTCAATGG-3' (SEQ ID NO: 3167)

5'-GCAGCUACUCUUUGGAUAUUUUCAA<sup>CA-3'</sup> (SEQ ID NO: 6495)
3'-CGUCGAUGAGAAACCUAUAAAAGUU<sub>AC-5'</sub> (SEQ ID NO: 2059)

βc-m2056 Target: 5'-GCAGCTACTCTTTGGATATTTTCAATG-3' (SEQ ID NO: 3168)

5'-CCGCUUCUUGUAAUCCUGUGGCUUG<sup>CA-3'</sup> (SEQ ID NO: 6496)
3'-GGCGAAGAACAUUAGGACACCGAAC<sub>AG-5'</sub> (SEQ ID NO: 2060)

βc-m2231 Target: 5'-CCGCTTCTTGTAATCCTGTGGCTTGTC-3' (SEQ ID NO: 3169)

TABLE 12-continued

Additional Selected Anti-β-catenin DsiRNAs, Blunt/Frayed Duplexes

5'-CCAGUCCAAGAUCUGCAGUCUCAUU$^{AA}$-3'  (SEQ ID NO: 6497)
3'-GGUCAGGUUCUAGACGUCAGAGUAA$_{G}$-5'  (SEQ ID NO: 2061)

βc-m2307 Target: 5'-CCAGTCCAAGATCTGCAGTCTCATTCC-3' (SEQ ID NO: 3170)

5'-CGUAUCCACCAGAGUGAAAAGAACG$^{AC}$-3'  (SEQ ID NO: 6498)
3'-GCAUAGGUGGUCUCACUUUUCUUGC$_{CA}$-5'  (SEQ ID NO: 2062)

βc-m2385 Target: 5'-CGTATCCACCAGAGTGAAAAGAACGGT-3' (SEQ ID NO: 3171)

5'-CAGGCCAGCUGAUUGCUAUCACCUG$^{AA}$-3'  (SEQ ID NO: 6499)
3'-GUCCGGUCGACUAACGAUAGUGGAC$_{CC}$-5'  (SEQ ID NO: 2063)

βc-m2539 Target: 5'-CAGGCCAGCTGATTGCTATCACCTGGG-3' (SEQ ID NO: 3172)

5'-CGAUUUACAGGUCAGUAUCAAACCA$^{AA}$-3'  (SEQ ID NO: 6500)
3'-GCUAAAUGUCCAGUCAUAGUUUGGU$_{CC}$-5'  (SEQ ID NO: 2064)

βc-m2562 Target: 5'-CGATTTACAGGTCAGTATCAAACCAGG-3' (SEQ ID NO: 3173)

5'-ACGAUUUACAGGUCAGUAUCAAACC$^{CA}$-3'  (SEQ ID NO: 6501)
3'-UGCUAAAUGUCCAGUCAUAGUUUGG$_{UC}$-5'  (SEQ ID NO: 2065)

βc-m2563 Target: 5'-ACGATTTACAGGTCAGTATCAAACCAG-3' (SEQ ID NO: 3174)

5'-UUUCUUACCUAAAGGACGAUUUACA$^{AA}$-3'  (SEQ ID NO: 6502)
3'-AAAGAAUGGAUUUCCUGCUAAAUGU$_{CC}$-5'  (SEQ ID NO: 2066)

βc-m2578 Target: 5'-TTTCTTACCTAAAGGACGATTTACAGG-3' (SEQ ID NO: 3175)

5'-GCUUUCUUACCUAAAGGACGAUUUA$^{AC}$-3'  (SEQ ID NO: 6503)
3'-CGAAAGAAUGGAUUUCCUGCUAAAU$_{GU}$-5'  (SEQ ID NO: 2067)

βc-m2580 Target: 5'-GCTTTCTTACCTAAAGGACGATTTACA-3' (SEQ ID NO: 3176)

5'-CUUUUAUAAGCUUUCUUACCUAAAG$^{AC}$-3'  (SEQ ID NO: 6504)
3'-GAAAAUAUUCGAAAGAAUGGAUUUC$_{CU}$-5'  (SEQ ID NO: 2068)

βc-m2589 Target: 5'-CTTTTATAAGCTTTCTTACCTAAGGA-3' (SEQ ID NO: 3177)

5'-GCUUUUAUAAGCUUUCUUACCUAAA$^{AA}$-3'  (SEQ ID NO: 6505)
3'-CGAAAAUAUUCGAAAGAAUGGAUUU$_{CC}$-5'  (SEQ ID NO: 2069)

βc-m2590 Target: 5'-GCTTTTATAAGCTTTCTTACCTAAGG-3' (SEQ ID NO: 3178)

5'-CUGGCUUUUAUAAGCUUUCUUACCU$^{CC}$-3'  (SEQ ID NO: 6506)
3'-GACCGAAAAUAUUCGAAAGAAUGGA$_{UU}$-5'  (SEQ ID NO: 2070)

βc-m2593 Target: 5'-CTGGCTTTTATAAGCTTTCTTACCTAA-3' (SEQ ID NO: 3179)

5'-CCACACUGGCUUUUAUAAGCUUUCU$^{CC}$-3'  (SEQ ID NO: 6507)
3'-GGUGUGACCGAAAAUAUUCGAAAGA$_{AU}$-5'  (SEQ ID NO: 2071)

βc-m2598 Target: 5'-CCACACTGGCTTTTATAAGCTTTCTTA-3' (SEQ ID NO: 3180)

5'-AUUCACCCACACUGGCUUUUAUAAG$^{AC}$-3'  (SEQ ID NO: 6508)
3'-UAAGUGGGUGUGACCGAAAAUAUUC$_{GA}$-5'  (SEQ ID NO: 2072)

βc-m2604 Target: 5'-ATTCACCCACACTGGCTTTTATAAGCT-3' (SEQ ID NO: 3181)

TABLE 12-continued

Additional Selected Anti-β-catenin DsiRNAs, Blunt/Frayed Duplexes

5'-CCUACCAAGUCUUUCUGGAGUUCUG$^{AC}$-3'    (SEQ ID NO: 6509)
3'-GGAUGGUUCAGAAAGACCUCAAGAC$_{GU}$-5'    (SEQ ID NO: 2073)

βc-m2644 Target: 5'-CCTACCAAGTCTTTCTGGAGTTCTGCA-3' (SEQ ID NO: 3182)

5'-AUUUACAAACAGGCCUAAAACCAUU$^{AA}$-3'    (SEQ ID NO: 6510)
3'-UAAAUGUUUGUCCGGAUUUUGGUAA$_{G}$-5'    (SEQ ID NO: 2074)

βc-m2674 Target: 5'-ATTTACAAACAGGCCTAAAACCATTCC-3' (SEQ ID NO: 3183)

5'-GAUUUACAAACAGGCCUAAAACCAU$^{CA}$-3'    (SEQ ID NO: 6511)
3'-CUAAAUGUUUGUCCGGAUUUUGGUA$_{AG}$-5'    (SEQ ID NO: 2075)

βc-m2675 Target: 5'-GATTTACAAACAGGCCTAAAACCATTC-3' (SEQ ID NO: 3184)

5'-AGAUUUACAAACAGGCCUAAAACCA$^{CC}$-3'    (SEQ ID NO: 6512)
3'-UCUAAAUGUUUGUCCGGAUUUUGGU$_{A}$-5'    (SEQ ID NO: 2076)

βc-m2676 Target: 5'-AGATTTACAAACAGGCCTAAAACCATT-3' (SEQ ID NO: 3185)

5'-CAUCUCCUUCCAAGGUAUGUAUCUG$^{CC}$-3'    (SEQ ID NO: 6513)
3'-GUAGAGGAAGGUUCCAUACAUAGAC$_{A}$-5'    (SEQ ID NO: 2077)

βc-m2710 Target: 5'-CATCTCCTTCCAAGGTATGTATCTGTT-3' (SEQ ID NO: 3186)

5'-ACAUCUCCUUCCAAGGUAUGUAUCU$^{AC}$-3'    (SEQ ID NO: 6514)
3'-UGUAGAGGAAGGUUCCAUACAUAGA$_{CA}$-5'    (SEQ ID NO: 2078)

βc-m2711 Target: 5'-ACATCTCCTTCCAAGGTATGTATCTGT-3' (SEQ ID NO: 3187)

5'-ACUUCCACACAUGAACAUCUCCUUC$^{AC}$-3'    (SEQ ID NO: 6515)
3'-UGAAGGUGUGUACUUGUAGAGGAAG$_{GU}$-5'    (SEQ ID NO: 2079)

βc-m2725 Target: 5'-ACTTCCACACATGAACATCTCCTTCCA-3' (SEQ ID NO: 3188)

5'-GAAACUUCCACACAUGAACAUCUCC$^{CC}$-3'    (SEQ ID NO: 6516)
3'-CUUUGAAGGUGUGUACUUGUAGAGG$_{A}$-5'    (SEQ ID NO: 2080)

βc-m2728 Target: 5'-GAAACTTCCACACATGAACATCTCCTT-3' (SEQ ID NO: 3189)

5'-AGAAACUUCCACACAUGAACAUCUC$^{AC}$-3'    (SEQ ID NO: 6517)
3'-UCUUUGAAGGUGUGUACUUGUAGAG$_{GA}$-5'    (SEQ ID NO: 2081)

βc-m2729 Target: 5'-AGAAACTTCCACACATGAACATCTCCT-3' (SEQ ID NO: 3190)

5'-GAGAAACUUCCACACAUGAACAUCU$^{AA}$-3'    (SEQ ID NO: 6518)
3'-CUCUUUGAAGGUGUGUACUUGUAGA$_{G}$-5'    (SEQ ID NO: 2082)

βc-m2730 Target: 5'-GAGAAACTTCCACACATGAACATCTCC-3' (SEQ ID NO: 3191)

5'-UGAGAAACUUCCACACAUGAACAUC$^{CA}$-3'    (SEQ ID NO: 6519)
3'-ACUCUUUGAAGGUGUGUACUUGUAG$_{AG}$-5'    (SEQ ID NO: 2083)

βc-m2731 Target: 5'-TGAGAAACTTCCACACATGAACATCTC-3' (SEQ ID NO: 3192)

5'-CAUCAACGUGAGAAACUUCCACACA$^{CA}$-3'    (SEQ ID NO: 6520)
3'-GUAGUUGCACUCUUUGAAGGUGUGU$_{AC}$-5'    (SEQ ID NO: 2084)

βc-m2739 Target: 5'-CATCAACGTGAGAAACTTCCACACATG-3' (SEQ ID NO: 3193)

TABLE 12-continued

Additional Selected Anti-β-catenin DsiRNAs, Blunt/Frayed Duplexes

5'-AAACAUCAACGUGAGAAACUUCCAC$^{CA-3'}$ (SEQ ID NO: 6521)
3'-UUUGUAGUUGCACUCUUUGAAGGUG$_{UG-5'}$ (SEQ ID NO: 2085)

βc-m2742 Target: 5'-AAACATCAACGTGAGAAACTTCCACAC-3' (SEQ ID NO: 3194)

5'-AAAACAUCAACGUGAGAAACUUCCA$^{AC-3'}$ (SEQ ID NO: 6522)
3'-UUUUGUAGUUGCACUCUUUGAAGGU$_{GU-5'}$ (SEQ ID NO: 2086)

βc-m2743 Target: 5'-AAAACATCAACGTGAGAAACTTCCACA-3' (SEQ ID NO: 3195)

5'-AAAAACAUCAACGUGAGAAACUUCC$^{CA-3'}$ (SEQ ID NO: 6523)
3'-UUUUUGUAGUUGCACUCUUUGAAGG$_{UG-5'}$ (SEQ ID NO: 2087)

βc-m2744 Target: 5'-AAAAACATCAACGTGAGAAACTTCCAC-3' (SEQ ID NO: 3196)

5'-CAAAAACAUCAACGUGAGAAACUUC$^{AC-3'}$ (SEQ ID NO: 6524)
3'-GUUUUUGUAGUUGCACUCUUUGAAG$_{GU-5'}$ (SEQ ID NO: 2088)

βc-m2745 Target: 5'-CAAAAACATCAACGTGAGAAACTTCCA-3' (SEQ ID NO: 3197)

5'-GCAAAAACAUCAACGUGAGAAACUU$^{AA-3'}$ (SEQ ID NO: 6525)
3'-CGUUUUUGUAGUUGCACUCUUUGAA$_{GG-5'}$ (SEQ ID NO: 2089)

βc-m2746 Target: 5'-GCAAAAACATCAACGTGAGAAACTTCC-3' (SEQ ID NO: 3198)

5'-UGGCAAAAACAUCAACGUGAGAAAC$^{CC-3'}$ (SEQ ID NO: 6526)
3'-ACCGUUUUUGUAGUUGCACUCUUUG$_{AA-5'}$ (SEQ ID NO: 2090)

βc-m2748 Target: 5'-TGGCAAAAACATCAACGTGAGAAACTT-3' (SEQ ID NO: 3199)

5'-CUGCAAAAGCUGUGGCAAAAACAUC$^{CC-3'}$ (SEQ ID NO: 6527)
3'-GACGUUUUCGACACCGUUUUUGUAG$_{UU-5'}$ (SEQ ID NO: 2091)

βc-m2760 Target: 5'-CTGCAAAAGCTGTGGCAAAAACATCAA-3' (SEQ ID NO: 3200)

5'-GCUGCAAAAGCUGUGGCAAAAACAU$^{AC-3'}$ (SEQ ID NO: 6528)
3'-CGACGUUUUCGACACCGUUUUUGUA$_{GU-5'}$ (SEQ ID NO: 2092)

βc-m2761 Target: 5'-GCTGCAAAAGCTGTGGCAAAAACATCA-3' (SEQ ID NO: 3201)

5'-ACUCAUCUGAGUAUAACGCUGCAAA$^{CA-3'}$ (SEQ ID NO: 6529)
3'-UGAGUAGACUCAUAUUGCGACGUUU$_{UC-5'}$ (SEQ ID NO: 2093)

βc-m2778 Target: 5'-ACTCATCTGAGTATAACGCTGCAAAAG-3' (SEQ ID NO: 3202)

5'-UGAAAACAGCAAAUGUUACUCAUCU$^{AC-3'}$ (SEQ ID NO: 6530)
3'-ACUUUUGUCGUUUACAAUGAGUAGA$_{CU-5'}$ (SEQ ID NO: 2094)

βc-m2795 Target: 5'-TGAAAACAGCAAATGTTACTCATCTGA-3' (SEQ ID NO: 3203)

5'-UUGAAAACAGCAAAUGUUACUCAUC$^{CA-3'}$ (SEQ ID NO: 6531)
3'-AACUUUUGUCGUUUACAAUGAGUAG$_{AC-5'}$ (SEQ ID NO: 2095)

βc-m2796 Target: 5'-TTGAAAACAGCAAATGTTACTCATCTG-3' (SEQ ID NO: 3204)

5'-GUUGAAAACAGCAAAUGUUACUCAU$^{AC-3'}$ (SEQ ID NO: 6532)
3'-CAACUUUUGUCGUUUACAAUGAGUA$_{GA-5'}$ (SEQ ID NO: 2096)

βc-m2797 Target: 5'-GTTGAAAACAGCAAATGTTACTCATCT-3' (SEQ ID NO: 3205)

TABLE 12-continued

Additional Selected Anti-β-catenin DsiRNAs, Blunt/Frayed Duplexes

5'-CUAUUAAUGUUGAAAACAGCAAAUG$^{CC\text{-}3'}$ (SEQ ID NO: 6533)
3'-GAUAAUUACAACUUUUGUCGUUUAC$_{AA\text{-}5'}$ (SEQ ID NO: 2097)

βc-m2805 Target: 5'-CTATTAATGTTGAAAACAGCAAATGTT-3' (SEQ ID NO: 3206)

5'-ACACUACAGCUGUAUAGAGAGAAAG$^{AA\text{-}3'}$ (SEQ ID NO: 6534)
3'-UGUGAUGUCGACAUAUCUCUCUUUC$_{CG\text{-}5'}$ (SEQ ID NO: 2098)

βc-m2834 Target: 5'-ACACTACAGCTGTATAGAGAGAAAGGC-3' (SEQ ID NO: 3207)

5'-CAGGCCAAUCACAAUGCACGUUCAG$^{CA\text{-}3'}$ (SEQ ID NO: 6535)
3'-GUCCGGUUAGUGUUACGUGCAAGUC$_{UG\text{-}5'}$ (SEQ ID NO: 2099)

βc-m2859 Target: 5'-CAGGCCAATCACAATGCACGTTCAGAC-3' (SEQ ID NO: 3208)

5'-CUGUUCCCAUAGGAAACUCAGCUUG$^{AC\text{-}3'}$ (SEQ ID NO: 6536)
3'-GACAAGGGUAUCCUUUGAGUCGAAC$_{CA\text{-}5'}$ (SEQ ID NO: 2100)

βc-m2946 Target: 5'-CTGTTCCCATAGGAAACTCAGCTTGGT-3' (SEQ ID NO: 3209)

5'-CAGAACAAAAAGCGUACUUCGACUG$^{CC\text{-}3'}$ (SEQ ID NO: 6537)
3'-GUCUUGUUUUUCGCAUGAAGCUGAC$_{AA\text{-}5'}$ (SEQ ID NO: 2101)

βc-m2968 Target: 5'-CAGAACAAAAAGCGTACTTCGACTGTT-3' (SEQ ID NO: 3210)

5'-AAGGACCAGAACAAAAAGCGUACUU$^{AA\text{-}3'}$ (SEQ ID NO: 6538)
3'-UUCCUGGUCUUGUUUUUCGCAUGAA$_{GC\text{-}5'}$ (SEQ ID NO: 2102)

βc-m2974 Target: 5'-AAGGACCAGAACAAAAAGCGTACTTCG-3' (SEQ ID NO: 3211)

5'-CGACCAAAAAGGACCAGAACAAAAA$^{AA\text{-}3'}$ (SEQ ID NO: 6539)
3'-GCUGGUUUUUCCUGGUCUUGUUUUU$_{CG\text{-}5'}$ (SEQ ID NO: 2103)

βc-m2982 Target: 5'-CGACCAAAAAGGACCAGAACAAAAAGC-3' (SEQ ID NO: 3212)

5'-UCGACCAAAAAGGACCAGAACAAAA$^{CA\text{-}3'}$ (SEQ ID NO: 6540)
3'-AGCUGGUUUUUCCUGGUCUUGUUUU$_{UC\text{-}5'}$ (SEQ ID NO: 2104)

βc-m2983 Target: 5'-TCGACCAAAAAGGACCAGAACAAAAG-3' (SEQ ID NO: 3213)

5'-UUACUCCUCGACCAAAAAGGACCAG$^{CC\text{-}3'}$ (SEQ ID NO: 6541)
3'-AAUGAGGAGCUGGUUUUUCCUGGUC$_{UU\text{-}5'}$ (SEQ ID NO: 2105)

βc-m2990 Target: 5'-TTACTCCTCGACCAAAAAGGACCAGAA-3' (SEQ ID NO: 3214)

5'-AAUCCAUUUGUAUUGUUACUCCUCG$^{CA\text{-}3'}$ (SEQ ID NO: 6542)
3'-UUAGGUAAACAUAACAAUGAGGAGC$_{UG\text{-}5'}$ (SEQ ID NO: 2106)

βc-m3005 Target: 5'-AATCCATTTGTATTGTTACTCCTCGAC-3' (SEQ ID NO: 3215)

5'-AAAUCCAUUUGUAUUGUUACUCCUC$^{AC\text{-}3'}$ (SEQ ID NO: 6543)
3'-UUUAGGUAAACAUAACAAUGAGGAG$_{CU\text{-}5'}$ (SEQ ID NO: 2107)

βc-m3006 Target: 5'-AAATCCATTTGTATTGTTACTCCTCGA-3' (SEQ ID NO: 3216)

5'-CAAAUCCAUUUGUAUUGUUACUCCU$^{AA\text{-}3'}$ (SEQ ID NO: 6544)
3'-GUUUAGGUAAACAUAACAAUGAGGA$_{GC\text{-}5'}$ (SEQ ID NO: 2108)

βc-m3007 Target: 5'-CAAATCCATTTGTATTGTTACTCCTCG-3' (SEQ ID NO: 3217)

TABLE 12-continued

Additional Selected Anti-β-catenin DsiRNAs, Blunt/Frayed Duplexes

5'-CCAAAUCCAUUUGUAUUGUUACUCC<sup>CA-3'</sup> (SEQ ID NO: 6545)
3'-GGUUUAGGUAAACAUAACAAUGAGG<sub>AG-5'</sub> (SEQ ID NO: 2109)

βc-m3008 Target: 5'-CCAAATCCATTTGTATTGTTACTCCTC-3' (SEQ ID NO: 3218)

5'-UCACUCCCCAAAUCCAUUUGUAUUG<sup>CC-3'</sup> (SEQ ID NO: 6546)
3'-AGUGAGGGGUUUAGGUAAACAUAAC<sub>AA-5'</sub> (SEQ ID NO: 2110)

βc-m3015 Target: 5'-TCACTCCCCAAATCCATTTGTATTGTT-3' (SEQ ID NO: 3219)

5'-GAUCCAUUCGUGUGCAUUCUUCACU<sup>AA-3'</sup> (SEQ ID NO: 6547)
3'-CUAGGUAAGCACACGUAAGAAGUGA<sub>CG-5'</sub> (SEQ ID NO: 2111)

βc-m3047 Target: 5'-GATCCATTCGTGTGCATTCTTCACTGC-3' (SEQ ID NO: 3220)

5'-UGAUCCAUUCGUGUGCAUUCUUCAC<sup>CA-3'</sup> (SEQ ID NO: 6548)
3'-ACUAGGUAAGCACACGUAAGAAGUG<sub>AC-5'</sub> (SEQ ID NO: 2112)

βc-m3048 Target: 5'-TGATCCATTCGTGTGCATTCTTCACTG-3' (SEQ ID NO: 3221)

5'-GUGAUCCAUUCGUGUGCAUUCUUCA<sup>AC-3'</sup> (SEQ ID NO: 6549)
3'-CACUAGGUAAGCACACGUAAGAAGU<sub>GA-5'</sub> (SEQ ID NO: 2113)

βc-m3049 Target: 5'-GTGATCCATTCGTGTGCATTCTTCACT-3' (SEQ ID NO: 3222)

5'-UAAAACAAAGAACAAGCAAGGCUAG<sup>AA-3'</sup> (SEQ ID NO: 6550)
3'-AUUUUGUUUCUUGUUCGUUCCGAUC<sub>CC-5'</sub> (SEQ ID NO: 2114)

βc-m3093 Target: 5'-TAAAACAAAGAACAAGCAAGGCTAGGG-3' (SEQ ID NO: 3223)

5'-GCACCACUACAGAUAUUAAAACAAA<sup>AC-3'</sup> (SEQ ID NO: 6551)
3'-CGUGGUGAUGUCUAUAAUUUUGUUU<sub>CU-5'</sub> (SEQ ID NO: 2115)

βc-m3109 Target: 5'-GCACCACTACAGATATTAAAACAAAGA-3' (SEQ ID NO: 3224)

5'-CAGCACCACUACAGAUAUUAAAACA<sup>CC-3'</sup> (SEQ ID NO: 6552)
3'-GUCGUGGUGAUGUCUAUAAUUUUGU<sub>UU-5'</sub> (SEQ ID NO: 2116)

βc-m3111 Target: 5'-CAGCACCACTACAGATATTAAAACAAA-3' (SEQ ID NO: 3225)

5'-UCAGCACCACUACAGAUAUUAAAAC<sup>CC-3'</sup> (SEQ ID NO: 6553)
3'-AGUCGUGGUGAUGUCUAUAAUUUUG<sub>UU-5'</sub> (SEQ ID NO: 2117)

βc-m3112 Target: 5'-TCAGCACCACTACAGATATTAAAACAA-3' (SEQ ID NO: 3226)

5'-AAAAAAUAAAAGCAAGCAAAGUCAG<sup>AC-3'</sup> (SEQ ID NO: 6554)
3'-UUUUUUAUUUUCGUUCGUUUCAGUC<sub>GU-5'</sub> (SEQ ID NO: 2118)

βc-m3133 Target: 5'-AAAAAATAAAAGCAAGCAAAGTCAGCA-3' (SEQ ID NO: 3227)

5'-CUGCAAAAAAUAAAAGCAAGCAAAG<sup>CA-3'</sup> (SEQ ID NO: 6555)
3'-GACGUUUUUUAUUUUCGUUCGUUUC<sub>AG-5'</sub> (SEQ ID NO: 2119)

βc-m3137 Target: 5'-CTGCAAAAAATAAAAGCAAGCAAAGTC-3' (SEQ ID NO: 3228)

5'-AGUUACUGCAAAAAAUAAAAGCAAG<sup>AC-3'</sup> (SEQ ID NO: 6556)
3'-UCAAUGACGUUUUUUAUUUUCGUUC<sub>GU-5'</sub> (SEQ ID NO: 2120)

βc-m3142 Target: 5'-AGTTACTGCAAAAAATAAAAGCAAGCA-3' (SEQ ID NO: 3229)

TABLE 12-continued

Additional Selected Anti-β-catenin DsiRNAs, Blunt/Frayed Duplexes

5'-ACUAACAGUUACUGCAAAAAUAAA$^{CA}$-3' (SEQ ID NO: 6557)
3'-UGAUUGUCAAUGACGUUUUUAUUU$_{UC}$-5' (SEQ ID NO: 2121)

βc-m3148 Target: 5'-ACTAACAGTTACTGCAAAAATAAAG-3' (SEQ ID NO: 3230)

5'-AAACUAACAGUUACUGCAAAAAUA$^{CC}$-3' (SEQ ID NO: 6558)
3'-UUUGAUUGUCAAUGACGUUUUUAU$_{UU}$-5' (SEQ ID NO: 2122)

βc-m3150 Target: 5'-AAACTAACAGTTACTGCAAAAATAAA-3' (SEQ ID NO: 3231)

5'-AAAAACUAACAGUUACUGCAAAAAA$^{CC}$-3' (SEQ ID NO: 6559)
3'-UUUUUGAUUGUCAAUGACGUUUUU$_{AU}$-5' (SEQ ID NO: 2123)

βc-m3152 Target: 5'-AAAAACTAACAGTTACTGCAAAAATA-3' (SEQ ID NO: 3232)

5'-UAAAAACUAACAGUUACUGCAAAAA$^{CC}$-3' (SEQ ID NO: 6560)
3'-AUUUUUGAUUGUCAAUGACGUUUUU$_{UA}$-5' (SEQ ID NO: 2124)

βc-m3153 Target: 5'-TAAAAACTAACAGTTACTGCAAAAAT-3' (SEQ ID NO: 3233)

5'-CUUAAAAACUAACAGUUACUGCAAA$^{CC}$-3' (SEQ ID NO: 6561)
3'-GAAUUUUUGAUUGUCAAUGACGUUU$_{UU}$-5' (SEQ ID NO: 2125)

βc-m3155 Target: 5'-CTTAAAAACTAACAGTTACTGCAAAAA-3' (SEQ ID NO: 3234)

5'-ACUACUUAAAAACUAACAGUUACUG$^{A}$$^{AC}$-3' (SEQ ID NO: 6562)
3'-UGAUGAAUUUUUGAUUGUCAAUGAC$_{GU}$-5' (SEQ ID NO: 2126)

βc-m3159 Target: 5'-ACTACTTAAAAACTAACAGTTACTGCA-3' (SEQ ID NO: 3235)

5'-ACACUACUUAAAAACUAACAGUUAC$^{CA}$-3' (SEQ ID NO: 6563)
3'-UGUGAUGAAUUUUUGAUUGUCAAUG$_{AC}$-5' (SEQ ID NO: 2127)

βc-m3161 Target: 5'-ACACTACTTAAAAACTAACAGTTACTG-3' (SEQ ID NO: 3236)

5'-CAUAACACUACUUAAAAACUAACAG$^{CC}$-3' (SEQ ID NO: 6564)
3'-GUAUUGUGAUGAAUUUUUGAUUGUC$_{A}$$_{A}$-5' (SEQ ID NO: 2128)

βc-m3165 Target: 5'-CATAACACTACTTAAAAACTAACAGTT-3' (SEQ ID NO: 3237)

5'-ACAUAACACUACUUAAAAACUAACA$^{AC}$-3' (SEQ ID NO: 6565)
3'-UGUAUUGUGAUGAAUUUUUGAUUGU$_{CA}$-5' (SEQ ID NO: 2129)

βc-m3166 Target: 5'-ACATAACACTACTTAAAAACTAACAGT-3' (SEQ ID NO: 3238)

5'-GAACAUAACACUACUUAAAAACUAA$^{A}$$^{AC}$-3' (SEQ ID NO: 6566)
3'-CUUGUAUUGUGAUGAAUUUUUGAUU$_{GU}$-5' (SEQ ID NO: 2130)

βc-m3168 Target: 5'-GAACATAACACTACTTAAAAACTAACA-3' (SEQ ID NO: 3239)

5'-AGAACAUAACACUACUUAAAAACUA$^{CA}$-3' (SEQ ID NO: 6567)
3'-UCUUGUAUUGUGAUGAAUUUUUGAU$_{UG}$-5' (SEQ ID NO: 2131)

βc-m3169 Target: 5'-AGAACATAACACTACTTAAAAACTAAC-3' (SEQ ID NO: 3240)

5'-UAGAACAUAACACUACUUAAAAACU$^{CC}$-3' (SEQ ID NO: 6568)
3'-AUCUUGUAUUGUGAUGAAUUUUUGA$_{UU}$-5' (SEQ ID NO: 2132)

βc-m3170 Target: 5'-TAGAACATAACACTACTTAAAAACTAA-3' (SEQ ID NO: 3241)

TABLE 12-continued

Additional Selected Anti-β-catenin DsiRNAs, Blunt/Frayed Duplexes

5'-CUAGAACAUAACACUACUUAAAAAC$^{CC\text{-}3'}$ (SEQ ID NO: 6569)
3'-GAUCUUGUAUUGUGAUGAAUUUUG$_{A_{U\text{-}5'}}$ (SEQ ID NO: 2133)

βc-m3171 Target: 5'-CTAGAACATAACACTACTTAAAAACTA-3' (SEQ ID NO: 3242)

5'-GUUCACUAGAACAUAACACUACUUA$^{CC\text{-}3'}$ (SEQ ID NO: 6570)
3'-CAAGUGAUCUUGUAUUGUGAUGAAU$_{U\text{-}5'}$ (SEQ ID NO: 2134)

βc-m3176 Target: 5'-GTTCACTAGAACATAACACTACTTAAA-3' (SEQ ID NO: 3243)

5'-AGGUUCACUAGAACAUAACACUACU$^{CC\text{-}3'}$ (SEQ ID NO: 6571)
3'-UCCAAGUGAUCUUGUAUUGUGAUGA$_{A_{U\text{-}5'}}$ (SEQ ID NO: 2135)

βc-m3178 Target: 5'-AGGTTCACTAGAACATAACACTACTTA-3' (SEQ ID NO: 3244)

5'-CAGGUUCACUAGAACAUAACACUAC$^{CC\text{-}3'}$ (SEQ ID NO: 6572)
3'-GUCCAAGUGAUCUUGUAUUGUGAUG$_{A_{A\text{-}5'}}$ (SEQ ID NO: 2136)

βc-m3179 Target: 5'-CAGGTTCACTAGAACATAACACTACTT-3' (SEQ ID NO: 3245)

5'-CCAUUACUCGGUUCUUAGAAAUCAG$^{CC\text{-}3'}$ (SEQ ID NO: 6573)
3'-GGUAAUGAGCCAAGAAUCUUUAGUC$_{U\text{-}5'}$ (SEQ ID NO: 2137)

βc-m3216 Target: 5'-CCATTACTCGGTTCTTAGAAATCAGAA-3' (SEQ ID NO: 3246)

5'-ACACCAUUACUCGGUUCUUAGAAAU$^{AC\text{-}3'}$ (SEQ ID NO: 6574)
3'-UGUGGUAAUGAGCCAAGAAUCUUUA$_{G_{U\text{-}5'}}$ (SEQ ID NO: 2138)

βc-m3219 Target: 5'-ACACCATTACTCGGTTCTTAGAAATCA-3' (SEQ ID NO: 3247)

5'-GUUCUACACCAUUACUCGGUUCUUA$^{AC\text{-}3'}$ (SEQ ID NO: 6575)
3'-CAAGAUGUGGUAAUGAGCCAAGAAU$_{C_{U\text{-}5'}}$ (SEQ ID NO: 2139)

βc-m3224 Target: 5'-GTTCTACACCATTACTCGGTTCTTAGA-3' (SEQ ID NO: 3248)

5'-AUGAAUUAGUGUUCUACACCAUUAC$^{CA\text{-}3'}$ (SEQ ID NO: 6576)
3'-UACUUAAUCACAAGAUGUGGUAAUG$_{A_{G\text{-}5'}}$ (SEQ ID NO: 2140)

βc-m3234 Target: 5'-ATGAATTAGTGTTCTACACCATTACTC-3' (SEQ ID NO: 3249)

5'-UGAUUAUGAAUUAGUGUUCUACACC$^{CC\text{-}3'}$ (SEQ ID NO: 6577)
3'-ACUAAUACUUAAUCACAAGAUGUGG$_{U_{A\text{-}5'}}$ (SEQ ID NO: 2141)

βc-m3239 Target: 5'-TGATTATGAATTAGTGTTCTACACC-3' (SEQ ID NO: 3250)

5'-GUGAUUAUGAAUUAGUGUUCUACAC$^{AC\text{-}3'}$ (SEQ ID NO: 6578)
3'-CACUAAUACUUAAUCACAAGAUGUG$_{G_{U\text{-}5'}}$ (SEQ ID NO: 2142)

βc-m3240 Target: 5'-GTGATTATGAATTAGTGTTCTACACCA-3' (SEQ ID NO: 3251)

5'-CGUGAUUAUGAAUUAGUGUUCUACA$^{AA\text{-}3'}$ (SEQ ID NO: 6579)
3'-GCACUAAUACUUAAUCACAAGAUGU$_{G_{G\text{-}5'}}$ (SEQ ID NO: 2143)

βc-m3241 Target: 5'-CGTGATTATGAATTAGTGTTCTACACC-3' (SEQ ID NO: 3252)

5'-UUACAAUUAGCGUGAUUAUGAAUUA$^{AC\text{-}3'}$ (SEQ ID NO: 6580)
3'-AAUGUUAAUCGCACUAAUACUUAAU$_{C_{A\text{-}5'}}$ (SEQ ID NO: 2144)

βc-m3251 Target: 5'-TTACAATTAGCGTGATTATGAATTAGT-3' (SEQ ID NO: 3253)

TABLE 12-continued

Additional Selected Anti-β-catenin DsiRNAs, Blunt/Frayed Duplexes

5'-AUUACAAUUAGCGUGAUUAUGAAUU$^{CA-3'}$ (SEQ ID NO: 6581)
3'-UAAUGUUAAUCGCACUAAUACUUAA$_{UC-5'}$ (SEQ ID NO: 2145)

βc-m3252 Target: 5'-ATTACAATTAGCGTGATTATGAATTAG-3' (SEQ ID NO: 3254)

5'-CCAGAUUACAAUUAGCGUGAUUAUG$^{CC-3'}$ (SEQ ID NO: 6582)
3'-GGUCUAAUGUUAAUCGCACUAAUAC$_{UU-5'}$ (SEQ ID NO: 2146)

βc-m3256 Target: 5'-CCAGATTACAATTAGCGTGATTATGAA-3' (SEQ ID NO: 3255)

5'-GUUACACGUCUCCAGAUUACAAUUA$^{AA-3'}$ (SEQ ID NO: 6583)
3'-CAAUGUGCAGAGGUCUAAUGUUAAU$_{CG-5'}$ (SEQ ID NO: 2147)

βc-m3267 Target: 5'-GTTACACGTCTCCAGATTACAATTAGC-3' (SEQ ID NO: 3256)

5'-AUGUUACACGUCUCCAGAUUACAAU$^{CC-3'}$ (SEQ ID NO: 6584)
3'-UACAAUGUGCAGAGGUCUAAUGUUA$_{AU-5'}$ (SEQ ID NO: 2148)

βc-m3269 Target: 5'-ATGTTACACGTCTCCAGATTACAATTA-3' (SEQ ID NO: 3257)

5'-GCUACACAAUGUUACACGUCUCCAG$^{CC-3'}$ (SEQ ID NO: 6585)
3'-CGAUGUGUUACAAUGUGCAGAGGUC$_{UA-5'}$ (SEQ ID NO: 2149)

βc-m3277 Target: 5'-GCTACACAATGTTACACGTCTCCAGAT-3' (SEQ ID NO: 3258)

5'-AGGCUACACAAUGUUACACGUCUCC$^{CA-3'}$ (SEQ ID NO: 6586)
3'-UCCGAUGUGUUACAAUGUGCAGAGG$_{UC-5'}$ (SEQ ID NO: 2150)

βc-m3279 Target: 5'-AGGCTACACAATGTTACACGTCTCCAG-3' (SEQ ID NO: 3259)

5'-AUACAAAAGGCUACACAAUGUUACA$^{AA-3'}$ (SEQ ID NO: 6587)
3'-UAUGUUUUCCGAUGUGUUACAAUGU$_{GC-5'}$ (SEQ ID NO: 2151)

βc-m3286 Target: 5'-ATACAAAAGGCTACACAATGTTACACG-3' (SEQ ID NO: 3260)

5'-UAUACAAAAGGCUACACAAUGUUAC$^{CA-3'}$ (SEQ ID NO: 6588)
3'-AUAUGUUUUCCGAUGUGUUACAAUG$_{UG-5'}$ (SEQ ID NO: 2152)

βc-m3287 Target: 5'-TATACAAAAGGCTACACAATGTTACAC-3' (SEQ ID NO: 3261)

5'-UAUUUAUACAAAAGGCUACACAAUG$^{CC-3'}$ (SEQ ID NO: 6589)
3'-AUAAAUAUGUUUUCCGAUGUGUUAC$_{AA-5'}$ (SEQ ID NO: 2153)

βc-m3291 Target: 5'-TATTTATACAAAAGGCTACACAATGTT-3' (SEQ ID NO: 3262)

5'-CUAUUUAUACAAAAGGCUACACAAU$^{AC-3'}$ (SEQ ID NO: 6590)
3'-GAUAAAUAUGUUUUCCGAUGUGUUA$_{CA-5'}$ (SEQ ID NO: 2154)

βc-m3292 Target: 5'-CTATTTATACAAAAGGCTACACAATGT-3' (SEQ ID NO: 3263)

5'-UGUCUAUUUAUACAAAAGGCUACAC$^{CC-3'}$ (SEQ ID NO: 6591)
3'-ACAGAUAAAUAUGUUUUCCGAUGUG$_{UU-5'}$ (SEQ ID NO: 2155)

βc-m3295 Target: 5'-TGTCTATTTATACAAAAGGCTACACAA-3' (SEQ ID NO: 3264)

5'-CUGUCUAUUUAUACAAAAGGCUACA$^{AC-3'}$ (SEQ ID NO: 6592)
3'-GACAGAUAAAUAUGUUUUCCGAUGU$_{GU-5'}$ (SEQ ID NO: 2156)

βc-m3296 Target: 5'-CTGTCTATTTATACAAAAGGCTACACA-3' (SEQ ID NO: 3265)

TABLE 12-continued

Additional Selected Anti-β-catenin DsiRNAs, Blunt/Frayed Duplexes

5'-UCUGUCUAUUUAUACAAAAGGCUAC$^{CA\text{-}3'}$ (SEQ ID NO: 6593)
3'-AGACAGAUAAAUAUGUUUUCCGAUG$_{UG\text{-}5'}$ (SEQ ID NO: 2157)

βc-m3297 Target: 5'-TCTGTCTATTTATACAAAAGGCTACAC-3' (SEQ ID NO: 3266)

5'-UUUCUAUCUGUCUAUUUAUACAAAA$^{AA\text{-}3'}$ (SEQ ID NO: 6594)
3'-AAAGAUAGACAGAUAAAUAUGUUUU$_{CC\text{-}5'}$ (SEQ ID NO: 2158)

βc-m3303 Target: 5'-TTTCTATCTGTCTATTTATACAAAGG-3' (SEQ ID NO: 3267)

5'-AUUUCUAUCUGUCUAUUUAUACAAA$^{CA\text{-}3'}$ (SEQ ID NO: 6595)
3'-UAAAGAUAGACAGAUAAAUAUGUUU$_{UC\text{-}5'}$ (SEQ ID NO: 2159)

βc-m3304 Target: 5'-ATTTCTATCTGTCTATTTATACAAAG-3' (SEQ ID NO: 3268)

5'-CAUUUCUAUCUGUCUAUUUAUACAA$^{CC\text{-}3'}$ (SEQ ID NO: 6596)
3'-GUAAAGAUAGACAGAUAAAUAUGUU$_{UU\text{-}5'}$ (SEQ ID NO: 2160)

βc-m3305 Target: 5'-CATTTCTATCTGTCTATTTATACAAA-3' (SEQ ID NO: 3269)

5'-CCAUUUCUAUCUGUCUAUUUAUACA$^{CC\text{-}3'}$ (SEQ ID NO: 6597)
3'-GGUAAAGAUAGACAGAUAAAUAUGU$_{UU\text{-}5'}$ (SEQ ID NO: 2161)

βc-m3306 Target: 5'-CCATTTCTATCTGTCTATTTATACAAA-3' (SEQ ID NO: 3270)

5'-CGGACCAUUUCUAUCUGUCUAUUUA$^{CC\text{-}3'}$ (SEQ ID NO: 6598)
3'-GCCUGGUAAAGAUAGACAGAUAAAU$_{AU\text{-}5'}$ (SEQ ID NO: 2162)

βc-m3310 Target: 5'-CGGACCATTTCTATCTGTCTATTTATA-3' (SEQ ID NO: 3271)

5'-UCGGACCAUUUCUAUCUGUCUAUUU$^{CC\text{-}3'}$ (SEQ ID NO: 6599)
3'-AGCCUGGUAAAGAUAGACAGAUAAA$_{UA\text{-}5'}$ (SEQ ID NO: 2163)

βc-m3311 Target: 5'-TCGGACCATTTCTATCTGTCTATTTAT-3' (SEQ ID NO: 3272)

5'-AAACUAAUCGGACCAUUUCUAUCUG$^{CA\text{-}3'}$ (SEQ ID NO: 6600)
3'-UUUGAUUAGCCUGGUAAAGAUAGAC$_{AG\text{-}5'}$ (SEQ ID NO: 2164)

βc-m3318 Target: 5'-AAACTAATCGGACCATTTCTATCTGTC-3' (SEQ ID NO: 3273)

5'-GAAACUAAUCGGACCAUUUCUAUCU$^{AC\text{-}3'}$ (SEQ ID NO: 6601)
3'-CUUUGAUUAGCCUGGUAAAGAUAGA$_{CA\text{-}5'}$ (SEQ ID NO: 2165)

βc-m3319 Target: 5'-GAAACTAATCGGACCATTTCTATCTGT-3' (SEQ ID NO: 3274)

5'-GGAAACUAAUCGGACCAUUUCUAUC$^{CA\text{-}3'}$ (SEQ ID NO: 6602)
3'-CCUUUGAUUAGCCUGGUAAAGAUAG$_{AC\text{-}5'}$ (SEQ ID NO: 2166)

βc-m3320 Target: 5'-GGAAACTAATCGGACCATTTCTATCTG-3' (SEQ ID NO: 3275)

5'-AGGAAACUAAUCGGACCAUUUCUAU$^{AC\text{-}3'}$ (SEQ ID NO: 6603)
3'-UCCUUUGAUUAGCCUGGUAAAGAUA$_{GA\text{-}5'}$ (SEQ ID NO: 2167)

βc-m3321 Target: 5'-AGGAAACTAATCGGACCATTTCTATCT-3' (SEQ ID NO: 3276)

5'-AUUAAAAGGAAACUAAUCGGACCA$^{CC\text{-}3'}$ (SEQ ID NO: 6604)
3'-UAAUUUUUCCUUUGAUUAGCCUGGU$_{AA\text{-}5'}$ (SEQ ID NO: 2168)

βc-m3328 Target: 5'-ATTAAAAGGAAACTAATCGGACCATT-3' (SEQ ID NO: 3277)

TABLE 12-continued

Additional Selected Anti-β-catenin DsiRNAs, Blunt/Frayed Duplexes

5'-AAGCAUAUUAAAAAGGAAACUAAUC$^{AA}$-3' (SEQ ID NO: 6605)
3'-UUCGUAUAAUUUUUCCUUUGAUUAG$_{C-5'}$ (SEQ ID NO: 2169)

βc-m3334 Target: 5'-AAGCATATTAAAAAGGAAACTAATCGG-3' (SEQ ID NO: 3278)

5'-UAAGCAUAUUAAAAAGGAAACUAAU$^{AA}$-3' (SEQ ID NO: 6606)
3'-AUUCGUAUAAUUUUUCCUUUGAUUA$_{GC-5'}$ (SEQ ID NO: 2170)

βc-m3335 Target: 5'-TAAGCATATTAAAAAGGAAACTAATCG-3' (SEQ ID NO: 3279)

5'-AUUUUAAGCAUAUUAAAAAGGAAAC$^{CC}$-3' (SEQ ID NO: 6607)
3'-UAAAAUUCGUAUAAUUUUUCCUUUG$_{AU-5'}$ (SEQ ID NO: 2171)

βc-m3339 Target: 5'-ATTTTAAGCATATTAAAAAGGAAACTA-3' (SEQ ID NO: 3280)

5'-CUGCUUAUUUUAAGCAUAUUAAAAA$^{AA}$-3' (SEQ ID NO: 6608)
3'-GACGAAUAAAAUUCGUAUAAUUUUU$_{CC-5'}$ (SEQ ID NO: 2172)

βc-m3345 Target: 5'-CTGCTTATTTTAAGCATATTAAAAGG-3' (SEQ ID NO: 3281)

5'-CCUGCUUAUUUUAAGCAUAUUAAAA$^{CA}$-3' (SEQ ID NO: 6609)
3'-GGACGAAUAAAAUUCGUAUAAUUUU$_{UC-5'}$ (SEQ ID NO: 2173)

βc-m3346 Target: 5'-CCTGCTTATTTTAAGCATATTAAAAG-3' (SEQ ID NO: 3282)

5'-GAUCCACCUGCUUAUUUUAAGCAUA$^{CC}$-3' (SEQ ID NO: 6610)
3'-CUAGGUGGACGAAUAAAAUUCGUAU$_{AA-5'}$ (SEQ ID NO: 2174)

βc-m3352 Target: 5'-GATCCACCTGCTTATTTTAAGCATATT-3' (SEQ ID NO: 3283)

5'-CAAAAACAUGAAAUAGAUCCACCUG$^{AC}$-3' (SEQ ID NO: 6611)
3'-GUUUUUGUACUUUAUCUAGGUGGAC$_{GA-5'}$ (SEQ ID NO: 2175)

βc-m3367 Target: 5'-CAAAAACATGAAATAGATCCACCTGCT-3' (SEQ ID NO: 3284)

5'-UCAAAAACAUGAAAUAGAUCCACCU$^{AA}$-3' (SEQ ID NO: 6612)
3'-AGUUUUUGUACUUUAUCUAGGUGGA$_{CG-5'}$ (SEQ ID NO: 2176)

βc-m3368 Target: 5'-TCAAAAACATGAAATAGATCCACCTGC-3' (SEQ ID NO: 3285)

5'-GUUCAAAAACAUGAAAUAGAUCCAC$^{AC}$-3' (SEQ ID NO: 6613)
3'-CAAGUUUUUGUACUUUAUCUAGGUG$_{GA-5'}$ (SEQ ID NO: 2177)

βc-m3370 Target: 5'-GTTCAAAAACATGAAATAGATCCACCT-3' (SEQ ID NO: 3286)

5'-UGUUCAAAAACAUGAAAUAGAUCCA$^{AA}$-3' (SEQ ID NO: 6614)
3'-ACAAGUUUUUGUACUUUAUCUAGGU$_{GG-5'}$ (SEQ ID NO: 2178)

βc-m3371 Target: 5'-TGTTCAAAAACATGAAATAGATCCACC-3' (SEQ ID NO: 3287)

5'-UUGUUCAAAAACAUGAAAUAGAUCC$^{CA}$-3' (SEQ ID NO: 6615)
3'-AACAAGUUUUUGUACUUUAUCUAGG$_{UG-5'}$ (SEQ ID NO: 2179)

βc-m3372 Target: 5'-TTGTTCAAAAACATGAAATAGATCCAC-3' (SEQ ID NO: 3288)

5'-AGUUUUUGUUCAAAAACAUGAAAUA$^{AC}$-3' (SEQ ID NO: 6616)
3'-UCAAAAACAAGUUUUUGUACUUUAU$_{CU-5'}$ (SEQ ID NO: 2180)

βc-m3377 Target: 5'-AGTTTTTGTTCAAAAACATGAAATAGA-3' (SEQ ID NO: 3289)

TABLE 12-continued

Additional Selected Anti-β-catenin DsiRNAs, Blunt/Frayed Duplexes

5'-CGAUAAAGUUUUUGUUCAAAAACAU$^{AC-3'}$ (SEQ ID NO: 6617)
3'-GCUAUUUCAAAAACAAGUUUUUGUA$_{CU-5'}$ (SEQ ID NO: 2181)

βc-m3383 Target: 5'-CGATAAAGTTTTGTTCAAAAACATGA-3' (SEQ ID NO: 3290)

5'-UAUCCCCGAUAAAGUUUUUGUUCAA$^{CC-3'}$ (SEQ ID NO: 6618)
3'-AUAGGGGCUAUUUCAAAAACAAGUU$_{U-5'}$ (SEQ ID NO: 2182)

βc-m3389 Target: 5'-TATCCCCGATAAAGTTTTGTTCAAA-3' (SEQ ID NO: 3291)

5'-GUAUCCCCGAUAAAGUUUUUGUUCA$^{CC-3'}$ (SEQ ID NO: 6619)
3'-CAUAGGGGCUAUUUCAAAAACAAGU$_{U-5'}$ (SEQ ID NO: 2183)

βc-m3390 Target: 5'-GTATCCCCGATAAAGTTTTGTTCAAA-3' (SEQ ID NO: 3292)

5'-ACACCUCUUACUGAUUUACCCUACC$^{AA-3'}$ (SEQ ID NO: 6620)
3'-UGUGGAGAAUGACUAAAUGGGAUGG$_{CG-5'}$ (SEQ ID NO: 2184)

βc-m3419 Target: 5'-ACACCTCTTACTGATTTACCCTACCGC-3' (SEQ ID NO: 3293)

5'-UAACACCUCUUACUGAUUUACCCUA$^{AA-3'}$ (SEQ ID NO: 6621)
3'-AUUGUGGAGAAUGACUAAAUGGGAU$_{GG-5'}$ (SEQ ID NO: 2185)

βc-m3421 Target: 5'-TAACACCTCTTACTGATTTACCCTACC-3' (SEQ ID NO: 3294)

5'-AUAACACCUCUUACUGAUUUACCCU$^{CA-3'}$ (SEQ ID NO: 6622)
3'-UAUUGUGGAGAAUGACUAAAUGGGA$_{UG-5'}$ (SEQ ID NO: 2186)

βc-m3422 Target: 5'-ATAACACCTCTTACTGATTTACCCTAC-3' (SEQ ID NO: 3295)

5'-AAUAACACCUCUUACUGAUUUACCC$^{CC-3'}$ (SEQ ID NO: 6623)
3'-UUAUUGUGGAGAAUGACUAAAUGGG$_{AU-5'}$ (SEQ ID NO: 2187)

βc-m3423 Target: 5'-AATAACACCTCTTACTGATTTACCCTA-3' (SEQ ID NO: 3296)

5'-AAAUAACACCUCUUACUGAUUUACC$^{AC-3'}$ (SEQ ID NO: 6624)
3'-UUUAUUGUGGAGAAUGACUAAAUGG$_{GA-5'}$ (SEQ ID NO: 2188)

βc-m3424 Target: 5'-AAATAACACCTCTTACTGATTTACCCT-3' (SEQ ID NO: 3297)

5'-CAAAUAACACCUCUUACUGAUUUAC$^{AA-3'}$ (SEQ ID NO: 6625)
3'-GUUUAUUGUGGAGAAUGACUAAAUG$_{GG-5'}$ (SEQ ID NO: 2189)

βc-m3425 Target: 5'-CAAATAACACCTCTTACTGATTTACCC-3' (SEQ ID NO: 3298)

5'-AAGGCUCAAAUAACACCUCUUACUG$^{CC-3'}$ (SEQ ID NO: 6626)
3'-UUCCGAGUUUAUUGUGGAGAAUGAC$_{UA-5'}$ (SEQ ID NO: 2190)

βc-m3431 Target: 5'-AAGGCTCAAATAACACCTCTTACTGAT-3' (SEQ ID NO: 3299)

5'-AAAACAAGGCUCAAAUAACACCUCU$^{CC-3'}$ (SEQ ID NO: 6627)
3'-UUUUGUUCCGAGUUUAUUGUGGAGA$_{AU-5'}$ (SEQ ID NO: 2191)

βc-m3436 Target: 5'-AAAACAAGGCTCAAATAACACCTCTTA-3' (SEQ ID NO: 3300)

5'-CAAAACAAGGCUCAAAUAACACCUC$^{CC-3'}$ (SEQ ID NO: 6628)
3'-GUUUUGUUCCGAGUUUAUUGUGGAG$_{AA-5'}$ (SEQ ID NO: 2192)

βc-m3437 Target: 5'-CAAAACAAGGCTCAAATAACACCTCTT-3' (SEQ ID NO: 3301)

TABLE 12-continued

Additional Selected Anti-β-catenin DsiRNAs, Blunt/Frayed Duplexes

5'-CCAAAACAAGGCUCAAAUAACACCU$^{AC}$-3' (SEQ ID NO: 6629)
3'-GGUUUUGUUCCGAGUUUAUUGUGGA$_{GA}$-5' (SEQ ID NO: 2193)

βc-m3438 Target: 5'-CCAAAACAAGGCTCAAATAACACCTCT-3' (SEQ ID NO: 3302)

5'-UGUCCAAAACAAGGCUCAAAUAACA$^{AA}$-3' (SEQ ID NO: 6630)
3'-ACAGGUUUUGUUCCGAGUUUAUUGU$_{GA}$-5' (SEQ ID NO: 2194)

βc-m3441 Target: 5'-TGTCCAAAACAAGGCTCAAATAACACC-3' (SEQ ID NO: 3303)

5'-ACUGUCCAAAACAAGGCUCAAAUAA$^{AC}$-3' (SEQ ID NO: 6631)
3'-UGACAGGUUUUGUUCCGAGUUUAUU$_{GU}$-5' (SEQ ID NO: 2195)

βc-m3443 Target: 5'-ACTGTCCAAAACAAGGCTCAAATAACA-3' (SEQ ID NO: 3304)

5'-GGUAUACUGUCCAAAACAAGGCUCA$^{CC}$-3' (SEQ ID NO: 6632)
3'-CCAUAUGACAGGUUUUGUUCCGAGU$_{UU}$-5' (SEQ ID NO: 2196)

βc-m3448 Target: 5'-GGTATACTGTCCAAAACAAGGCTCAAA-3' (SEQ ID NO: 3305)

5'-AGGCAACUGGUAUACUGUCCAAAAC$^{CC}$-3' (SEQ ID NO: 6633)
3'-UCCGUUGACCAUAUGACAGGUUUUG$_{UU}$-5' (SEQ ID NO: 2197)

βc-m3456 Target: 5'-AGGCAACTGGTATACTGTCCAAAACAA-3' (SEQ ID NO: 3306)

5'-GGGAUAAAAGGCAACUGGUAUACUG$^{CA}$-3' (SEQ ID NO: 6634)
3'-CCCUAUUUUCCGUUGACCAUAUGAC$_{AG}$-5' (SEQ ID NO: 2198)

βc-m3464 Target: 5'-GGGATAAAAGGCAACTGGTATACTGTC-3' (SEQ ID NO: 3307)

5'-UGGGAUAAAAGGCAACUGGUAUACU$^{AC}$-3' (SEQ ID NO: 6635)
3'-ACCCUAUUUUCCGUUGACCAUAUGA$_{CA}$-5' (SEQ ID NO: 2199)

βc-m3465 Target: 5'-TGGGATAAAAGGCAACTGGTATACTGT-3' (SEQ ID NO: 3308)

5'-ACAACUUUGGGAUAAAAGGCAACUG$^{AC}$-3' (SEQ ID NO: 6636)
3'-UGUUGAAACCCUAUUUUCCGUUGAC$_{CA}$-5' (SEQ ID NO: 2200)

βc-m3472 Target: 5'-ACAACTTTGGGATAAAAGGCAACTGGT-3' (SEQ ID NO: 3309)

5'-CAACAACUUUGGGAUAAAAGGCAAC$^{CA}$-3' (SEQ ID NO: 6637)
3'-GUUGUUGAAACCCUAUUUUCCGUUG$_{AC}$-5' (SEQ ID NO: 2201)

βc-m3474 Target: 5'-CAACAACTTTGGGATAAAAGGCAACTG-3' (SEQ ID NO: 3310)

5'-GGUUACAACAACUUUGGGAUAAAAG$^{AA}$-3' (SEQ ID NO: 6638)
3'-CCAAUGUUGUUGAAACCCUAUUUUC$_{GA}$-5' (SEQ ID NO: 2202)

βc-m3479 Target: 5'-GGTTACAACAACTTTGGGATAAAAGGC-3' (SEQ ID NO: 3311)

5'-AGGUUACAACAACUUUGGGAUAAAA$^{AA}$-3' (SEQ ID NO: 6639)
3'-UCCAAUGUUGUUGAAACCCUAUUUU$_{CC}$-5' (SEQ ID NO: 2203)

βc-m3480 Target: 5'-AGGTTACAACAACTTTGGGATAAAAGG-3' (SEQ ID NO: 3312)

5'-CAGGUUACAACAACUUUGGGAUAAA$^{CA}$-3' (SEQ ID NO: 6640)
3'-GUCCAAUGUUGUUGAAACCCUAUUU$_{UC}$-5' (SEQ ID NO: 2204)

βc-m3481 Target: 5'-CAGGTTACAACAACTTTGGGATAAAG-3' (SEQ ID NO: 3313)

TABLE 12-continued

Additional Selected Anti-β-catenin DsiRNAs, Blunt/Frayed Duplexes

5'-UAUCACAGCAGGUUACAACAACUUU$^\text{A}$$^\text{A-3'}$ (SEQ ID NO: 6641)
3'-AUAGUGUCGUCCAAUGUUGUUGAAA$_\text{C}$$_\text{C-5'}$ (SEQ ID NO: 2205)

βc-m3489 Target: 5'-TATCACAGCAGGTTACAACAACTTTGG-3' (SEQ ID NO: 3314)

5'-GUAUCACAGCAGGUUACAACAACUU$^\text{C}$$^\text{A-3'}$ (SEQ ID NO: 6642)
3'-CAUAGUGUCGUCCAAUGUUGUUGAA$_\text{A}$$_\text{C-5'}$ (SEQ ID NO: 2206)

βc-m3490 Target: 5'-GTATCACAGCAGGTTACAACAACTTTG-3' (SEQ ID NO: 3315)

5'-UUGUAUCACAGCAGGUUACAACAAC$^\text{C}$$^\text{C-3'}$ (SEQ ID NO: 6643)
3'-AACAUAGUGUCGUCCAAUGUUGUUG$_\text{A}$$_\text{A-5'}$ (SEQ ID NO: 2207)

βc-m3492 Target: 5'-TTGTATCACAGCAGGTTACAACAACTT-3' (SEQ ID NO: 3316)

5'-CCGCAUCUGUUGAAGCAUUGUAUCA$^\text{A}$$^\text{C-3'}$ (SEQ ID NO: 6644)
3'-GGCGUAGACAACUUCGUAACAUAGU$_\text{G}$$_\text{U-5'}$ (SEQ ID NO: 2208)

βc-m3509 Target: 5'-CCGCATCTGTTGAAGCATTGTATCACA-3' (SEQ ID NO: 3317)

5'-UCUGAACCAUUUCUAUAACCGCAUC$^\text{C}$$^\text{A-3'}$ (SEQ ID NO: 6645)
3'-AGACUUGGUAAAGAUAUUGGCGUAG$_\text{A}$$_\text{C-5'}$ (SEQ ID NO: 2209)

βc-m3527 Target: 5'-TCTGAACCATTTCTATAACCGCATCTG-3' (SEQ ID NO: 3318)

5'-UAAUUCUGAACCAUUUCUAUAACCG$^\text{A}$$^\text{C-3'}$ (SEQ ID NO: 6646)
3'-AUUAAGACUUGGUAAAGAUAUUGGC$_\text{G}$$_\text{U-5'}$ (SEQ ID NO: 2210)

βc-m3531 Target: 5'-TAATTCTGAACCATTTCTATAACCGCA-3' (SEQ ID NO: 3319)

5'-UUUAAUUCUGAACCAUUUCUAUAAC$^\text{A}$$^\text{A-3'}$ (SEQ ID NO: 6647)
3'-AAAUUAAGACUUGGUAAAGAUAUUG$_\text{G}$$_\text{C-5'}$ (SEQ ID NO: 2211)

βc-m3533 Target: 5'-TTTAATTCTGAACCATTTCTATAACCG-3' (SEQ ID NO: 3320)

5'-GUUUAAUUCUGAACCAUUUCUAUAA$^\text{A}$$^\text{A-3'}$ (SEQ ID NO: 6648)
3'-CAAAUUAAGACUUGGUAAAGAUAUU$_\text{G}$$_\text{G-5'}$ (SEQ ID NO: 2212)

βc-m3534 Target: 5'-GTTTAATTCTGAACCATTTCTATAACC-3' (SEQ ID NO: 3321)

5'-AGUUUAAUUCUGAACCAUUUCUAUA$^\text{C}$$^\text{A-3'}$ (SEQ ID NO: 6649)
3'-UCAAAUUAAGACUUGGUAAAGAUAU$_\text{U}$$_\text{G-5'}$ (SEQ ID NO: 2213)

βc-m3535 Target: 5'-AGTTTAATTCTGAACCATTTCTATAAC-3' (SEQ ID NO: 3322)

5'-AAGUUUAAUUCUGAACCAUUUCUAU$^\text{C}$$^\text{C-3'}$ (SEQ ID NO: 6650)
3'-UUCAAAUUAAGACUUGGUAAAGAUA$_\text{U}$$_\text{U-5'}$ (SEQ ID NO: 2214)

βc-m3536 Target: 5'-AAGTTTAATTCTGAACCATTTCTATAA-3' (SEQ ID NO: 3323)

5'-AUUAAAAGUUUAAUUCUGAACCAUU$^\text{C}$$^\text{A-3'}$ (SEQ ID NO: 6651)
3'-UAAUUUUCAAAUUAAGACUUGGUAA$_\text{A}$$_\text{G-5'}$ (SEQ ID NO: 2215)

βc-m3541 Target: 5'-ATTAAAAGTTTAATTCTGAACCATTTC-3' (SEQ ID NO: 3324)

5'-AAUUAAAAGUUUAAUUCUGAACCAU$^\text{C}$$^\text{C-3'}$ (SEQ ID NO: 6652)
3'-UUAAUUUUCAAAUUAAGACUUGGUA$_\text{A}$$_\text{A-5'}$ (SEQ ID NO: 2216)

βc-m3542 Target: 5'-AATTAAAAGTTTAATTCTGAACCATTT-3' (SEQ ID NO: 3325)

TABLE 12-continued

Additional Selected Anti-β-catenin DsiRNAs, Blunt/Frayed Duplexes

5'-UGAAUUAAAAGUUUAAUUCUGAACC$^{CC-3'}$ (SEQ ID NO: 6653)
3'-ACUUAAUUUUCAAAUUAAGACUUGG$_{UA-5'}$ (SEQ ID NO: 2217)

βc-m3544 Target: 5'-TGAATTAAAAGTTTAATTCTGAACC-3' (SEQ ID NO: 3326)

5'-UUUGAAUGAAUUAAAAGUUUAAUUC$^{CA-3'}$ (SEQ ID NO: 6654)
3'-AAACUUACUUAAUUUUCAAAUUAAG$_{AC-5'}$ (SEQ ID NO: 2218)

βc-m3550 Target: 5'-TTTGAATGAATTAAAAGTTTAATTCTG-3' (SEQ ID NO: 3327)

5'-UUUUUUUGAAUGAAUUAAAAGUUUA$^{CC-3'}$ (SEQ ID NO: 6655)
3'-AAAAAAACUUACUUAAUUUUCAAAU$_{UA-5'}$ (SEQ ID NO: 2219)

βc-m3554 Target: 5'-TTTTTTTGAATGAATTAAAAGTTTAAT-3' (SEQ ID NO: 3328)

5'-UUUUUUUUUUUGAAUGAAUUAAAAG$^{CC-3'}$ (SEQ ID NO: 6656)
3'-AAAAAAAAAACUUACUUAAUUUUC$_{AA-5'}$ (SEQ ID NO: 2220)

βc-m3558 Target: 5'-TTTTTTTTTTGAATGAATTAAAAGTT-3' (SEQ ID NO: 3329)

5'-UUUUUUUUUUUUGAAUGAAUUAAAA$^{AC-3'}$ (SEQ ID NO: 6657)
3'-AAAAAAAAAAACUUACUUAAUUUUU$_{CA-5'}$ (SEQ ID NO: 2221)

βc-m3559 Target: 5'-TTTTTTTTTTTGAATGAATTAAAAGT-3' (SEQ ID NO: 3330)

5'-UUUUUUUUUUUUUGAAUGAAUUAAA$^{CA-3'}$ (SEQ ID NO: 6658)
3'-AAAAAAAAAAAACUUACUUAAUUUU$_{UC-5'}$ (SEQ ID NO: 2222)

βc-m3560 Target: 5'-TTTTTTTTTTTTGAATGAATTAAAAG-3' (SEQ ID NO: 3331)

5'-UUUUUUUUUUUUUUGAAUGAAUUAA$^{CC-3'}$ (SEQ ID NO: 6659)
3'-AAAAAAAAAAAAACUUACUUAAUUU$_{UU-5'}$ (SEQ ID NO: 2223)

βc-m3561 Target: 5'-TTTTTTTTTTTTTGAATGAATTAAAA-3' (SEQ ID NO: 3332)

5'-UUUUUUUUUUUUUUUGAAUGAAUUA$^{CC-3'}$ (SEQ ID NO: 6660)
3'-AAAAAAAAAAAAAACUUACUUAAUU$_{UU-5'}$ (SEQ ID NO: 2224)

βc-m3562 Target: 5'-TTTTTTTTTTTTTTGAATGAATTAAA-3' (SEQ ID NO: 3333)

5'-UUUUUUUUUUUUUUUUGAAUGAAUU$^{CC-3'}$ (SEQ ID NO: 6661)
3'-AAAAAAAAAAAAAAACUUACUUAAA$_{UU-5'}$ (SEQ ID NO: 2225)

βc-m3563 Target: 5'-TTTTTTTTTTTTTTTGAATGAATTAA-3' (SEQ ID NO: 3334)

TABLE 13

Additional Selected Anti-β-catenin DsiRNAs, Blunt, Unfrayed Duplexes

| | | |
|---|---|---|
| | 5'-GUUGUAUGGUAUACUUCAAAUACCCUC-3' | (SEQ ID NO: 7150) |
| | 3'-CAACAUACCAUAUGAAGUUUAUGGGAG-5' | (SEQ ID NO: 1605) |
| βc-244 Target: | 5'-GTTGTATGGTATACTTCAAATACCCTC-3' | (SEQ ID NO: 2714) |
| | 5'-CAAAACAGUUGUAUGGUAUACUUCAAA-3' | (SEQ ID NO: 7151) |
| | 3'-GUUUUGUCAACAUACCAUAUGAAGUUU-5' | (SEQ ID NO: 1606) |
| βc-251 Target: | 5'-CAAAACAGTTGTATGGTATACTTCAAA-3' | (SEQ ID NO: 2715) |

TABLE 13-continued

Additional Selected Anti-β-catenin DsiRNAs, Blunt, Unfrayed Duplexes

|  |  |  |  |
|---|---|---|---|
|  | 5'-UCAAAACAGUUGUAUGGUAUACUUCAA-3' | (SEQ ID NO: 7152) |
|  | 3'-AGUUUUGUCAACAUACCAUAUGAAGUU-5' | (SEQ ID NO: 1607) |
| βc-252 Target: | 5'-TCAAAACAGTTGTATGGTATACTTCAA-3' | (SEQ ID NO: 2716) |
|  | 5'-UUUCAAAACAGUUGUAUGGUAUACUUC-3' | (SEQ ID NO: 7153) |
|  | 3'-AAAGUUUUGUCAACAUACCAUAUGAAG-5' | (SEQ ID NO: 1608) |
| βc-254 Target: | 5'-TTTCAAAACAGTTGTATGGTATACTTC-3' | (SEQ ID NO: 2717) |
|  | 5'-UUUUCAAAACAGUUGUAUGGUAUACUU-3' | (SEQ ID NO: 7154) |
|  | 3'-AAAAGUUUUGUCAACAUACCAUAUGAA-5' | (SEQ ID NO: 1609) |
| βc-255 Target: | 5'-TTTTCAAAACAGTTGTATGGTATACTT-3' | (SEQ ID NO: 2718) |
|  | 5'-AUUUUCAAAACAGUUGUAUGGUAUACU-3' | (SEQ ID NO: 7155) |
|  | 3'-UAAAAGUUUUGUCAACAUACCAUAUGA-5' | (SEQ ID NO: 1610) |
| βc-256 Target: | 5'-ATTTTCAAAACAGTTGTATGGTATACT-3' | (SEQ ID NO: 2719) |
|  | 5'-UUGUCCACGCUGGAUUUUCAAAACAGU-3' | (SEQ ID NO: 7156) |
|  | 3'-AACAGGUGCGACCUAAAAGUUUUGUCA-5' | (SEQ ID NO: 1611) |
| βc-269 Target: | 5'-TTGTCCACGCTGGATTTTCAAAACAGT-3' | (SEQ ID NO: 2720) |
|  | 5'-AUUGUCCACGCUGGAUUUUCAAAACAG-3' | (SEQ ID NO: 7157) |
|  | 3'-UAACAGGUGCGACCUAAAAGUUUUGUC-5' | (SEQ ID NO: 1612) |
| βc-270 Target: | 5'-ATTGTCCACGCTGGATTTTCAAAACAG-3' | (SEQ ID NO: 2721) |
|  | 5'-CCAUCAAAUCAGCUUGAGUAGCCAUUG-3' | (SEQ ID NO: 7158) |
|  | 3'-GGUAGUUUAGUCGAACUCAUCGGUAAC-5' | (SEQ ID NO: 1613) |
| βc-293 Target: | 5'-CCATCAAATCAGCTTGAGTAGCCATTG-3' | (SEQ ID NO: 2722) |
|  | 5'-UGUCCAACUCCAUCAAAUCAGCUUGAG-3' | (SEQ ID NO: 7159) |
|  | 3'-ACAGGUUGAGGUAGUUUAGUCGAACUC-5' | (SEQ ID NO: 1614) |
| βc-302 Target: | 5'-TGTCCAACTCCATCAAATCAGCTTGAG-3' | (SEQ ID NO: 2723) |
|  | 5'-CUUCCUCAGGAUUGCCUUUACCACUCA-3' | (SEQ ID NO: 7160) |
|  | 3'-GAAGGAGUCCUAACGGAAAUGGUGAGU-5' | (SEQ ID NO: 1615) |
| βc-431 Target: | 5'-CTTCCTCAGGATTGCCTTTACCACTCA-3' | (SEQ ID NO: 2724) |
|  | 5'-UCUUCCUCAGGAUUGCCUUUACCACUC-3' | (SEQ ID NO: 7161) |
|  | 3'-AGAAGGAGUCCUAACGGAAAUGGUGAG-5' | (SEQ ID NO: 1616) |
| βc-432 Target: | 5'-TCTTCCTCAGGATTGCCTTTACCACTC-3' | (SEQ ID NO: 2725) |
|  | 5'-CAUCAAUAUCAGCUACUUGUUCUUGAG-3' | (SEQ ID NO: 7162) |
|  | 3'-GUAGUUAUAGUCGAUGAACAAGAACUC-5' | (SEQ ID NO: 1617) |
| βc-518 Target: | 5'-CATCAATATCAGCTACTTGTTCTTGAG-3' | (SEQ ID NO: 2726) |
|  | 5'-CCAUCAAUAUCAGCUACUUGUUCUUGA-3' | (SEQ ID NO: 7163) |
|  | 3'-GGUAGUUAUAGUCGAUGAACAAGAACU-5' | (SEQ ID NO: 1618) |
| βc-519 Target: | 5'-CCATCAATATCAGCTACTTGTTCTTGA-3' | (SEQ ID NO: 2727) |
|  | 5'-ACUGUCCAUCAAUAUCAGCUACUUGUU-3' | (SEQ ID NO: 7164) |
|  | 3'-UGACAGGUAGUUAUAGUCGAUGAACAA-5' | (SEQ ID NO: 1619) |
| βc-524 Target: | 5'-ACTGTCCATCAATATCAGCTACTTGTT-3' | (SEQ ID NO: 2728) |

TABLE 13-continued

Additional Selected Anti-β-catenin DsiRNAs, Blunt, Unfrayed Duplexes

|  |  |  |  |
|---|---|---|---|
|  | 5'-AUUGCAUACUGUCCAUCAAUAUCAGCU-3' | (SEQ ID NO: 7165) |  |
|  | 3'-UAACGUAUGACAGGUAGUUAUAGUCGA-5' | (SEQ ID NO: 1620) |  |
| βc-531 Target: | 5'-ATTGCATACTGTCCATCAATATCAGCT-3' | (SEQ ID NO: 2729) |  |
|  | 5'-CGAGUCAUUGCAUACUGUCCAUCAAUA-3' | (SEQ ID NO: 7166) |  |
|  | 3'-GCUCAGUAACGUAUGACAGGUAGUUAU-5' | (SEQ ID NO: 1621) |  |
| βc-537 Target: | 5'-CGAGTCATTGCATACTGTCCATCAATA-3' | (SEQ ID NO: 2730) |  |
|  | 5'-CCUCAUCUAAUGUCUCAGGGAACAUAG-3' | (SEQ ID NO: 7167) |  |
|  | 3'-GGAGUAGAUUACAGAGUCCCUUGUAUC-5' | (SEQ ID NO: 1622) |  |
| βc-584 Target: | 5'-CCTCATCTAATGTCTCAGGGAACATAG-3' | (SEQ ID NO: 2731) |  |
|  | 5'-UUACAACUGCAUGUUUCAGCAUCUGUG-3' | (SEQ ID NO: 7168) |  |
|  | 3'-AAUGUUGACGUACAAAGUCGUAGACAC-5' | (SEQ ID NO: 1623) |  |
| βc-680 Target: | 5'-TTACAACTGCATGTTTCAGCATCTGTG-3' | (SEQ ID NO: 2732) |  |
|  | 5'-GUUUACAACUGCAUGUUUCAGCAUCUG-3' | (SEQ ID NO: 7169) |  |
|  | 3'-CAAAUGUUGACGUACAAAGUCGUAGAC-5' | (SEQ ID NO: 1624) |  |
| βc-682 Target: | 5'-GTTTACAACTGCATGTTTCAGCATCTG-3' | (SEQ ID NO: 2733) |  |
|  | 5'-AGUUAAUCAAGUUUACAACUGCAUGUU-3' | (SEQ ID NO: 7170) |  |
|  | 3'-UCAAUUAGUUCAAAUGUUGACGUACAA-5' | (SEQ ID NO: 1625) |  |
| βc-692 Target: | 5'-AGTTAATCAAGTTTACAACTGCATGTT-3' | (SEQ ID NO: 2734) |  |
|  | 5'-CUUGAUAGUUAAUCAAGUUUACAACUG-3' | (SEQ ID NO: 7171) |  |
|  | 3'-GAACUAUCAAUUAGUUCAAAUGUUGAC-5' | (SEQ ID NO: 1626) |  |
| βc-698 Target: | 5'-CTTGATAGTTAATCAAGTTTACAACTG-3' | (SEQ ID NO: 2735) |  |
|  | 5'-CUGCAUCAUCUUGAUAGUUAAUCAAGU-3' | (SEQ ID NO: 7172) |  |
|  | 3'-GACGUAGUAGAACUAUCAAUUAGUUCA-5' | (SEQ ID NO: 1627) |  |
| βc-707 Target: | 5'-CTGCATCATCTTGATAGTTAATCAAGT-3' | (SEQ ID NO: 2736) |  |
|  | 5'-UCUGCAUCAUCUUGAUAGUUAAUCAAG-3' | (SEQ ID NO: 7173) |  |
|  | 3'-AGACGUAGUAGAACUAUCAAUUAGUUC-5' | (SEQ ID NO: 1628) |  |
| βc-708 Target: | 5'-TCTGCATCATCTTGATAGTTAATCAAG-3' | (SEQ ID NO: 2737) |  |
|  | 5'-CUGGUCCUCGUCAUUUAGCAGUUUUGU-3' | (SEQ ID NO: 7174) |  |
|  | 3'-GACCAGGAGCAGUAAAUCGUCAAAACA-5' | (SEQ ID NO: 1629) |  |
| βc-763 Target: | 5'-CTGGTCCTCGTCATTTAGCAGTTTTGT-3' | (SEQ ID NO: 2738) |  |
|  | 5'-CAUAACUGCAGCCUUAUUAACCACCAC-3' | (SEQ ID NO: 7175) |  |
|  | 3'-GUAUUGACGUCGGAAUAAUUGGUGGUG-5' | (SEQ ID NO: 1630) |  |
| βc-790 Target: | 5'-CATAACTGCAGCCTTATTAACCACCAC-3' | (SEQ ID NO: 2739) |  |
|  | 5'-CCAUAACUGCAGCCUUAUUAACCACCA-3' | (SEQ ID NO: 7176) |  |
|  | 3'-GGUAUUGACGUCGGAAUAAUUGGUGGU-5' | (SEQ ID NO: 1631) |  |
| βc-791 Target: | 5'-CCATAACTGCAGCCTTATTAACCACCA-3' | (SEQ ID NO: 2740) |  |
|  | 5'-GGACCAUAACUGCAGCCUUAUUAACCA-3' | (SEQ ID NO: 7177) |  |
|  | 3'-CCUGGUAUUGACGUCGGAAUAAUUGGU-5' | (SEQ ID NO: 1632) |  |
| βc-794 Target: | 5'-GGACCATAACTGCAGCCTTATTAACCA-3' | (SEQ ID NO: 2741) |  |

TABLE 13-continued

Additional Selected Anti-β-catenin DsiRNAs, Blunt, Unfrayed Duplexes

|  |  |  |  |
|---|---|---|---|
|  | 5'-CCUUUUUAGAAAGCUGAUGGACCAUAA-3' | (SEQ ID NO: 7178) |
|  | 3'-GGAAAAAUCUUUCGACUACCUGGUAUU-5' | (SEQ ID NO: 1633) |
| βc-812 Target: | 5'-CCTTTTTAGAAAGCTGATGGACCATAA-3' | (SEQ ID NO: 2742) |
|  | 5'-AUGGUACGUACAAUAGCAGACACCAUC-3' | (SEQ ID NO: 7179) |
|  | 3'-UACCAUGCAUGUUAUCGUCUGUGGUAG-5' | (SEQ ID NO: 1634) |
| βc-873 Target: | 5'-ATGGTACGTACAATAGCAGACACCATC-3' | (SEQ ID NO: 2743) |
|  | 5'-CAUCAUUUGUAUUCUGCAUGGUACGUA-3' | (SEQ ID NO: 7180) |
|  | 3'-GUAGUAAACAUAAGACGUACCAUGCAU-5' | (SEQ ID NO: 1635) |
| βc-890 Target: | 5'-CATCATTTGTATTCTGCATGGTACGTA-3' | (SEQ ID NO: 2744) |
|  | 5'-CUGUUUCUACAUCAUUUGUAUUCUGCA-3' | (SEQ ID NO: 7181) |
|  | 3'-GACAAAGAUGUAGUAAACAUAAGACGU-5' | (SEQ ID NO: 1636) |
| βc-899 Target: | 5'-CTGTTTCTACATCATTTGTATTCTGCA-3' | (SEQ ID NO: 2745) |
|  | 5'-GCUGUUUCUACAUCAUUUGUAUUCUGC-3' | (SEQ ID NO: 7182) |
|  | 3'-CGACAAAGAUGUAGUAAACAUAAGACG-5' | (SEQ ID NO: 1637) |
| βc-900 Target: | 5'-GCTGTTTCTACATCATTTGTATTCTGC-3' | (SEQ ID NO: 2746) |
|  | 5'-GUACAACGAGCUGUUUCUACAUCAUUU-3' | (SEQ ID NO: 7183) |
|  | 3'-CAUGUUGCUCGACAAAGAUGUAGUAAA-5' | (SEQ ID NO: 1638) |
| βc-909 Target: | 5'-GTACAACGAGCTGTTTCTACATCATTT-3' | (SEQ ID NO: 2747) |
|  | 5'-CGGUACAACGAGCUGUUUCUACAUCAU-3' | (SEQ ID NO: 7184) |
|  | 3'-GCCAUGUUGCUCGACAAAGAUGUAGUA-5' | (SEQ ID NO: 1639) |
| βc-911 Target: | 5'-CGGTACAACGAGCTGTTTCTACATC-3' | (SEQ ID NO: 2748) |
|  | 5'-GCGGUACAACGAGCUGUUUCUACAUCA-3' | (SEQ ID NO: 7185) |
|  | 3'-CGCCAUGUUGCUCGACAAAGAUGUAGU-5' | (SEQ ID NO: 1640) |
| βc-912 Target: | 5'-GCGGTACAACGAGCTGTTTCTACATCA-3' | (SEQ ID NO: 2749) |
|  | 5'-GCAUAAAACAACACAGAAUCCACUGGU-3' | (SEQ ID NO: 7186) |
|  | 3'-CGUAUUUUGUUGUGUCUUAGGUGACCA-5' | (SEQ ID NO: 1641) |
| βc-1032 Target: | 5'-GCATAAAACAACACAGAATCCACTGGT-3' | (SEQ ID NO: 2750) |
|  | 5'-UGGCAUAAAACAACACAGAAUCCACUG-3' | (SEQ ID NO: 7187) |
|  | 3'-ACCGUAUUUUGUUGUGUCUUAGGUGAC-5' | (SEQ ID NO: 1642) |
| βc-1034 Target: | 5'-TGGCATAAAACAACACAGAATCCACTG-3' | (SEQ ID NO: 2751) |
|  | 5'-AUGGCAUAAAACAACACAGAAUCCACU-3' | (SEQ ID NO: 7188) |
|  | 3'-UACCGUAUUUUGUUGUGUCUUAGGUGA-5' | (SEQ ID NO: 1643) |
| βc-1035 Target: | 5'-ATGGCATAAAACAACACAGAATCCACT-3' | (SEQ ID NO: 2752) |
|  | 5'-UAGCUCCUUCUUGAUGUAAUAAAAGGU-3' | (SEQ ID NO: 7189) |
|  | 3'-AUCGAGGAAGAACUACAUUAUUUUCCA-5' | (SEQ ID NO: 1644) |
| βc-1076 Target: | 5'-TAGCTCCTTCTTGATGTAATAAAAGGT-3' | (SEQ ID NO: 2753) |
|  | 5'-UUAGCUCCUUCUUGAUGUAAUAAAAGG-3' | (SEQ ID NO: 7190) |
|  | 3'-AAUCGAGGAAGAACUACAUUAUUUUCC-5' | (SEQ ID NO: 1645) |
| βc-1077 Target: | 5'-TTAGCTCCTTCTTGATGTAATAAAAGG-3' | (SEQ ID NO: 2754) |

TABLE 13-continued

Additional Selected Anti-β-catenin DsiRNAs, Blunt, Unfrayed Duplexes

|  |  |  |  |
|---|---|---|---|
|  | 5'-UUUAACAUUUGUUUUGUUGAGCAAGGC-3' | (SEQ ID NO: 7191) |
|  | 3'-AAAUUGUAAACAAAACAACUCGUUCCG-5' | (SEQ ID NO: 1646) |
| βc-1144 Target: | 5'-TTTAACATTTGTTTTGTTGAGCAAGGC-3' | (SEQ ID NO: 2755) |
|  | 5'-UAGCCAAGAAUUUAACAUUUGUUUUGU-3' | (SEQ ID NO: 7192) |
|  | 3'-AUCGGUUCUUAAAUUGUAAACAAAACA-5' | (SEQ ID NO: 1647) |
| βc-1154 Target: | 5'-TAGCCAAGAATTTAACATTTGTTTTGT-3' | (SEQ ID NO: 2756) |
|  | 5'-CGUAAUAGCCAAGAAUUUAACAUUUGU-3' | (SEQ ID NO: 7193) |
|  | 3'-GCAUUAUCGGUUCUUAAAUUGUAAACA-5' | (SEQ ID NO: 1648) |
| βc-1159 Target: | 5'-CGTAATAGCCAAGAATTTAACATTTGT-3' | (SEQ ID NO: 2757) |
|  | 5'-UCGUAAUAGCCAAGAAUUUAACAUUUG-3' | (SEQ ID NO: 7194) |
|  | 3'-AGCAUUAUCGGUUCUUAAAUUGUAAAC-5' | (SEQ ID NO: 1649) |
| βc-1160 Target: | 5'-TCGTAATAGCCAAGAATTTAACATTTG-3' | (SEQ ID NO: 2758) |
|  | 5'-UAAGCUAAAAUUUGAAGGCAGUCUGUC-3' | (SEQ ID NO: 7195) |
|  | 3'-AUUCGAUUUUAAACUUCCGUCAGACAG-5' | (SEQ ID NO: 1650) |
| βc-1185 Target: | 5'-TAAGCTAAAATTTGAAGGCAGTCTGTC-3' | (SEQ ID NO: 2759) |
|  | 5'-UAGGUCCUCAUUAUAUUUACUAAAGCU-3' | (SEQ ID NO: 7196) |
|  | 3'-AUCCAGGAGUAAUAUAAAUGAUUUCGA-5' | (SEQ ID NO: 1651) |
| βc-1260 Target: | 5'-TAGGTCCTCATTATATTTACTAAAGCT-3' | (SEQ ID NO: 2760) |
|  | 5'-AAGUAUAGGUCCUCAUUAUAUUUACUA-3' | (SEQ ID NO: 7197) |
|  | 3'-UUCAUAUCCAGGAGUAAUAUAAAUGAU-5' | (SEQ ID NO: 1652) |
| βc-1265 Target: | 5'-AAGTATAGGTCCTCATTATATTTACTA-3' | (SEQ ID NO: 2761) |
|  | 5'-UAAGUAUAGGUCCUCAUUAUAUUUACU-3' | (SEQ ID NO: 7198) |
|  | 3'-AUUCAUAUCCAGGAGUAAUAUAAAUGA-5' | (SEQ ID NO: 1653) |
| βc-1266 Target: | 5'-TAAGTATAGGTCCTCATTATATTTACT-3' | (SEQ ID NO: 2762) |
|  | 5'-GUUUUUCGUAAGUAUAGGUCCUCAUUA-3' | (SEQ ID NO: 7199) |
|  | 3'-CAAAAAGCAUUCAUAUCCAGGAGUAAU-5' | (SEQ ID NO: 1654) |
| βc-1274 Target: | 5'-GTTTTTCGTAAGTATAGGTCCTCATTA-3' | (SEQ ID NO: 2763) |
|  | 5'-AGUUUUUCGUAAGUAUAGGUCCUCAUU-3' | (SEQ ID NO: 7200) |
|  | 3'-UCAAAAAGCAUUCAUAUCCAGGAGUAA-5' | (SEQ ID NO: 1655) |
| βc-1275 Target: | 5'-AGTTTTTCGTAAGTATAGGTCCTCATT-3' | (SEQ ID NO: 2764) |
|  | 5'-UAGUUUUUCGUAAGUAUAGGUCCUCAU-3' | (SEQ ID NO: 7201) |
|  | 3'-AUCAAAAAGCAUUCAUAUCCAGGAGUA-5' | (SEQ ID NO: 1656) |
| βc-1276 Target: | 5'-TAGTTTTTCGTAAGTATAGGTCCTC-3' | (SEQ ID NO: 2765) |
|  | 5'-GUAGUUUUUCGUAAGUAUAGGUCCUCA-3' | (SEQ ID NO: 7202) |
|  | 3'-CAUCAAAAAGCAUUCAUAUCCAGGAGU-5' | (SEQ ID NO: 1657) |
| βc-1277 Target: | 5'-GTAGTTTTTCGTAAGTATAGGTCCTCA-3' | (SEQ ID NO: 2766) |
|  | 5'-GUGGUCCACAGUAGUUUUUCGUAAGUA-3' | (SEQ ID NO: 7203) |
|  | 3'-CACCAGGUGUCAUCAAAAAGCAUUCAU-5' | (SEQ ID NO: 1658) |
| βc-1287 Target: | 5'-GTGGTCCACAGTAGTTTTTCGTAAGTA-3' | (SEQ ID NO: 2767) |

TABLE 13-continued

Additional Selected Anti-β-catenin DsiRNAs, Blunt, Unfrayed Duplexes

|  |  |  |
|---|---|---|
|  | 5'-UCUACAAUAGCCGGCUUAUUACUAGAG-3' | (SEQ ID NO: 7204) |
|  | 3'-AGAUGUUAUCGGCCGAAUAAUGAUCUC-5' | (SEQ ID NO: 1659) |
| βc-1344 Target: | 5'-TCTACAATAGCCGGCTTATTACTAGAG-3' | (SEQ ID NO: 2768) |
|  | 5'-CUUCUACAAUAGCCGGCUUAUUACUAG-3' | (SEQ ID NO: 7205) |
|  | 3'-GAAGAUGUUAUCGGCCGAAUAAUGAUC-5' | (SEQ ID NO: 1660) |
| βc-1346 Target: | 5'-CTTCTACAATAGCCGGCTTATTACTAG-3' | (SEQ ID NO: 2769) |
|  | 5'-AGUCCUAAAGCUUGCAUUCCACCAGCU-3' | (SEQ ID NO: 7206) |
|  | 3'-UCAGGAUUUCGAACGUAAGGUGGUCGA-5' | (SEQ ID NO: 1661) |
| βc-1371 Target: | 5'-AGTCCTAAAGCTTGCATTCCACCAGCT-3' | (SEQ ID NO: 2770) |
|  | 5'-AAGUCCUAAAGCUUGCAUUCCACCAGC-3' | (SEQ ID NO: 7207) |
|  | 3'-UUCAGGAUUUCGAACGUAAGGUGGUCG-5' | (SEQ ID NO: 1662) |
| βc-1372 Target: | 5'-AAGTCCTAAAGCTTGCATTCCACCAGC-3' | (SEQ ID NO: 2771) |
|  | 5'-GAAGUCCUAAAGCUUGCAUUCCACCAG-3' | (SEQ ID NO: 7208) |
|  | 3'-CUUCAGGAUUUCGAACGUAAGGUGGUC-5' | (SEQ ID NO: 1663) |
| βc-1373 Target: | 5'-GAAGTCCTAAAGCTTGCATTCCACCAG-3' | (SEQ ID NO: 2772) |
|  | 5'-CAGUUCUGAACAAGACGUUGACUUGGA-3' | (SEQ ID NO: 7209) |
|  | 3'-GUCAAGACUUGUUCUGCAACUGAACCU-5' | (SEQ ID NO: 1664) |
| βc-1410 Target: | 5'-CAGTTCTGAACAAGACGTTGACTTGGA-3' | (SEQ ID NO: 2773) |
|  | 5'-ACAGUUCUGAACAAGACGUUGACUUGG-3' | (SEQ ID NO: 7210) |
|  | 3'-UGUCAAGACUUGUUCUGCAACUGAACC-5' | (SEQ ID NO: 1665) |
| βc-1411 Target: | 5'-ACAGTTCTGAACAAGACGTTGACTTGG-3' | (SEQ ID NO: 2774) |
|  | 5'-GAGUCCAAAGACAGUUCUGAACAAGAC-3' | (SEQ ID NO: 7211) |
|  | 3'-CUCAGGUUUCUGUCAAGACUUGUUCUG-5' | (SEQ ID NO: 1666) |
| βc-1421 Target: | 5'-GAGTCCAAAGACAGTTCTGAACAAGAC-3' | (SEQ ID NO: 2775) |
|  | 5'-CCUUCCUGUUUAGUUGCAGCAUCUGAA-3' | (SEQ ID NO: 7212) |
|  | 3'-GGAAGGACAAAUCAACGUCGUAGACUU-5' | (SEQ ID NO: 1667) |
| βc-1458 Target: | 5'-CCTTCCTGTTTAGTTGCAGCATCTGAA-3' | (SEQ ID NO: 2776) |
|  | 5'-CCACAUUUAUAUCAUCUGAACCCAGAA-3' | (SEQ ID NO: 7213) |
|  | 3'-GGUGUAAAUAUAGUAGACUUGGGUCUU-5' | (SEQ ID NO: 1668) |
| βc-1517 Target: | 5'-CCACATTTATATCATCTGAACCCAGAA-3' | (SEQ ID NO: 2777) |
|  | 5'-UGACCACAUUUAUAUCAUCUGAACCCA-3' | (SEQ ID NO: 7214) |
|  | 3'-ACUGGUGUAAAUAUAGUAGACUUGGGU-5' | (SEQ ID NO: 1669) |
| βc-1520 Target: | 5'-TGACCACATTTATATCATCTGAACCCA-3' | (SEQ ID NO: 2778) |
|  | 5'-CUGCACAGGUGACCACAUUUAUAUCAU-3' | (SEQ ID NO: 7215) |
|  | 3'-GACGUGUCCACUGGUGUAAAUAUAGUA-5' | (SEQ ID NO: 1670) |
| βc-1529 Target: | 5'-CTGCACAGGTGACCACATTTATATC-3' | (SEQ ID NO: 2779) |
|  | 5'-GCUGCACAGGUGACCACAUUUAUAUCA-3' | (SEQ ID NO: 7216) |
|  | 3'-CGACGUGUCCACUGGUGUAAAUAUAGU-5' | (SEQ ID NO: 1671) |
| βc-1530 Target: | 5'-GCTGCACAGGTGACCACATTTATATCA-3' | (SEQ ID NO: 2780) |

TABLE 13-continued

Additional Selected Anti-β-catenin DsiRNAs, Blunt, Unfrayed Duplexes

|  |  |  |  |
|---|---|---|---|
|  | 5'-AUUGCAAGUGAGGUUAGAAAGAAUUCC-3' | (SEQ ID NO: 7217) |  |
|  | 3'-UAACGUUCACUCCAAUCUUUCUUAAGG-5' | (SEQ ID NO: 1672) |  |
| βc-1558 Target: | 5'-ATTGCAAGTGAGGTTAGAAAGAATTCC-3' | (SEQ ID NO: 2781) |  |
|  | 5'-UUAUAAUUAUUGCAAGUGAGGUUAGAA-3' | (SEQ ID NO: 7218) |  |
|  | 3'-AAUAUUAAUAACGUUCACUCCAAUCUU-5' | (SEQ ID NO: 1673) |  |
| βc-1566 Target: | 5'-TTATAATTATTGCAAGTGAGGTTAGAA-3' | (SEQ ID NO: 2782) |  |
|  | 5'-CAUCAUCUUGUUCUUAUAAUUAUUGCA-3' | (SEQ ID NO: 7219) |  |
|  | 3'-GUAGUAGAACAAGAAUAUUAAUAACGU-5' | (SEQ ID NO: 1674) |  |
| βc-1579 Target: | 5'-CATCATCTTGTTCTTATAATTATTGCA-3' | (SEQ ID NO: 2783) |  |
|  | 5'-CCAUCAUCUUGUUCUUAUAAUUAUUGC-3' | (SEQ ID NO: 7220) |  |
|  | 3'-GGUAGUAGAACAAGAAUAUUAAUAACG-5' | (SEQ ID NO: 1675) |  |
| βc-1580 Target: | 5'-CCATCATCTTGTTCTTATAATTATTGC-3' | (SEQ ID NO: 2784) |  |
|  | 5'-AGACCAUCAUCUUGUUCUUAUAAUUAU-3' | (SEQ ID NO: 7221) |  |
|  | 3'-UCUGGUAGUAGAACAAGAAUAUUAAUA-5' | (SEQ ID NO: 1676) |  |
| βc-1583 Target: | 5'-AGACCATCATCTTGTTCTTATAATTAT-3' | (SEQ ID NO: 2785) |  |
|  | 5'-GCAGACCAUCAUCUUGUUCUUAUAAUU-3' | (SEQ ID NO: 7222) |  |
|  | 3'-CGUCUGGUAGUAGAACAAGAAUAUUAA-5' | (SEQ ID NO: 1677) |  |
| βc-1585 Target: | 5'-GCAGACCATCATCTTGTTCTTATAATT-3' | (SEQ ID NO: 2786) |  |
|  | 5'-UCAAUCCAACAGUAGCCUUUAUCAGAG-3' | (SEQ ID NO: 7223) |  |
|  | 3'-AGUUAGGUUGUCAUCGGAAAUAGUCUC-5' | (SEQ ID NO: 1678) |  |
| βc-1808 Target: | 5'-TCAATCCAACAGTAGCCTTTATCAGAG-3' | (SEQ ID NO: 2787) |  |
|  | 5'-UCGAAUCAAUCCAACAGUAGCCUUUAU-3' | (SEQ ID NO: 7224) |  |
|  | 3'-AGCUUAGUUAGGUUGUCAUCGGAAAUA-5' | (SEQ ID NO: 1679) |  |
| βc-1813 Target: | 5'-TCGAATCAATCCAACAGTAGCCTTTAT-3' | (SEQ ID NO: 2788) |  |
|  | 5'-CCUCCACAAAUUGCUGCUGUGUCCCAC-3' | (SEQ ID NO: 7225) |  |
|  | 3'-GGAGGUGUUUAACGACGACACAGGGUG-5' | (SEQ ID NO: 1680) |  |
| βc-1955 Target: | 5'-CCTCCACAAATTGCTGCTGTGTCCCAC-3' | (SEQ ID NO: 2789) |  |
|  | 5'-GUACAACCUUCAACUAUUUCUUCCAUG-3' | (SEQ ID NO: 7226) |  |
|  | 3'-CAUGUUGGAAGUUGAUAAAGAAGGUAC-5' | (SEQ ID NO: 1681) |  |
| βc-1989 Target: | 5'-GTACAACCTTCAACTATTTCTTCCATG-3' | (SEQ ID NO: 2790) |  |
|  | 5'-GGUACAACCUUCAACUAUUUCUUCCAU-3' | (SEQ ID NO: 7227) |  |
|  | 3'-CCAUGUUGGAAGUUGAUAAAGAAGGUA-5' | (SEQ ID NO: 1682) |  |
| βc-1990 Target: | 5'-GGTACAACCTTCAACTATTTCTTCC-3' | (SEQ ID NO: 2791) |  |
|  | 5'-CGGUACAACCUUCAACUAUUUCUUCCA-3' | (SEQ ID NO: 7228) |  |
|  | 3'-GCCAUGUUGGAAGUUGAUAAAGAAGGU-5' | (SEQ ID NO: 1683) |  |
| βc-1991 Target: | 5'-CGGTACAACCTTCAACTATTTCTTCCA-3' | (SEQ ID NO: 2792) |  |
|  | 5'-CCGGUACAACCUUCAACUAUUUCUUCC-3' | (SEQ ID NO: 7229) |  |
|  | 3'-GGCCAUGUUGGAAGUUGAUAAAGAAGG-5' | (SEQ ID NO: 1684) |  |
| βc-1992 Target: | 5'-CCGGTACAACCTTCAACTATTTCTTCC-3' | (SEQ ID NO: 2793) |  |

TABLE 13-continued

Additional Selected Anti-β-catenin DsiRNAs, Blunt, Unfrayed Duplexes

|  |  |  |
|---|---|---|
|  | 5'-GGGCUCCGGUACAACCUUCAACUAUUU-3' | (SEQ ID NO: 7230) |
|  | 3'-CCCGAGGCCAUGUUGGAAGUUGAUAAA-5' | (SEQ ID NO: 1685) |
| βc-1997 Target: | 5'-GGGCTCCGGTACAACCTTCAACTATTT-3' | (SEQ ID NO: 2794) |
|  | 5'-UAACAAUUCGGUUGUGAACAUCCCGAG-3' | (SEQ ID NO: 7231) |
|  | 3'-AUUGUUAAGCCAACACUUGUAGGGCUC-5' | (SEQ ID NO: 1686) |
| βc-2036 Target: | 5'-TAACAATTCGGTTGTGAACATCCCGAG-3' | (SEQ ID NO: 2795) |
|  | 5'-AUAACAAUUCGGUUGUGAACAUCCCGA-3' | (SEQ ID NO: 7232) |
|  | 3'-UAUUGUUAAGCCAACACUUGUAGGGCU-5' | (SEQ ID NO: 1687) |
| βc-2037 Target: | 5'-ATAACAATTCGGTTGTGAACATCCCGA-3' | (SEQ ID NO: 2796) |
|  | 5'-GAUAACAAUUCGGUUGUGAACAUCCCG-3' | (SEQ ID NO: 7233) |
|  | 3'-CUAUUGUUAAGCCAACACUUGUAGGGC-5' | (SEQ ID NO: 1688) |
| βc-2038 Target: | 5'-GATAACAATTCGGTTGTGAACATCCCG-3' | (SEQ ID NO: 2797) |
|  | 5'-UGAUAACAAUUCGGUUGUGAACAUCCC-3' | (SEQ ID NO: 7234) |
|  | 3'-ACUAUUGUUAAGCCAACACUUGUAGGG-5' | (SEQ ID NO: 1689) |
| βc-2039 Target: | 5'-TGATAACAATTCGGTTGTGAACATCCC-3' | (SEQ ID NO: 2798) |
|  | 5'-CUGAUAACAAUUCGGUUGUGAACAUCC-3' | (SEQ ID NO: 7235) |
|  | 3'-GACUAUUGUUAAGCCAACACUUGUAGG-5' | (SEQ ID NO: 1690) |
| βc-2040 Target: | 5'-CTGATAACAATTCGGTTGTGAACATCC-3' | (SEQ ID NO: 2799) |
|  | 5'-UCUGAUAACAAUUCGGUUGUGAACAUC-3' | (SEQ ID NO: 7236) |
|  | 3'-AGACUAUUGUUAAGCCAACACUUGUAG-5' | (SEQ ID NO: 1691) |
| βc-2041 Target: | 5'-TCTGATAACAATTCGGTTGTGAACATC-3' | (SEQ ID NO: 2800) |
|  | 5'-GUAUUUAGUCCUCUGAUAACAAUUCGG-3' | (SEQ ID NO: 7237) |
|  | 3'-CAUAAAUCAGGAGACUAUUGUUAAGCC-5' | (SEQ ID NO: 1692) |
| βc-2052 Target: | 5'-GTATTTAGTCCTCTGATAACAATTCGG-3' | (SEQ ID NO: 2801) |
|  | 5'-GGUAUUUAGUCCUCUGAUAACAAUUCG-3' | (SEQ ID NO: 7238) |
|  | 3'-CCAUAAAUCAGGAGACUAUUGUUAAGC-5' | (SEQ ID NO: 1693) |
| βc-2053 Target: | 5'-GGTATTTAGTCCTCTGATAACAATTCG-3' | (SEQ ID NO: 2802) |
|  | 5'-UGGUAUUUAGUCCUCUGAUAACAAUUC-3' | (SEQ ID NO: 7239) |
|  | 3'-ACCAUAAAUCAGGAGACUAUUGUUAAG-5' | (SEQ ID NO: 1694) |
| βc-2054 Target: | 5'-TGGTATTTAGTCCTCTGATAACAATTC-3' | (SEQ ID NO: 2803) |
|  | 5'-AUGGUAUUUAGUCCUCUGAUAACAAUU-3' | (SEQ ID NO: 7240) |
|  | 3'-UACCAUAAAUCAGGAGACUAUUGUUAA-5' | (SEQ ID NO: 1695) |
| βc-2055 Target: | 5'-ATGGTATTTAGTCCTCTGATAACAATT-3' | (SEQ ID NO: 2804) |
|  | 5'-AAACAAUGGAAUGGUAUUUAGUCCUCU-3' | (SEQ ID NO: 7241) |
|  | 3'-UUUGUUACCUUACCAUAAAUCAGGAGA-5' | (SEQ ID NO: 1696) |
| βc-2065 Target: | 5'-AAACAATGGAATGGTATTTAGTCCTCT-3' | (SEQ ID NO: 2805) |
|  | 5'-GCACAAACAAUGGAAUGGUAUUUAGUC-3' | (SEQ ID NO: 7242) |
|  | 3'-CGUGUUUGUUACCUUACCAUAAAUCAG-5' | (SEQ ID NO: 1697) |
| βc-2069 Target: | 5'-GCACAAACAATGGAATGGTATTTAGTC-3' | (SEQ ID NO: 2806) |

TABLE 13-continued

Additional Selected Anti-β-catenin DsiRNAs, Blunt, Unfrayed Duplexes

|  |  |  |  |
|---|---|---|---|
|  | 5'-CUGCACAAACAAUGGAAUGGUAUUUAG-3' | (SEQ ID NO: 7243) |
|  | 3'-GACGUGUUUGUUACCUUACCAUAAAUC-5' | (SEQ ID NO: 1698) |
| βc-2071 Target: | 5'-CTGCACAAACAATGGAATGGTATTTAG-3' | (SEQ ID NO: 2807) |
|  | 5'-GCUGCACAAACAAUGGAAUGGUAUUUA-3' | (SEQ ID NO: 7244) |
|  | 3'-CGACGUGUUUGUUACCUUACCAUAAAU-5' | (SEQ ID NO: 1699) |
| βc-2072 Target: | 5'-GCTGCACAAACAATGGAATGGTATTTA-3' | (SEQ ID NO: 2808) |
|  | 5'-CAGCUACUCUUUGGAUGUUUUCAAUGG-3' | (SEQ ID NO: 7245) |
|  | 3'-GUCGAUGAGAAACCUACAAAAGUUACC-5' | (SEQ ID NO: 1700) |
| βc-2111 Target: | 5'-CAGCTACTCTTTGGATGTTTTCAATGG-3' | (SEQ ID NO: 2809) |
|  | 5'-GCAGCUACUCUUUGGAUGUUUUCAAUG-3' | (SEQ ID NO: 7246) |
|  | 3'-CGUCGAUGAGAAACCUACAAAAGUUAC-5' | (SEQ ID NO: 1701) |
| βc-2112 Target: | 5'-GCAGCTACTCTTTGGATGTTTTCAATG-3' | (SEQ ID NO: 2810) |
|  | 5'-CAGCUUCAAUAGCUUCUGCAGCUUCCU-3' | (SEQ ID NO: 7247) |
|  | 3'-GUCGAAGUUAUCGAAGACGUCGAAGGA-5' | (SEQ ID NO: 1702) |
| βc-2168 Target: | 5'-CAGCTTCAATAGCTTCTGCAGCTTCCT-3' | (SEQ ID NO: 2811) |
|  | 5'-GCUCCCUCAGCUUCAAUAGCUUCUGCA-3' | (SEQ ID NO: 7248) |
|  | 3'-CGAGGGAGUCGAAGUUAUCGAAGACGU-5' | (SEQ ID NO: 1703) |
| βc-2175 Target: | 5'-GCTCCCTCAGCTTCAATAGCTTCTGCA-3' | (SEQ ID NO: 2812) |
|  | 5'-UGGCUCCCUCAGCUUCAAUAGCUUCUG-3' | (SEQ ID NO: 7249) |
|  | 3'-ACCGAGGGAGUCGAAGUUAUCGAAGAC-5' | (SEQ ID NO: 1704) |
| βc-2177 Target: | 5'-TGGCTCCCTCAGCTTCAATAGCTTCTG-3' | (SEQ ID NO: 2813) |
|  | 5'-UCAUUCCUAGAGUGAAGUAACUCUGUC-3' | (SEQ ID NO: 7250) |
|  | 3'-AGUAAGGAUCUCACUUCAUUGAGACAG-5' | (SEQ ID NO: 1705) |
| βc-2214 Target: | 5'-TCATTCCTAGAGTGAAGTAACTCTGTC-3' | (SEQ ID NO: 2814) |
|  | 5'-CUUCAUUCCUAGAGUGAAGUAACUCUG-3' | (SEQ ID NO: 7251) |
|  | 3'-GAAGUAAGGAUCUCACUUCAUUGAGAC-5' | (SEQ ID NO: 1706) |
| βc-2216 Target: | 5'-CTTCATTCCTAGAGTGAAGTAACTCTG-3' | (SEQ ID NO: 2815) |
|  | 5'-CCUUCAUUCCUAGAGUGAAGUAACUCU-3' | (SEQ ID NO: 7252) |
|  | 3'-GGAAGUAAGGAUCUCACUUCAUUGAGA-5' | (SEQ ID NO: 1707) |
| βc-2217 Target: | 5'-CCTTCATTCCTAGAGTGAAGTAACTCT-3' | (SEQ ID NO: 2816) |
|  | 5'-UGUCCUCAGACAUUCGGAACAAAACAG-3' | (SEQ ID NO: 7253) |
|  | 3'-ACAGGAGUCUGUAAGCCUUGUUUUGUC-5' | (SEQ ID NO: 1708) |
| βc-2264 Target: | 5'-TGTCCTCAGACATTCGGAACAAAACAG-3' | (SEQ ID NO: 2817) |
|  | 5'-CUUGUCCUCAGACAUUCGGAACAAAAC-3' | (SEQ ID NO: 7254) |
|  | 3'-GAACAGGAGUCUGUAAGCCUUGUUUUG-5' | (SEQ ID NO: 1709) |
| βc-2266 Target: | 5'-CTTGTCCTCAGACATTCGGAACAAAAC-3' | (SEQ ID NO: 2818) |
|  | 5'-CCGUUUCUUGUAAUCUUGUGGCUUGUC-3' | (SEQ ID NO: 7255) |
|  | 3'-GGCAAAGAACAUUAGAACACCGAACAG-5' | (SEQ ID NO: 1710) |
| βc-2287 Target: | 5'-CCGTTTCTTGTAATCTTGTGGCTTGTC-3' | (SEQ ID NO: 2819) |

TABLE 13-continued

Additional Selected Anti-β-catenin DsiRNAs, Blunt, Unfrayed Duplexes

|  |  |  |  |
|---|---|---|---|
|  | 5'-ACUGAAAGCCGUUUCUUGUAAUCUUGU-3' | (SEQ ID NO: 7256) |
|  | 3'-UGACUUUCGGCAAAGAACAUUAGAACA-5' | (SEQ ID NO: 1711) |
| βc-2295 Target: | 5'-ACTGAAAGCCGTTTCTTGTAATCTTGT-3' | (SEQ ID NO: 2820) |
|  | 5'-CAGCUCAACUGAAAGCCGUUUCUUGUA-3' | (SEQ ID NO: 7257) |
|  | 3'-GUCGAGUUGACUUUCGGCAAAGAACAU-5' | (SEQ ID NO: 1712) |
| βc-2302 Target: | 5'-CAGCTCAACTGAAAGCCGTTTCTTGTA-3' | (SEQ ID NO: 2821) |
|  | 5'-CAAGUCCAAGAUCAGCAGUCUCAUUCC-3' | (SEQ ID NO: 7258) |
|  | 3'-GUUCAGGUUCUAGUCGUCAGAGUAAGG-5' | (SEQ ID NO: 1713) |
| βc-2363 Target: | 5'-CAAGTCCAAGATCAGCAGTCTCATTCC-3' | (SEQ ID NO: 2822) |
|  | 5'-GCACCAAUAUCAAGUCCAAGAUCAGCA-3' | (SEQ ID NO: 7259) |
|  | 3'-CGUGGUUAUAGUUCAGGUUCUAGUCGU-5' | (SEQ ID NO: 1714) |
| βc-2373 Target: | 5'-GCACCAATATCAAGTCCAAGATCAGCA-3' | (SEQ ID NO: 2823) |
|  | 5'-AAAGAACGAUAGCUAGGAUCAUCCUGG-3' | (SEQ ID NO: 7260) |
|  | 3'-UUUCUUGCUAUCGAUCCUAGUAGGACC-5' | (SEQ ID NO: 1715) |
| βc-2424 Target: | 5'-AAAGAACGATAGCTAGGATCATCCTGG-3' | (SEQ ID NO: 2824) |
|  | 5'-CAUAUCCACCAGAGUGAAAAGAACGAU-3' | (SEQ ID NO: 7261) |
|  | 3'-GUAUAGGUGGUCUCACUUUUCUUGCUA-5' | (SEQ ID NO: 1716) |
| βc-2441 Target: | 5'-CATATCCACCAGAGTGAAAAGAACGAT-3' | (SEQ ID NO: 2825) |
|  | 5'-UGAUUUACAGGUCAGUAUCAAACCAGG-3' | (SEQ ID NO: 7262) |
|  | 3'-ACUAAAUGUCCAGUCAUAGUUUGGUCC-5' | (SEQ ID NO: 1717) |
| βc-2618 Target: | 5'-TGATTTACAGGTCAGTATCAAACCAGG-3' | (SEQ ID NO: 2826) |
|  | 5'-AUGAUUUACAGGUCAGUAUCAAACCAG-3' | (SEQ ID NO: 7263) |
|  | 3'-UACUAAAUGUCCAGUCAUAGUUUGGUC-5' | (SEQ ID NO: 1718) |
| βc-2619 Target: | 5'-ATGATTTACAGGTCAGTATCAAACCAG-3' | (SEQ ID NO: 2827) |
|  | 5'-GAUGAUUUACAGGUCAGUAUCAAACCA-3' | (SEQ ID NO: 7264) |
|  | 3'-CUACUAAAUGUCCAGUCAUAGUUUGGU-5' | (SEQ ID NO: 1719) |
| βc-2620 Target: | 5'-GATGATTTACAGGTCAGTATCAAACCA-3' | (SEQ ID NO: 2828) |
|  | 5'-CUUCUUACCUAAAGGAUGAUUUACAGG-3' | (SEQ ID NO: 7265) |
|  | 3'-GAAGAAUGGAUUUCCUACUAAAUGUCC-5' | (SEQ ID NO: 1720) |
| βc-2634 Target: | 5'-CTTCTTACCTAAAGGATGATTTACAGG-3' | (SEQ ID NO: 2829) |
|  | 5'-ACUUCUUACCUAAAGGAUGAUUUACAG-3' | (SEQ ID NO: 7266) |
|  | 3'-UGAAGAAUGGAUUUCCUACUAAAUGUC-5' | (SEQ ID NO: 1721) |
| βc-2635 Target: | 5'-ACTTCTTACCTAAAGGATGATTTACAG-3' | (SEQ ID NO: 2830) |
|  | 5'-AAACUUCUUACCUAAAGGAUGAUUUAC-3' | (SEQ ID NO: 7267) |
|  | 3'-UUUGAAGAAUGGAUUUCCUACUAAAUG-5' | (SEQ ID NO: 1722) |
| βc-2637 Target: | 5'-AAACTTCTTACCTAAAGGATGATTTAC-3' | (SEQ ID NO: 2831) |
|  | 5'-GCUUUUUAAAACUUCUUACCUAAAGGA-3' | (SEQ ID NO: 7268) |
|  | 3'-CGAAAAAUUUUGAAGAAUGGAUUUCCU-5' | (SEQ ID NO: 1723) |
| βc-2645 Target: | 5'-GCTTTTTAAAACTTCTTACCTAAAGGA-3' | (SEQ ID NO: 2832) |

TABLE 13-continued

Additional Selected Anti-β-catenin DsiRNAs, Blunt, Unfrayed Duplexes

|  |  |  |  |
|---|---|---|---|
|  | 5'-UGGCUUUUUAAAACUUCUUACCUAAAG-3' | (SEQ ID NO: 7269) |
|  | 3'-ACCGAAAAAUUUUGAAGAAUGGAUUUC-5' | (SEQ ID NO: 1724) |
| βc-2647 Target: | 5'-TGGCTTTTTAAAACTTCTTACCTAAAG-3' | (SEQ ID NO: 2833) |
|  | 5'-CCAAACUGGCUUUUUAAAACUUCUUAC-3' | (SEQ ID NO: 7270) |
|  | 3'-GGUUUGACCGAAAAAUUUUGAAGAAUG-5' | (SEQ ID NO: 1725) |
| βc-2653 Target: | 5'-CCAAACTGGCTTTTTAAAACTTCTTAC-3' | (SEQ ID NO: 2834) |
|  | 5'-UUACCCAAACUGGCUUUUUAAAACUUC-3' | (SEQ ID NO: 7271) |
|  | 3'-AAUGGGUUUGACCGAAAAAUUUUGAAG-5' | (SEQ ID NO: 1726) |
| βc-2657 Target: | 5'-TTACCCAAACTGGCTTTTTAAAACTTC-3' | (SEQ ID NO: 2835) |
|  | 5'-UUUACCCAAACUGGCUUUUUAAAACUU-3' | (SEQ ID NO: 7272) |
|  | 3'-AAAUGGGUUUGACCGAAAAAUUUUGAA-5' | (SEQ ID NO: 1727) |
| βc-2658 Target: | 5'-TTTACCCAAACTGGCTTTTTAAAACTT-3' | (SEQ ID NO: 2836) |
|  | 5'-UUUUACCCAAACUGGCUUUUUAAAACU-3' | (SEQ ID NO: 7273) |
|  | 3'-AAAAUGGGUUUGACCGAAAAAUUUUGA-5' | (SEQ ID NO: 1728) |
| βc-2659 Target: | 5'-TTTTACCCAAACTGGCTTTTTAAAACT-3' | (SEQ ID NO: 2837) |
|  | 5'-AUUUUACCCAAACUGGCUUUUUAAAAC-3' | (SEQ ID NO: 7274) |
|  | 3'-UAAAAUGGGUUUGACCGAAAAAUUUUG-5' | (SEQ ID NO: 1729) |
| βc-2660 Target: | 5'-ATTTTACCCAAACTGGCTTTTTAAAAC-3' | (SEQ ID NO: 2838) |
|  | 5'-CCAACCAAGUCUUUCUGAAGUUCUGUA-3' | (SEQ ID NO: 7275) |
|  | 3'-GGUUGGUUCAGAAAGACUUCAAGACAU-5' | (SEQ ID NO: 1730) |
| βc-2701 Target: | 5'-CCAACCAAGTCTTTCTGAAGTTCTGTA-3' | (SEQ ID NO: 2839) |
|  | 5'-CCACCCUACCAACCAAGUCUUUCUGAA-3' | (SEQ ID NO: 7276) |
|  | 3'-GGUGGGAUGGUUGGUUCAGAAAGACUU-5' | (SEQ ID NO: 1731) |
| βc-2709 Target: | 5'-CCACCCTACCAACCAAGTCTTTCTGAA-3' | (SEQ ID NO: 2840) |
|  | 5'-AUUUACAAAUAGCCUAAACCACUCCCA-3' | (SEQ ID NO: 7277) |
|  | 3'-UAAAUGUUUAUCGGAUUUGGUGAGGGU-5' | (SEQ ID NO: 1732) |
| βc-2733 Target: | 5'-ATTTACAAATAGCCTAAACCACTCCCA-3' | (SEQ ID NO: 2841) |
|  | 5'-GAUUUACAAAUAGCCUAAACCACUCCC-3' | (SEQ ID NO: 7278) |
|  | 3'-CUAAAUGUUUAUCGGAUUUGGUGAGGG-5' | (SEQ ID NO: 1733) |
| βc-2734 Target: | 5'-GATTTACAAATAGCCTAAACCACTCCC-3' | (SEQ ID NO: 2842) |
|  | 5'-AGAUUUACAAAUAGCCUAAACCACUCC-3' | (SEQ ID NO: 7279) |
|  | 3'-UCUAAAUGUUUAUCGGAUUUGGUGAGG-5' | (SEQ ID NO: 1734) |
| βc-2735 Target: | 5'-AGATTTACAAATAGCCTAAACCACTCC-3' | (SEQ ID NO: 2843) |
|  | 5'-CAGAUUUACAAAUAGCCUAAACCACUC-3' | (SEQ ID NO: 7280) |
|  | 3'-GUCUAAAUGUUUAUCGGAUUUGGUGAG-5' | (SEQ ID NO: 1735) |
| βc-2736 Target: | 5'-CAGATTTACAAATAGCCTAAACCACTC-3' | (SEQ ID NO: 2844) |
|  | 5'-UGUUUUUGUGGCAGAUUUACAAAUAGC-3' | (SEQ ID NO: 7281) |
|  | 3'-ACAAAAACACCGUCUAAAUGUUUAUCG-5' | (SEQ ID NO: 1736) |
| βc-2747 Target: | 5'-TGTTTTTGTGGCAGATTTACAAATAGC-3' | (SEQ ID NO: 2845) |

TABLE 13-continued

Additional Selected Anti-β-catenin DsiRNAs, Blunt, Unfrayed Duplexes

|  |  |  |  |
|---|---|---|---|
|  | 5'-CUGUUUUUGUGGCAGAUUUACAAAUAG-3' | (SEQ ID NO: 7282) |
|  | 3'-GACAAAAACACCGUCUAAAUGUUUAUC-5' | (SEQ ID NO: 1737) |
| βc-2748 Target: | 5'-CTGTTTTTGTGGCAGATTTACAAATAG-3' | (SEQ ID NO: 2846) |
|  | 5'-CCUGUUUUUGUGGCAGAUUUACAAAUA-3' | (SEQ ID NO: 7283) |
|  | 3'-GGACAAAAACACCGUCUAAAUGUUUAU-5' | (SEQ ID NO: 1738) |
| βc-2749 Target: | 5'-CCTGTTTTTGTGGCAGATTTACAAATA-3' | (SEQ ID NO: 2847) |
|  | 5'-AUAUACCUGUUUUUGUGGCAGAUUUAC-3' | (SEQ ID NO: 7284) |
|  | 3'-UAUAUGGACAAAAACACCGUCUAAAUG-5' | (SEQ ID NO: 1739) |
| βc-2754 Target: | 5'-ATATACCTGTTTTTGTGGCAGATTTAC-3' | (SEQ ID NO: 2848) |
|  | 5'-CUUUCAAAGUAUAUACCUGUUUUUGUG-3' | (SEQ ID NO: 7285) |
|  | 3'-GAAAGUUUCAUAUAUGGACAAAAACAC-5' | (SEQ ID NO: 1740) |
| βc-2764 Target: | 5'-CTTTCAAAGTATATACCTGTTTTTGTG-3' | (SEQ ID NO: 2849) |
|  | 5'-CAUCUCCUUUCAAAGUAUAUACCUGUU-3' | (SEQ ID NO: 7286) |
|  | 3'-GUAGAGGAAAGUUUCAUAUAUGGACAA-5' | (SEQ ID NO: 1741) |
| βc-2770 Target: | 5'-CATCTCCTTTCAAAGTATATACCTGTT-3' | (SEQ ID NO: 2850) |
|  | 5'-ACAUCUCCUUUCAAAGUAUAUACCUGU-3' | (SEQ ID NO: 7287) |
|  | 3'-UGUAGAGGAAAGUUUCAUAUAUGGACA-5' | (SEQ ID NO: 1742) |
| βc-2771 Target: | 5'-ACATCTCCTTTCAAAGTATATACCTGT-3' | (SEQ ID NO: 2851) |
|  | 5'-AGACAUCUCCUUUCAAAGUAUAUACCU-3' | (SEQ ID NO: 7288) |
|  | 3'-UCUGUAGAGGAAAGUUUCAUAUAUGGA-5' | (SEQ ID NO: 1743) |
| βc-2773 Target: | 5'-AGACATCTCCTTTCAAAGTATATACCT-3' | (SEQ ID NO: 2852) |
|  | 5'-AAGACAUCUCCUUUCAAAGUAUAUACC-3' | (SEQ ID NO: 7289) |
|  | 3'-UUCUGUAGAGGAAAGUUUCAUAUAUGG-5' | (SEQ ID NO: 1744) |
| βc-2774 Target: | 5'-AAGACATCTCCTTTCAAAGTATATACC-3' | (SEQ ID NO: 2853) |
|  | 5'-CAAGACAUCUCCUUUCAAAGUAUAUAC-3' | (SEQ ID NO: 7290) |
|  | 3'-GUUCUGUAGAGGAAAGUUUCAUAUAUG-5' | (SEQ ID NO: 1745) |
| βc-2775 Target: | 5'-CAAGACATCTCCTTTCAAAGTATATAC-3' | (SEQ ID NO: 2854) |
|  | 5'-UGUUCCAAGACAUCUCCUUUCAAAGUA-3' | (SEQ ID NO: 7291) |
|  | 3'-ACAAGGUUCUGUAGAGGAAAGUUUCAU-5' | (SEQ ID NO: 1746) |
| βc-2780 Target: | 5'-TGTTCCAAGACATCTCCTTTCAAAGTA-3' | (SEQ ID NO: 2855) |
|  | 5'-CAUUCCAAUGUUCCAAGACAUCUCCUU-3' | (SEQ ID NO: 7292) |
|  | 3'-GUAAGGUUACAAGGUUCUGUAGAGGAA-5' | (SEQ ID NO: 1747) |
| βc-2788 Target: | 5'-CATTCCAATGTTCCAAGACATCTCCTT-3' | (SEQ ID NO: 2856) |
|  | 5'-ACAUUCCAAUGUUCCAAGACAUCUCCU-3' | (SEQ ID NO: 7293) |
|  | 3'-UGUAAGGUUACAAGGUUCUGUAGAGGA-5' | (SEQ ID NO: 1748) |
| βc-2789 Target: | 5'-ACATTCCAATGTTCCAAGACATCTCCT-3' | (SEQ ID NO: 2857) |
|  | 5'-GAACAUUCCAAUGUUCCAAGACAUCUC-3' | (SEQ ID NO: 7294) |
|  | 3'-CUUGUAAGGUUACAAGGUUCUGUAGAG-5' | (SEQ ID NO: 1749) |
| βc-2791 Target: | 5'-GAACATTCCAATGTTCCAAGACATCTC-3' | (SEQ ID NO: 2858) |

TABLE 13-continued

Additional Selected Anti-β-catenin DsiRNAs, Blunt, Unfrayed Duplexes

|  |  |  |  |
|---|---|---|---|
|  | 5'-CCAGAAAUCUGAGAACAUUCCAAUGUU-3' | (SEQ ID NO: 7295) |
|  | 3'-GGUCUUUAGACUCUUGUAAGGUUACAA-5' | (SEQ ID NO: 1750) |
| βc-2803 Target: | 5'-CCAGAAATCTGAGAACATTCCAATGTT-3' | (SEQ ID NO: 2859) |
|  | 5'-ACAACCAGAAAUCUGAGAACAUUCCAA-3' | (SEQ ID NO: 7296) |
|  | 3'-UGUUGGUCUUUAGACUCUUGUAAGGUU-5' | (SEQ ID NO: 1751) |
| βc-2807 Target: | 5'-ACAACCAGAAATCTGAGAACATTCCAA-3' | (SEQ ID NO: 2860) |
|  | 5'-UAACAACCAGAAAUCUGAGAACAUUCC-3' | (SEQ ID NO: 7297) |
|  | 3'-AUUGUUGGUCUUUAGACUCUUGUAAGG-5' | (SEQ ID NO: 1752) |
| βc-2809 Target: | 5'-TAACAACCAGAAATCTGAGAACATTCC-3' | (SEQ ID NO: 2861) |
|  | 5'-AUAACAACCAGAAAUCUGAGAACAUUC-3' | (SEQ ID NO: 7298) |
|  | 3'-UAUUGUUGGUCUUUAGACUCUUGUAAG-5' | (SEQ ID NO: 1753) |
| βc-2810 Target: | 5'-ATAACAACCAGAAATCTGAGAACATTC-3' | (SEQ ID NO: 2862) |
|  | 5'-CAUAACAACCAGAAAUCUGAGAACAUU-3' | (SEQ ID NO: 7299) |
|  | 3'-GUAUUGUUGGUCUUUAGACUCUUGUAA-5' | (SEQ ID NO: 1754) |
| βc-2811 Target: | 5'-CATAACAACCAGAAATCTGAGAACATT-3' | (SEQ ID NO: 2863) |
|  | 5'-UGAUCACAUAACAACCAGAAAUCUGAG-3' | (SEQ ID NO: 7300) |
|  | 3'-ACUAGUGUAUUGUUGGUCUUUAGACUC-5' | (SEQ ID NO: 1755) |
| βc-2817 Target: | 5'-TGATCACATAACAACCAGAAATCTGAG-3' | (SEQ ID NO: 2864) |
|  | 5'-AUGAUCACAUAACAACCAGAAAUCUGA-3' | (SEQ ID NO: 7301) |
|  | 3'-UACUAGUGUAUUGUUGGUCUUUAGACU-5' | (SEQ ID NO: 1756) |
| βc-2818 Target: | 5'-ATGATCACATAACAACCAGAAATCTGA-3' | (SEQ ID NO: 2865) |
|  | 5'-CCACACAUGAUCACAUAACAACCAGAA-3' | (SEQ ID NO: 7302) |
|  | 3'-GGUGUGUACUAGUGUAUUGUUGGUCUU-5' | (SEQ ID NO: 1757) |
| βc-2824 Target: | 5'-CCACACATGATCACATAACAACCAGAA-3' | (SEQ ID NO: 2866) |
|  | 5'-CUUCCACACAUGAUCACAUAACAACCA-3' | (SEQ ID NO: 7303) |
|  | 3'-GAAGGUGUGUACUAGUGUAUUGUUGGU-5' | (SEQ ID NO: 1758) |
| βc-2827 Target: | 5'-CTTCCACACATGATCACATAACAACCA-3' | (SEQ ID NO: 2867) |
|  | 5'-AAUAACUUCCACACAUGAUCACAUAAC-3' | (SEQ ID NO: 7304) |
|  | 3'-UUAUUGAAGGUGUGUACUAGUGUAUUG-5' | (SEQ ID NO: 1759) |
| βc-2832 Target: | 5'-AATAACTTCCACACATGATCACATAAC-3' | (SEQ ID NO: 2868) |
|  | 5'-UAAUAACUUCCACACAUGAUCACAUAA-3' | (SEQ ID NO: 7305) |
|  | 3'-AUUAUUGAAGGUGUGUACUAGUGUAUU-5' | (SEQ ID NO: 1760) |
| βc-2833 Target: | 5'-TAATAACTTCCACACATGATCACATAA-3' | (SEQ ID NO: 2869) |
|  | 5'-UUAAUAACUUCCACACAUGAUCACAUA-3' | (SEQ ID NO: 7306) |
|  | 3'-AAUUAUUGAAGGUGUGUACUAGUGUAU-5' | (SEQ ID NO: 1761) |
| βc-2834 Target: | 5'-TTAATAACTTCCACACATGATCACATA-3' | (SEQ ID NO: 2870) |
|  | 5'-GUUAAUAACUUCCACACAUGAUCACAU-3' | (SEQ ID NO: 7307) |
|  | 3'-CAAUUAUUGAAGGUGUGUACUAGUGUA-5' | (SEQ ID NO: 1762) |
| βc-2835 Target: | 5'-GTTAATAACTTCCACACATGATCAC-3' | (SEQ ID NO: 2871) |

TABLE 13-continued

Additional Selected Anti-β-catenin DsiRNAs, Blunt, Unfrayed Duplexes

|  |  |  |  |
|---|---|---|---|
|  | 5'-CAUUAAAGUUAAUAACUUCCACACAUG-3' | (SEQ ID NO: 7308) |
|  | 3'-GUAAUUUCAAUUAUUGAAGGUGUGUAC-5' | (SEQ ID NO: 1763) |
| βc-2842 Target: | 5'-CATTAAAGTTAATAACTTCCACACATG-3' | (SEQ ID NO: 2872) |
|  | 5'-ACAUUAAAGUUAAUAACUUCCACACAU-3' | (SEQ ID NO: 7309) |
|  | 3'-UGUAAUUUCAAUUAUUGAAGGUGUGUA-5' | (SEQ ID NO: 1764) |
| βc-2843 Target: | 5'-ACATTAAAGTTAATAACTTCCACAC-3' | (SEQ ID NO: 2873) |
|  | 5'-AAACAUUAAAGUUAAUAACUUCCACAC-3' | (SEQ ID NO: 7310) |
|  | 3'-UUUGUAAUUUCAAUUAUUGAAGGUGUG-5' | (SEQ ID NO: 1765) |
| βc-2845 Target: | 5'-AAACATTAAAGTTAATAACTTCCACAC-3' | (SEQ ID NO: 2874) |
|  | 5'-AAAACAUUAAAGUUAAUAACUUCCACA-3' | (SEQ ID NO: 7311) |
|  | 3'-UUUUGUAAUUUCAAUUAUUGAAGGUGU-5' | (SEQ ID NO: 1766) |
| βc-2846 Target: | 5'-AAAACATTAAAGTTAATAACTTCCACA-3' | (SEQ ID NO: 2875) |
|  | 5'-AAAAACAUUAAAGUUAAUAACUUCCAC-3' | (SEQ ID NO: 7312) |
|  | 3'-UUUUUGUAAUUUCAAUUAUUGAAGGUG-5' | (SEQ ID NO: 1767) |
| βc-2847 Target: | 5'-AAAAACATTAAAGTTAATAACTTCCAC-3' | (SEQ ID NO: 2876) |
|  | 5'-AAAAAACAUUAAAGUUAAUAACUUCCA-3' | (SEQ ID NO: 7313) |
|  | 3'-UUUUUUGUAAUUUCAAUUAUUGAAGGU-5' | (SEQ ID NO: 1768) |
| βc-2848 Target: | 5'-AAAAAACATTAAAGTTAATAACTTCCA-3' | (SEQ ID NO: 2877) |
|  | 5'-CAAAAAACAUUAAAGUUAAUAACUUCC-3' | (SEQ ID NO: 7314) |
|  | 3'-GUUUUUUGUAAUUUCAAUUAUUGAAGG-5' | (SEQ ID NO: 1769) |
| βc-2849 Target: | 5'-CAAAAAACATTAAAGTTAATAACTTCC-3' | (SEQ ID NO: 2878) |
|  | 5'-GCAAAAAACAUUAAAGUUAAUAACUUC-3' | (SEQ ID NO: 7315) |
|  | 3'-CGUUUUUUGUAAUUUCAAUUAUUGAAG-5' | (SEQ ID NO: 1770) |
| βc-2850 Target: | 5'-GCAAAAAACATTAAAGTTAATAACTTC-3' | (SEQ ID NO: 2879) |
|  | 5'-UGGCAAAAAACAUUAAAGUUAAUAACU-3' | (SEQ ID NO: 7316) |
|  | 3'-ACCGUUUUUUGUAAUUUCAAUUAUUGA-5' | (SEQ ID NO: 1771) |
| βc-2852 Target: | 5'-TGGCAAAAAACATTAAAGTTAATAACT-3' | (SEQ ID NO: 2880) |
|  | 5'-GUGGCAAAAAACAUUAAAGUUAAUAAC-3' | (SEQ ID NO: 7317) |
|  | 3'-CACCGUUUUUUGUAAUUUCAAUUAUUG-5' | (SEQ ID NO: 1772) |
| βc-2853 Target: | 5'-GTGGCAAAAAACATTAAAGTTAATAAC-3' | (SEQ ID NO: 2881) |
|  | 5'-UUGCAAAAGCUGUGGCAAAAAACAUUA-3' | (SEQ ID NO: 7318) |
|  | 3'-AACGUUUUCGACACCGUUUUUUGUAAU-5' | (SEQ ID NO: 1773) |
| βc-2864 Target: | 5'-TTGCAAAAGCTGTGGCAAAAAACATTA-3' | (SEQ ID NO: 2882) |
|  | 5'-GUUGCAAAAGCUGUGGCAAAAAACAUU-3' | (SEQ ID NO: 7319) |
|  | 3'-CAACGUUUUCGACACCGUUUUUUGUAA-5' | (SEQ ID NO: 1774) |
| βc-2865 Target: | 5'-GTTGCAAAAGCTGTGGCAAAAAACATT-3' | (SEQ ID NO: 2883) |
|  | 5'-ACUCAUUUGAGUAUUAAGUUGCAAAAG-3' | (SEQ ID NO: 7320) |
|  | 3'-UGAGUAAACUCAUAAUUCAACGUUUUC-5' | (SEQ ID NO: 1775) |
| βc-2882 Target: | 5'-ACTCATTTGAGTATTAAGTTGCAAAAG-3' | (SEQ ID NO: 2884) |

TABLE 13-continued

Additional Selected Anti-β-catenin DsiRNAs, Blunt, Unfrayed Duplexes

|  |  |  |  |
|---|---|---|---|
|  | 5'-UUAAAACAGCAAAUGUUACUCAUUUGA-3' | (SEQ ID NO: 7321) |  |
|  | 3'-AAUUUUGUCGUUUACAAUGAGUAAACU-5' | (SEQ ID NO: 1776) |  |
| βc-2899 Target: | 5'-TTAAAACAGCAAATGTTACTCATTTGA-3' | (SEQ ID NO: 2885) |  |
|  | 5'-UUUAAAACAGCAAAUGUUACUCAUUUG-3' | (SEQ ID NO: 7322) |  |
|  | 3'-AAAUUUUGUCGUUUACAAUGAGUAAAC-5' | (SEQ ID NO: 1777) |  |
| βc-2900 Target: | 5'-TTTAAAACAGCAAATGTTACTCATTTG-3' | (SEQ ID NO: 2886) |  |
|  | 5'-GUUUAAAACAGCAAAUGUUACUCAUUU-3' | (SEQ ID NO: 7323) |  |
|  | 3'-CAAAUUUUGUCGUUUACAAUGAGUAAA-5' | (SEQ ID NO: 1778) |  |
| βc-2901 Target: | 5'-GTTTAAAACAGCAAATGTTACTCATTT-3' | (SEQ ID NO: 2887) |  |
|  | 5'-UGUUUAAAACAGCAAAUGUUACUCAUU-3' | (SEQ ID NO: 7324) |  |
|  | 3'-ACAAAUUUUGUCGUUUACAAUGAGUAA-5' | (SEQ ID NO: 1779) |  |
| βc-2902 Target: | 5'-TGTTTAAAACAGCAAATGTTACTCATT-3' | (SEQ ID NO: 2888) |  |
|  | 5'-AUGUUUAAAACAGCAAAUGUUACUCAU-3' | (SEQ ID NO: 7325) |  |
|  | 3'-UACAAAUUUUGUCGUUUACAAUGAGUA-5' | (SEQ ID NO: 1780) |  |
| βc-2903 Target: | 5'-ATGTTTAAAACAGCAAATGTTACTC-3' | (SEQ ID NO: 2889) |  |
|  | 5'-AAUGUUUAAAACAGCAAAUGUUACUCA-3' | (SEQ ID NO: 7326) |  |
|  | 3'-UUACAAAUUUUGUCGUUUACAAUGAGU-5' | (SEQ ID NO: 1781) |  |
| βc-2904 Target: | 5'-AATGTTTAAAACAGCAAATGTTACTCA-3' | (SEQ ID NO: 2890) |  |
|  | 5'-CUAUUAAUGUUUAAAACAGCAAAUGUU-3' | (SEQ ID NO: 7327) |  |
|  | 3'-GAUAAUUACAAAUUUUGUCGUUUACAA-5' | (SEQ ID NO: 1782) |  |
| βc-2909 Target: | 5'-CTATTAATGTTTAAAACAGCAAATGTT-3' | (SEQ ID NO: 2891) |  |
|  | 5'-AGAGAAAGGCUGCUAUUAAUGUUUAAA-3' | (SEQ ID NO: 7328) |  |
|  | 3'-UCUCUUUCCGACGAUAAUUACAAAUUU-5' | (SEQ ID NO: 1783) |  |
| βc-2921 Target: | 5'-AGAGAAAGGCTGCTATTAATGTTTAAA-3' | (SEQ ID NO: 2892) |  |
|  | 5'-CAAGUUCAGACAAUACAGCUGUAUAAA-3' | (SEQ ID NO: 7329) |  |
|  | 3'-GUUCAAGUCUGUUAUGUCGACAUAUUU-5' | (SEQ ID NO: 1784) |  |
| βc-2949 Target: | 5'-CAAGTTCAGACAATACAGCTGTATAAA-3' | (SEQ ID NO: 2893) |  |
|  | 5'-UCACAAUGCAAGUUCAGACAAUACAGC-3' | (SEQ ID NO: 7330) |  |
|  | 3'-AGUGUUACGUUCAAGUCUGUUAUGUCG-5' | (SEQ ID NO: 1785) |  |
| βc-2957 Target: | 5'-TCACAATGCAAGTTCAGACAATACAGC-3' | (SEQ ID NO: 2894) |  |
|  | 5'-AAUCACAAUGCAAGUUCAGACAAUACA-3' | (SEQ ID NO: 7331) |  |
|  | 3'-UUAGUGUUACGUUCAAGUCUGUUAUGU-5' | (SEQ ID NO: 1786) |  |
| βc-2959 Target: | 5'-AATCACAATGCAAGTTCAGACAATACA-3' | (SEQ ID NO: 2895) |  |
|  | 5'-CCAAUCACAAUGCAAGUUCAGACAAUA-3' | (SEQ ID NO: 7332) |  |
|  | 3'-GGUUAGUGUUACGUUCAAGUCUGUUAU-5' | (SEQ ID NO: 1787) |  |
| βc-2961 Target: | 5'-CCAATCACAATGCAAGTTCAGACAATA-3' | (SEQ ID NO: 2896) |  |
|  | 5'-CAGGCCAAUCACAAUGCAAGUUCAGAC-3' | (SEQ ID NO: 7333) |  |
|  | 3'-GUCCGGUUAGUGUUACGUUCAAGUCUG-5' | (SEQ ID NO: 1788) |  |
| βc-2965 Target: | 5'-CAGGCCAATCACAATGCAAGTTCAGAC-3' | (SEQ ID NO: 2897) |  |

TABLE 13-continued

Additional Selected Anti-β-catenin DsiRNAs, Blunt, Unfrayed Duplexes

|  |  |  |  |
|---|---|---|---|
|  | 5'-UUGUUCCCAUAGGAAACUCAGCUUGGU-3' | (SEQ ID NO: 7334) |
|  | 3'-AACAAGGGUAUCCUUUGAGUCGAACCA-5' | (SEQ ID NO: 1789) |
| βc-3052 Target: | 5'-TTGTTCCCATAGGAAACTCAGCTTGGT-3' | (SEQ ID NO: 2898) |
|  | 5'-CUUCAAUUGUUCCCAUAGGAAACUCAG-3' | (SEQ ID NO: 7335) |
|  | 3'-GAAGUUAACAAGGGUAUCCUUUGAGUC-5' | (SEQ ID NO: 1790) |
| βc-3058 Target: | 5'-CTTCAATTGTTCCCATAGGAAACTCAG-3' | (SEQ ID NO: 2899) |
|  | 5'-ACUUCAAUUGUUCCCAUAGGAAACUCA-3' | (SEQ ID NO: 7336) |
|  | 3'-UGAAGUUAACAAGGGUAUCCUUUGAGU-5' | (SEQ ID NO: 1791) |
| βc-3059 Target: | 5'-ACTTCAATTGTTCCCATAGGAAACTCA-3' | (SEQ ID NO: 2900) |
|  | 5'-AAGUUUACUUCAAUUGUUCCCAUAGGA-3' | (SEQ ID NO: 7337) |
|  | 3'-UUCAAAUGAAGUUAACAAGGGUAUCCU-5' | (SEQ ID NO: 1792) |
| βc-3065 Target: | 5'-AAGTTTACTTCAATTGTTCCCATAGGA-3' | (SEQ ID NO: 2901) |
|  | 5'-AAAGUUUACUUCAAUUGUUCCCAUAGG-3' | (SEQ ID NO: 7338) |
|  | 3'-UUUCAAAUGAAGUUAACAAGGGUAUCC-5' | (SEQ ID NO: 1793) |
| βc-3066 Target: | 5'-AAAGTTTACTTCAATTGTTCCCATAGG-3' | (SEQ ID NO: 2902) |
|  | 5'-ACAAAAGUUUACUUCAAUUGUUCCCA-3' | (SEQ ID NO: 7339) |
|  | 3'-UGUUUUUCAAAUGAAGUUAACAAGGGU-5' | (SEQ ID NO: 1794) |
| βc-3070 Target: | 5'-ACAAAAGTTTACTTCAATTGTTCCCA-3' | (SEQ ID NO: 2903) |
|  | 5'-CAGAACAAAAGUUUACUUCAAUUGUU-3' | (SEQ ID NO: 7340) |
|  | 3'-GUCUUGUUUUUCAAAUGAAGUUAACAA-5' | (SEQ ID NO: 1795) |
| βc-3074 Target: | 5'-CAGAACAAAAGTTTACTTCAATTGTT-3' | (SEQ ID NO: 2904) |
|  | 5'-AGGACCAGAACAAAAAGUUUACUUCAA-3' | (SEQ ID NO: 7341) |
|  | 3'-UCCUGGUCUUGUUUUUCAAAUGAAGUU-5' | (SEQ ID NO: 1796) |
| βc-3079 Target: | 5'-AGGACCAGAACAAAAAGTTTACTTCAA-3' | (SEQ ID NO: 2905) |
|  | 5'-AAGGACCAGAACAAAAAGUUUACUUCA-3' | (SEQ ID NO: 7342) |
|  | 3'-UUCCUGGUCUUGUUUUUCAAAUGAAGU-5' | (SEQ ID NO: 1797) |
| βc-3080 Target: | 5'-AAGGACCAGAACAAAAAGTTTACTTCA-3' | (SEQ ID NO: 2906) |
|  | 5'-CGACCAAAAAGGACCAGAACAAAAAGU-3' | (SEQ ID NO: 7343) |
|  | 3'-GCUGGUUUUUCCUGGUCUUGUUUUUCA-5' | (SEQ ID NO: 1798) |
| βc-3088 Target: | 5'-CGACCAAAAAGGACCAGAACAAAAAGT-3' | (SEQ ID NO: 2907) |
|  | 5'-UCGACCAAAAAGGACCAGAACAAAAAG-3' | (SEQ ID NO: 7344) |
|  | 3'-AGCUGGUUUUUCCUGGUCUUGUUUUUC-5' | (SEQ ID NO: 1799) |
| βc-3089 Target: | 5'-TCGACCAAAAAGGACCAGAACAAAAAG-3' | (SEQ ID NO: 2908) |
|  | 5'-UUACUCCUCGACCAAAAAGGACCAGAA-3' | (SEQ ID NO: 7345) |
|  | 3'-AAUGAGGAGCUGGUUUUUCCUGGUCUU-5' | (SEQ ID NO: 1800) |
| βc-3096 Target: | 5'-TTACTCCTCGACCAAAAAGGACCAGAA-3' | (SEQ ID NO: 2909) |
|  | 5'-AAUCCAUUUGUAUUGUUACUCCUCGAC-3' | (SEQ ID NO: 7346) |
|  | 3'-UUAGGUAAACAUAACAAUGAGGAGCUG-5' | (SEQ ID NO: 1801) |
| βc-3111 Target: | 5'-AATCCATTTGTATTGTTACTCCTCGAC-3' | (SEQ ID NO: 2910) |

TABLE 13-continued

Additional Selected Anti-β-catenin DsiRNAs, Blunt, Unfrayed Duplexes

|  |  |  |
|---|---|---|
|  | 5'-AAAUCCAUUUGUAUUGUUACUCCUCGA-3' | (SEQ ID NO: 7347) |
|  | 3'-UUUAGGUAAACAUAACAAUGAGGAGCU-5' | (SEQ ID NO: 1802) |
| βc-3112 Target: | 5'-AAATCCATTTGTATTGTTACTCCTCGA-3' | (SEQ ID NO: 2911) |
|  | 5'-AAAAUCCAUUUGUAUUGUUACUCCUCG-3' | (SEQ ID NO: 7348) |
|  | 3'-UUUUAGGUAAACAUAACAAUGAGGAGC-5' | (SEQ ID NO: 1803) |
| βc-3113 Target: | 5'-AAAATCCATTTGTATTGTTACTCCTCG-3' | (SEQ ID NO: 2912) |
|  | 5'-CAAAAUCCAUUUGUAUUGUUACUCCUC-3' | (SEQ ID NO: 7349) |
|  | 3'-GUUUUAGGUAAACAUAACAAUGAGGAG-5' | (SEQ ID NO: 1804) |
| βc-3114 Target: | 5'-CAAAATCCATTTGTATTGTTACTCCTC-3' | (SEQ ID NO: 2913) |
|  | 5'-CCAAAAUCCAUUUGUAUUGUUACUCCU-3' | (SEQ ID NO: 7350) |
|  | 3'-GGUUUUAGGUAAACAUAACAAUGAGGA-5' | (SEQ ID NO: 1805) |
| βc-3115 Target: | 5'-CCAAAATCCATTTGTATTGTTACTCCT-3' | (SEQ ID NO: 2914) |
|  | 5'-UCACUCCCAAAAUCCAUUUGUAUUGUU-3' | (SEQ ID NO: 7351) |
|  | 3'-AGUGAGGGUUUUAGGUAAACAUAACAA-5' | (SEQ ID NO: 1806) |
| βc-3121 Target: | 5'-TCACTCCCAAAATCCATTTGTATTGTT-3' | (SEQ ID NO: 2915) |
|  | 5'-UCUUCACUUCUUGAGUCACUCCCAAAA-3' | (SEQ ID NO: 7352) |
|  | 3'-AGAAGUGAAGAACUCAGUGAGGGUUUU-5' | (SEQ ID NO: 1807) |
| βc-3136 Target: | 5'-TCTTCACTTCTTGAGTCACTCCCAAAA-3' | (SEQ ID NO: 2916) |
|  | 5'-AUUCUUCACUUCUUGAGUCACUCCCAA-3' | (SEQ ID NO: 7353) |
|  | 3'-UAAGAAGUGAAGAACUCAGUGAGGGUU-5' | (SEQ ID NO: 1808) |
| βc-3138 Target: | 5'-ATTCTTCACTTCTTGAGTCACTCCCAA-3' | (SEQ ID NO: 2917) |
|  | 5'-CAUUCUUCACUUCUUGAGUCACUCCCA-3' | (SEQ ID NO: 7354) |
|  | 3'-GUAAGAAGUGAAGAACUCAGUGAGGGU-5' | (SEQ ID NO: 1809) |
| βc-3139 Target: | 5'-CATTCTTCACTTCTTGAGTCACTCCCA-3' | (SEQ ID NO: 2918) |
|  | 5'-GCAUUCUUCACUUCUUGAGUCACUCCC-3' | (SEQ ID NO: 7355) |
|  | 3'-CGUAAGAAGUGAAGAACUCAGUGAGGG-5' | (SEQ ID NO: 1810) |
| βc-3140 Target: | 5'-GCATTCTTCACTTCTTGAGTCACTCCC-3' | (SEQ ID NO: 2919) |
|  | 5'-GUGCAUUCUUCACUUCUUGAGUCACUC-3' | (SEQ ID NO: 7356) |
|  | 3'-CACGUAAGAAGUGAAGAACUCAGUGAG-5' | (SEQ ID NO: 1811) |
| βc-3142 Target: | 5'-GTGCATTCTTCACTTCTTGAGTCACTC-3' | (SEQ ID NO: 2920) |
|  | 5'-CCAUUCUUGUGCAUUCUUCACUUCUUG-3' | (SEQ ID NO: 7357) |
|  | 3'-GGUAAGAACACGUAAGAAGUGAAGAAC-5' | (SEQ ID NO: 1812) |
| βc-3150 Target: | 5'-CCATTCTTGTGCATTCTTCACTTCTTG-3' | (SEQ ID NO: 2921) |
|  | 5'-GAUCCAUUCUUGUGCAUUCUUCACUUC-3' | (SEQ ID NO: 7358) |
|  | 3'-CUAGGUAAGAACACGUAAGAAGUGAAG-5' | (SEQ ID NO: 1813) |
| βc-3153 Target: | 5'-GATCCATTCTTGTGCATTCTTCACTTC-3' | (SEQ ID NO: 2922) |
|  | 5'-UGAUCCAUUCUUGUGCAUUCUUCACUU-3' | (SEQ ID NO: 7359) |
|  | 3'-ACUAGGUAAGAACACGUAAGAAGUGAA-5' | (SEQ ID NO: 1814) |
| βc-3154 Target: | 5'-TGATCCATTCTTGTGCATTCTTCACTT-3' | (SEQ ID NO: 2923) |

TABLE 13-continued

Additional Selected Anti-β-catenin DsiRNAs, Blunt, Unfrayed Duplexes

|  |  |  |  |
|---|---|---|---|
|  | 5'-GUGAUCCAUUCUUGUGCAUUCUUCACU-3' | (SEQ ID NO: 7360) |  |
|  | 3'-CACUAGGUAAGAACACGUAAGAAGUGA-5' | (SEQ ID NO: 1815) |  |
| βc-3155 Target: | 5'-GTGATCCATTCTTGTGCATTCTTCACT-3' | (SEQ ID NO: 2924) |  |
|  | 5'-UAAAUUCCAUCUUGUGAUCCAUUCUUG-3' | (SEQ ID NO: 7361) |  |
|  | 3'-AUUUAAGGUAGAACACUAGGUAAGAAC-5' | (SEQ ID NO: 1816) |  |
| βc-3168 Target: | 5'-TAAATTCCATCTTGTGATCCATTCTTG-3' | (SEQ ID NO: 2925) |  |
|  | 5'-GAUAAAUUCCAUCUUGUGAUCCAUUCU-3' | (SEQ ID NO: 7362) |  |
|  | 3'-CUAUUUAAGGUAGAACACUAGGUAAGA-5' | (SEQ ID NO: 1817) |  |
| βc-3170 Target: | 5'-GATAAATTCCATCTTGTGATCCATTCT-3' | (SEQ ID NO: 2926) |  |
|  | 5'-UGAUAAAUUCCAUCUUGUGAUCCAUUC-3' | (SEQ ID NO: 7363) |  |
|  | 3'-ACUAUUUAAGGUAGAACACUAGGUAAG-5' | (SEQ ID NO: 1818) |  |
| βc-3171 Target: | 5'-TGATAAATTCCATCTTGTGATCCATTC-3' | (SEQ ID NO: 2927) |  |
|  | 5'-UUGAUAAAUUCCAUCUUGUGAUCCAUU-3' | (SEQ ID NO: 7364) |  |
|  | 3'-AACUAUUUAAGGUAGAACACUAGGUAA-5' | (SEQ ID NO: 1819) |  |
| βc-3172 Target: | 5'-TTGATAAATTCCATCTTGTGATCCATT-3' | (SEQ ID NO: 2928) |  |
|  | 5'-UUUGAUAAAUUCCAUCUUGUGAUCCAU-3' | (SEQ ID NO: 7365) |  |
|  | 3'-AAACUAUUUAAGGUAGAACACUAGGUA-5' | (SEQ ID NO: 1820) |  |
| βc-3173 Target: | 5'-TTTGATAAATTCCATCTTGTGATCC-3' | (SEQ ID NO: 2929) |  |
|  | 5'-AAGGCUAGGGUUUGAUAAAUUCCAUCU-3' | (SEQ ID NO: 7366) |  |
|  | 3'-UUCCGAUCCCAAACUAUUUAAGGUAGA-5' | (SEQ ID NO: 1821) |  |
| βc-3183 Target: | 5'-AAGGCTAGGGTTTGATAAATTCCATCT-3' | (SEQ ID NO: 2930) |  |
|  | 5'-AAAAAAAUUUAACAAGCAAGGCUAGGG-3' | (SEQ ID NO: 7367) |  |
|  | 3'-UUUUUUUAAAUUGUUCGUUCCGAUCCC-5' | (SEQ ID NO: 1822) |  |
| βc-3200 Target: | 5'-AAAAAAATTTAACAAGCAAGGCTAGGG-3' | (SEQ ID NO: 2931) |  |
|  | 5'-AAAAAAAAAAAAAAAUUUAACAAGCA-3' | (SEQ ID NO: 7368) |  |
|  | 3'-UUUUUUUUUUUUUUUUAAAUUGUUCGU-5' | (SEQ ID NO: 1823) |  |
| βc-3209 Target: | 5'-AAAAAAAAAAAAAAAATTTAACAAGCA-3' | (SEQ ID NO: 2932) |  |
|  | 5'-AAAAAAAAAAAAAAAAUUUAACAAGC-3' | (SEQ ID NO: 7369) |  |
|  | 3'-UUUUUUUUUUUUUUUUUAAAUUGUUCG-5' | (SEQ ID NO: 1824) |  |
| βc-3210 Target: | 5'-AAAAAAAAAAAAAAAAATTTAACAAGC-3' | (SEQ ID NO: 2933) |  |
|  | 5'-AAAAAAAAAAAAAAAAAUUUAACAAG-3' | (SEQ ID NO: 7370) |  |
|  | 3'-UUUUUUUUUUUUUUUUUUAAAUUGUUC-5' | (SEQ ID NO: 1825) |  |
| βc-3211 Target: | 5'-AAAAAAAAAAAAAAAAAATTTAACAAG-3' | (SEQ ID NO: 2934) |  |
|  | 5'-AAAAAAAAAAAAAAAAAAUUUAACAA-3' | (SEQ ID NO: 7371) |  |
|  | 3'-UUUUUUUUUUUUUUUUUUUAAAUUGUU-5' | (SEQ ID NO: 1826) |  |
| βc-3212 Target: | 5'-AAAAAAAAAAAAAAAAAAATTTAACAA-3' | (SEQ ID NO: 2935) |  |
|  | 5'-UAAAAAAAAAAAAAAAAAAAUUUAACA-3' | (SEQ ID NO: 7372) |  |
|  | 3'-AUUUUUUUUUUUUUUUUUUUAAAUUGU-5' | (SEQ ID NO: 1827) |  |
| βc-3213 Target: | 5'-TAAAAAAAAAAAAAAAAAAATTTAACA-3' | (SEQ ID NO: 2936) |  |

TABLE 13-continued

Additional Selected Anti-β-catenin DsiRNAs, Blunt, Unfrayed Duplexes

|              |                                             |                  |
|--------------|---------------------------------------------|------------------|
|              | 5'-UUAAAAAAAAAAAAAAAAAAAUUUAAC-3'           | (SEQ ID NO: 7373) |
|              | 3'-AAUUUUUUUUUUUUUUUUUUUAAAUUG-5'           | (SEQ ID NO: 1828) |
| βc-3214 Target: | 5'-TTAAAAAAAAAAAAAAAAAAATTTAAC-3'        | (SEQ ID NO: 2937) |
|              | 5'-CUUAAAAAAAAAAAAAAAAAAAUUUAA-3'           | (SEQ ID NO: 7374) |
|              | 3'-GAAUUUUUUUUUUUUUUUUUUAAAUU-5'            | (SEQ ID NO: 1829) |
| βc-3215 Target: | 5'-CTTAAAAAAAAAAAAAAAAAAATTTAA-3'        | (SEQ ID NO: 2938) |
|              | 5'-UCUUAAAAAAAAAAAAAAAAAAAUUUA-3'           | (SEQ ID NO: 7375) |
|              | 3'-AGAAUUUUUUUUUUUUUUUUUUUAAAU-5'           | (SEQ ID NO: 1830) |
| βc-3216 Target: | 5'-TCTTAAAAAAAAAAAAAAAAAAATTTA-3'        | (SEQ ID NO: 2939) |
|              | 5'-AUUCUUAAAAAAAAAAAAAAAAAAAUU-3'           | (SEQ ID NO: 7376) |
|              | 3'-UAAGAAUUUUUUUUUUUUUUUUUUUAA-5'           | (SEQ ID NO: 1831) |
| βc-3218 Target: | 5'-ATTCTTAAAAAAAAAAAAAAAAAAATT-3'        | (SEQ ID NO: 2940) |
|              | 5'-UAUUCUUAAAAAAAAAAAAAAAAAAAU-3'           | (SEQ ID NO: 7377) |
|              | 3'-AUAAGAAUUUUUUUUUUUUUUUUUUUA-5'           | (SEQ ID NO: 1832) |
| βc-3219 Target: | 5'-TATTCTTAAAAAAAAAAAAAAAAAAAT-3'        | (SEQ ID NO: 2941) |
|              | 5'-AUAUUCUUAAAAAAAAAAAAAAAAAAA-3'           | (SEQ ID NO: 7378) |
|              | 3'-UAUAAGAAUUUUUUUUUUUUUUUUUUU-5'           | (SEQ ID NO: 1833) |
| βc-3220 Target: | 5'-ATATTCTTAAAAAAAAAAAAAAAAAAA-3'        | (SEQ ID NO: 2942) |
|              | 5'-GAUAUUCUUAAAAAAAAAAAAAAAAAA-3'           | (SEQ ID NO: 7379) |
|              | 3'-CUAUAAGAAUUUUUUUUUUUUUUUUUU-5'           | (SEQ ID NO: 1834) |
| βc-3221 Target: | 5'-GATATTCTTAAAAAAAAAAAAAAAAAA-3'        | (SEQ ID NO: 2943) |
|              | 5'-AGAUAUUCUUAAAAAAAAAAAAAAAAA-3'           | (SEQ ID NO: 7380) |
|              | 3'-UCUAUAAGAAUUUUUUUUUUUUUUUUU-5'           | (SEQ ID NO: 1835) |
| βc-3222 Target: | 5'-AGATATTCTTAAAAAAAAAAAAAAAAA-3'        | (SEQ ID NO: 2944) |
|              | 5'-CAGAUAUUCUUAAAAAAAAAAAAAAAA-3'           | (SEQ ID NO: 7381) |
|              | 3'-GUCUAUAAGAAUUUUUUUUUUUUUUUU-5'           | (SEQ ID NO: 1836) |
| βc-3223 Target: | 5'-CAGATATTCTTAAAAAAAAAAAAAAAA-3'        | (SEQ ID NO: 2945) |
|              | 5'-ACAGAUAUUCUUAAAAAAAAAAAAAAA-3'           | (SEQ ID NO: 7382) |
|              | 3'-UGUCUAUAAGAAUUUUUUUUUUUUUUU-5'           | (SEQ ID NO: 1837) |
| βc-3224 Target: | 5'-ACAGATATTCTTAAAAAAAAAAAAAAA-3'        | (SEQ ID NO: 2946) |
|              | 5'-CAUUACAGAUAUUCUUAAAAAAAAAAA-3'           | (SEQ ID NO: 7383) |
|              | 3'-GUAAUGUCUAUAAGAAUUUUUUUUUUU-5'           | (SEQ ID NO: 1838) |
| βc-3228 Target: | 5'-CATTACAGATATTCTTAAAAAAAAAAA-3'        | (SEQ ID NO: 2947) |
|              | 5'-CCAUUACAGAUAUUCUUAAAAAAAAAA-3'           | (SEQ ID NO: 7384) |
|              | 3'-GGUAAUGUCUAUAAGAAUUUUUUUUUU-5'           | (SEQ ID NO: 1839) |
| βc-3229 Target: | 5'-CCATTACAGATATTCTTAAAAAAAAAA-3'        | (SEQ ID NO: 2948) |
|              | 5'-AGUACCAUUACAGAUAUUCUUAAAAAA-3'           | (SEQ ID NO: 7385) |
|              | 3'-UCAUGGUAAUGUCUAUAAGAAUUUUUU-5'           | (SEQ ID NO: 1840) |
| βc-3233 Target: | 5'-AGTACCATTACAGATATTCTTAAAAAA-3'        | (SEQ ID NO: 2949) |

TABLE 13-continued

Additional Selected Anti-β-catenin DsiRNAs, Blunt, Unfrayed Duplexes

|  |  |  |  |
|---|---|---|---|
|  | 5'-CAGUACCAUUACAGAUAUUCUUAAAAA-3' | (SEQ ID NO: 7386) |
|  | 3'-GUCAUGGUAAUGUCUAUAAGAAUUUUU-5' | (SEQ ID NO: 1841) |
| βc-3234 Target: | 5'-CAGTACCATTACAGATATTCTTAAAAA-3' | (SEQ ID NO: 2950) |
|  | 5'-UCAGUACCAUUACAGAUAUUCUUAAAA-3' | (SEQ ID NO: 7387) |
|  | 3'-AGUCAUGGUAAUGUCUAUAAGAAUUUU-5' | (SEQ ID NO: 1842) |
| βc-3235 Target: | 5'-TCAGTACCATTACAGATATTCTTAAAA-3' | (SEQ ID NO: 2951) |
|  | 5'-AAAGUCAGUACCAUUACAGAUAUUCUU-3' | (SEQ ID NO: 7388) |
|  | 3'-UUUCAGUCAUGGUAAUGUCUAUAAGAA-5' | (SEQ ID NO: 1843) |
| βc-3239 Target: | 5'-AAAGTCAGTACCATTACAGATATTCTT-3' | (SEQ ID NO: 2952) |
|  | 5'-GCUACUUCAAAGCAAGCAAAGUCAGUA-3' | (SEQ ID NO: 7389) |
|  | 3'-CGAUGAAGUUUCGUUCGUUUCAGUCAU-5' | (SEQ ID NO: 1844) |
| βc-3256 Target: | 5'-GCTACTTCAAAGCAAGCAAAGTCAGTA-3' | (SEQ ID NO: 2953) |
|  | 5'-AAAAAAAGAGCUACUUCAAAGCAAGCA-3' | (SEQ ID NO: 7390) |
|  | 3'-UUUUUUUCUCGAUGAAGUUUCGUUCGU-5' | (SEQ ID NO: 1845) |
| βc-3265 Target: | 5'-AAAAAAAGAGCTACTTCAAAGCAAGCA-3' | (SEQ ID NO: 2954) |
|  | 5'-AAAAAAAAAAAGAGCUACUUCAAAGC-3' | (SEQ ID NO: 7391) |
|  | 3'-UUUUUUUUUUUUCUCGAUGAAGUUUCG-5' | (SEQ ID NO: 1846) |
| βc-3270 Target: | 5'-AAAAAAAAAAAGAGCTACTTCAAAGC-3' | (SEQ ID NO: 2955) |
|  | 5'-AAAAAAAAAAAAGAGCUACUUCAAAG-3' | (SEQ ID NO: 7392) |
|  | 3'-UUUUUUUUUUUUUCUCGAUGAAGUUUC-5' | (SEQ ID NO: 1847) |
| βc-3271 Target: | 5'-AAAAAAAAAAAAGAGCTACTTCAAAG-3' | (SEQ ID NO: 2956) |
|  | 5'-AAAAAAAAAAAAAGAGCUACUUCAA-3' | (SEQ ID NO: 7393) |
|  | 3'-UUUUUUUUUUUUUUCUCGAUGAAGUU-5' | (SEQ ID NO: 1848) |
| βc-3273 Target: | 5'-AAAAAAAAAAAAAGAGCTACTTCAA-3' | (SEQ ID NO: 2957) |
|  | 5'-AAAAAAAAAAAAAAGAGCUACUUCA-3' | (SEQ ID NO: 7394) |
|  | 3'-UUUUUUUUUUUUUUUCUCGAUGAAGU-5' | (SEQ ID NO: 1849) |
| βc-3274 Target: | 5'-AAAAAAAAAAAAAAGAGCTACTTCA-3' | (SEQ ID NO: 2958) |
|  | 5'-AAAAAAAAAAAAAAAGAGCUACUUC-3' | (SEQ ID NO: 7395) |
|  | 3'-UUUUUUUUUUUUUUUUCUCGAUGAAG-5' | (SEQ ID NO: 1850) |
| βc-3275 Target: | 5'-AAAAAAAAAAAAAAAGAGCTACTTC-3' | (SEQ ID NO: 2959) |
|  | 5'-AAAAAAAAAAAAAAAAGAGCUACUU-3' | (SEQ ID NO: 7396) |
|  | 3'-UUUUUUUUUUUUUUUUUCUCGAUGAA-5' | (SEQ ID NO: 1851) |
| βc-3276 Target: | 5'-AAAAAAAAAAAAAAAAGAGCTACTT-3' | (SEQ ID NO: 2960) |
|  | 5'-AAAAAAAAAAAAAAAAAAAAGAG-3' | (SEQ ID NO: 7397) |
|  | 3'-UUUUUUUUUUUUUUUUUUUUUCUC-5' | (SEQ ID NO: 1852) |
| βc-3282 Target: | 5'-AAAAAAAAAAAAAAAAAAAAGAG-3' | (SEQ ID NO: 2961) |
|  | 5'-AAAAAAAAAAAAAAAAAAAAAGA-3' | (SEQ ID NO: 7398) |
|  | 3'-UUUUUUUUUUUUUUUUUUUUUUCU-5' | (SEQ ID NO: 1853) |
| βc-3283 Target: | 5'-AAAAAAAAAAAAAAAAAAAAAGA-3' | (SEQ ID NO: 2962) |

TABLE 13-continued

Additional Selected Anti-β-catenin DsiRNAs, Blunt, Unfrayed Duplexes

|  |  |  |
|---|---|---|
|  | 5'-CAAAAAAAAAAAAAAAAAAAAAAAG-3' | (SEQ ID NO: 7399) |
|  | 3'-GUUUUUUUUUUUUUUUUUUUUUUUC-5' | (SEQ ID NO: 1854) |
| βc-3284 Target: | 5'-CAAAAAAAAAAAAAAAAAAAAAAAG-3' | (SEQ ID NO: 2963) |
|  | 5'-GCAAAAAAAAAAAAAAAAAAAAAAA-3' | (SEQ ID NO: 7400) |
|  | 3'-CGUUUUUUUUUUUUUUUUUUUUUUU-5' | (SEQ ID NO: 1855) |
| βc-3285 Target: | 5'-GCAAAAAAAAAAAAAAAAAAAAAAA-3' | (SEQ ID NO: 2964) |
|  | 5'-CUGCAAAAAAAAAAAAAAAAAAAAA-3' | (SEQ ID NO: 7401) |
|  | 3'-GACGUUUUUUUUUUUUUUUUUUUUU-5' | (SEQ ID NO: 1856) |
| βc-3287 Target: | 5'-CTGCAAAAAAAAAAAAAAAAAAAAA-3' | (SEQ ID NO: 2965) |
|  | 5'-ACUGCAAAAAAAAAAAAAAAAAAAA-3' | (SEQ ID NO: 7402) |
|  | 3'-UGACGUUUUUUUUUUUUUUUUUUUU-5' | (SEQ ID NO: 1857) |
| βc-3288 Target: | 5'-ACTGCAAAAAAAAAAAAAAAAAAAA-3' | (SEQ ID NO: 2966) |
|  | 5'-AGUUACUGCAAAAAAAAAAAAAAAA-3' | (SEQ ID NO: 7403) |
|  | 3'-UCAAUGACGUUUUUUUUUUUUUUUU-5' | (SEQ ID NO: 1858) |
| βc-3292 Target: | 5'-AGTTACTGCAAAAAAAAAAAAAAAA-3' | (SEQ ID NO: 2967) |
|  | 5'-CAGUUACUGCAAAAAAAAAAAAAAA-3' | (SEQ ID NO: 7404) |
|  | 3'-GUCAAUGACGUUUUUUUUUUUUUUU-5' | (SEQ ID NO: 1859) |
| βc-3293 Target: | 5'-CAGTTACTGCAAAAAAAAAAAAAAA-3' | (SEQ ID NO: 2968) |
|  | 5'-ACAGUUACUGCAAAAAAAAAAAAAA-3' | (SEQ ID NO: 7405) |
|  | 3'-UGUCAAUGACGUUUUUUUUUUUUUU-5' | (SEQ ID NO: 1860) |
| βc-3294 Target: | 5'-ACAGTTACTGCAAAAAAAAAAAAAA-3' | (SEQ ID NO: 2969) |
|  | 5'-AAAAACAGUUACUGCAAAAAAAAAA-3' | (SEQ ID NO: 7406) |
|  | 3'-UUUUUGUCAAUGACGUUUUUUUUUU-5' | (SEQ ID NO: 1861) |
| βc-3298 Target: | 5'-AAAAACAGTTACTGCAAAAAAAAAA-3' | (SEQ ID NO: 2970) |
|  | 5'-AAAAAACAGUUACUGCAAAAAAAAA-3' | (SEQ ID NO: 7407) |
|  | 3'-UUUUUUGUCAAUGACGUUUUUUUUU-5' | (SEQ ID NO: 1862) |
| βc-3299 Target: | 5'-AAAAAACAGTTACTGCAAAAAAAAA-3' | (SEQ ID NO: 2971) |
|  | 5'-UAAAAAACAGUUACUGCAAAAAAAA-3' | (SEQ ID NO: 7408) |
|  | 3'-AUUUUUUGUCAAUGACGUUUUUUUU-5' | (SEQ ID NO: 1863) |
| βc-3300 Target: | 5'-TAAAAAACAGTTACTGCAAAAAAAA-3' | (SEQ ID NO: 2972) |
|  | 5'-CUUAAAAAACAGUUACUGCAAAAAA-3' | (SEQ ID NO: 7409) |
|  | 3'-GAAUUUUUUGUCAAUGACGUUUUUU-5' | (SEQ ID NO: 1864) |
| βc-3302 Target: | 5'-CTTAAAAAACAGTTACTGCAAAAAA-3' | (SEQ ID NO: 2973) |
|  | 5'-ACUUAAAAAACAGUUACUGCAAAAA-3' | (SEQ ID NO: 7410) |
|  | 3'-UGAAUUUUUUGUCAAUGACGUUUUU-5' | (SEQ ID NO: 1865) |
| βc-3303 Target: | 5'-ACTTAAAAAACAGTTACTGCAAAAA-3' | (SEQ ID NO: 2974) |
|  | 5'-AGACUUAAAAAACAGUUACUGCAAAA-3' | (SEQ ID NO: 7411) |
|  | 3'-UCUGAAUUUUUUGUCAAUGACGUUUU-5' | (SEQ ID NO: 1866) |
| βc-3305 Target: | 5'-AGACTTAAAAAACAGTTACTGCAAAAA-3' | (SEQ ID NO: 2975) |

TABLE 13-continued

Additional Selected Anti-β-catenin DsiRNAs, Blunt, Unfrayed Duplexes

|  |  |  |
|---|---|---|
|  | 5'-ACACUACGAGAGACUUAAAAAACAGUU-3' | (SEQ ID NO: 7412) |
|  | 3'-UGUGAUGCUCUCUGAAUUUUUUGUCAA-5' | (SEQ ID NO: 1867) |
| βc-3315 Target: | 5'-ACACTACGAGAGACTTAAAAAACAGTT-3' | (SEQ ID NO: 2976) |
|  | 5'-UAACACUACGAGAGACUUAAAAAACAG-3' | (SEQ ID NO: 7413) |
|  | 3'-AUUGUGAUGCUCUCUGAAUUUUUUGUC-5' | (SEQ ID NO: 1868) |
| βc-3317 Target: | 5'-TAACACTACGAGAGACTTAAAAAACAG-3' | (SEQ ID NO: 2977) |
|  | 5'-UUAACACUACGAGAGACUUAAAAAACA-3' | (SEQ ID NO: 7414) |
|  | 3'-AAUUGUGAUGCUCUCUGAAUUUUUUGU-5' | (SEQ ID NO: 1869) |
| βc-3318 Target: | 5'-TTAACACTACGAGAGACTTAAAAAACA-3' | (SEQ ID NO: 2978) |
|  | 5'-ACUUAACACUACGAGAGACUUAAAAAA-3' | (SEQ ID NO: 7415) |
|  | 3'-UGAAUUGUGAUGCUCUCUGAAUUUUUU-5' | (SEQ ID NO: 1870) |
| βc-3320 Target: | 5'-ACTTAACACTACGAGAGACTTAAAAAA-3' | (SEQ ID NO: 2979) |
|  | 5'-AUAACUUAACACUACGAGAGACUUAAA-3' | (SEQ ID NO: 7416) |
|  | 3'-UAUUGAAUUGUGAUGCUCUCUGAAUUU-5' | (SEQ ID NO: 1871) |
| βc-3323 Target: | 5'-ATAACTTAACACTACGAGAGACTTAAA-3' | (SEQ ID NO: 2980) |
|  | 5'-UAUAACUUAACACUACGAGAGACUUAA-3' | (SEQ ID NO: 7417) |
|  | 3'-AUAUUGAAUUGUGAUGCUCUCUGAAUU-5' | (SEQ ID NO: 1872) |
| βc-3324 Target: | 5'-TATAACTTAACACTACGAGAGACTTAA-3' | (SEQ ID NO: 2981) |
|  | 5'-GUAUUCACUAUAACUUAACACUACGAG-3' | (SEQ ID NO: 7418) |
|  | 3'-CAUAAGUGAUAUUGAAUUGUGAUGCUC-5' | (SEQ ID NO: 1873) |
| βc-3332 Target: | 5'-GTATTCACTATAACTTAACACTACGAG-3' | (SEQ ID NO: 2982) |
|  | 5'-AGUAUUCACUAUAACUUAACACUACGA-3' | (SEQ ID NO: 7419) |
|  | 3'-UCAUAAGUGAUAUUGAAUUGUGAUGCU-5' | (SEQ ID NO: 1874) |
| βc-3333 Target: | 5'-AGTATTCACTATAACTTAACACTACGA-3' | (SEQ ID NO: 2983) |
|  | 5'-CAGUAUUCACUAUAACUUAACACUACG-3' | (SEQ ID NO: 7420) |
|  | 3'-GUCAUAAGUGAUAUUGAAUUGUGAUGC-5' | (SEQ ID NO: 1875) |
| βc-3334 Target: | 5'-CAGTATTCACTATAACTTAACACTACG-3' | (SEQ ID NO: 2984) |
|  | 5'-GCAGUAUUCACUAUAACUUAACACUAC-3' | (SEQ ID NO: 7421) |
|  | 3'-CGUCAUAAGUGAUAUUGAAUUGUGAUG-5' | (SEQ ID NO: 1876) |
| βc-3335 Target: | 5'-GCAGTATTCACTATAACTTAACACTAC-3' | (SEQ ID NO: 2985) |
|  | 5'-AGAAAUUGCUGUAGCAGUAUUCACUAU-3' | (SEQ ID NO: 7422) |
|  | 3'-UCUUUAACGACAUCGUCAUAAGUGAUA-5' | (SEQ ID NO: 1877) |
| βc-3348 Target: | 5'-AGAAATTGCTGTAGCAGTATTCACTAT-3' | (SEQ ID NO: 2986) |
|  | 5'-UAGAAAUUGCUGUAGCAGUAUUCACUA-3' | (SEQ ID NO: 7423) |
|  | 3'-AUCUUUAACGACAUCGUCAUAAGUGAU-5' | (SEQ ID NO: 1878) |
| βc-3349 Target: | 5'-TAGAAATTGCTGTAGCAGTATTCACTA-3' | (SEQ ID NO: 2987) |
|  | 5'-UUAGAAAUUGCUGUAGCAGUAUUCACU-3' | (SEQ ID NO: 7424) |
|  | 3'-AAUCUUUAACGACAUCGUCAUAAGUGA-5' | (SEQ ID NO: 1879) |
| βc-3350 Target: | 5'-TTAGAAATTGCTGTAGCAGTATTCACT-3' | (SEQ ID NO: 2988) |

TABLE 13-continued

Additional Selected Anti-β-catenin DsiRNAs, Blunt, Unfrayed Duplexes

|  |  |  |  |
|---|---|---|---|
|  | 5'-ACUCAAUUCUUAAAAAUUAGAAAUUGC-3' | (SEQ ID NO: 7425) |
|  | 3'-UGAGUUAAGAAUUUUUAAUCUUUAACG-5' | (SEQ ID NO: 1880) |
| βc-3366 Target: | 5'-ACTCAATTCTTAAAAATTAGAAATTGC-3' | (SEQ ID NO: 2989) |
|  | 5'-CCAUUACUCAAUUCUUAAAAAUUAGAA-3' | (SEQ ID NO: 7426) |
|  | 3'-GGUAAUGAGUUAAGAAUUUUUAAUCUU-5' | (SEQ ID NO: 1881) |
| βc-3371 Target: | 5'-CCATTACTCAATTCTTAAAAATTAGAA-3' | (SEQ ID NO: 2990) |
|  | 5'-ACACCAUUACUCAAUUCUUAAAAAUUA-3' | (SEQ ID NO: 7427) |
|  | 3'-UGUGGUAAUGAGUUAAGAAUUUUUAAU-5' | (SEQ ID NO: 1882) |
| βc-3374 Target: | 5'-ACACCATTACTCAATTCTTAAAAATTA-3' | (SEQ ID NO: 2991) |
|  | 5'-CUACACCAUUACUCAAUUCUUAAAAAU-3' | (SEQ ID NO: 7428) |
|  | 3'-GAUGUGGUAAUGAGUUAAGAAUUUUUA-5' | (SEQ ID NO: 1883) |
| βc-3376 Target: | 5'-CTACACCATTACTCAATTCTTAAAAAT-3' | (SEQ ID NO: 2992) |
|  | 5'-UCUACACCAUUACUCAAUUCUUAAAAA-3' | (SEQ ID NO: 7429) |
|  | 3'-AGAUGUGGUAAUGAGUUAAGAAUUUUU-5' | (SEQ ID NO: 1884) |
| βc-3377 Target: | 5'-TCTACACCATTACTCAATTCTTAAAAA-3' | (SEQ ID NO: 2993) |
|  | 5'-GUUCUACACCAUUACUCAAUUCUUAAA-3' | (SEQ ID NO: 7430) |
|  | 3'-CAAGAUGUGGUAAUGAGUUAAGAAUUU-5' | (SEQ ID NO: 1885) |
| βc-3379 Target: | 5'-GTTCTACACCATTACTCAATTCTTAAA-3' | (SEQ ID NO: 2994) |
|  | 5'-GUGUUCUACACCAUUACUCAAUUCUUA-3' | (SEQ ID NO: 7431) |
|  | 3'-CACAAGAUGUGGUAAUGAGUUAAGAAU-5' | (SEQ ID NO: 1886) |
| βc-3381 Target: | 5'-GTGTTCTACACCATTACTCAATTCTTA-3' | (SEQ ID NO: 2995) |
|  | 5'-AUGAAUUAGUGUUCUACACCAUUACUC-3' | (SEQ ID NO: 7432) |
|  | 3'-UACUUAAUCACAAGAUGUGGUAAUGAG-5' | (SEQ ID NO: 1887) |
| βc-3389 Target: | 5'-ATGAATTAGTGTTCTACACCATTACTC-3' | (SEQ ID NO: 2996) |
|  | 5'-UGAUUAUGAAUUAGUGUUCUACACCAU-3' | (SEQ ID NO: 7433) |
|  | 3'-ACUAAUACUUAAUCACAAGAUGUGGUA-5' | (SEQ ID NO: 1888) |
| βc-3394 Target: | 5'-TGATTATGAATTAGTGTTCTACACC-3' | (SEQ ID NO: 2997) |
|  | 5'-GUGAUUAUGAAUUAGUGUUCUACACCA-3' | (SEQ ID NO: 7434) |
|  | 3'-CACUAAUACUUAAUCACAAGAUGUGGU-5' | (SEQ ID NO: 1889) |
| βc-3395 Target: | 5'-GTGATTATGAATTAGTGTTCTACACCA-3' | (SEQ ID NO: 2998) |
|  | 5'-AGUGAUUAUGAAUUAGUGUUCUACACC-3' | (SEQ ID NO: 7435) |
|  | 3'-UCACUAAUACUUAAUCACAAGAUGUGG-5' | (SEQ ID NO: 1890) |
| βc-3396 Target: | 5'-AGTGATTATGAATTAGTGTTCTACACC-3' | (SEQ ID NO: 2999) |
|  | 5'-AUUAAUUAGAGUGAUUAUGAAUUAGUG-3' | (SEQ ID NO: 7436) |
|  | 3'-UAAUUAAUCUCACUAAUACUUAAUCAC-5' | (SEQ ID NO: 1891) |
| βc-3405 Target: | 5'-ATTAATTAGAGTGATTATGAATTAGTG-3' | (SEQ ID NO: 3000) |
|  | 5'-AAUUAAUUAGAGUGAUUAUGAAUUAGU-3' | (SEQ ID NO: 7437) |
|  | 3'-UUAAUUAAUCUCACUAAUACUUAAUCA-5' | (SEQ ID NO: 1892) |
| βc-3406 Target: | 5'-AATTAATTAGAGTGATTATGAATTAGT-3' | (SEQ ID NO: 3001) |

TABLE 13-continued

Additional Selected Anti-β-catenin DsiRNAs, Blunt, Unfrayed Duplexes

|  |  |  |
|---|---|---|
| | 5'-CAAUUAAUUAGAGUGAUUAUGAAUUAG-3' | (SEQ ID NO: 7438) |
| | 3'-GUUAAUUAAUCUCACUAAUACUUAAUC-5' | (SEQ ID NO: 1893) |
| βc-3407 Target: | 5'-CAATTAATTAGAGTGATTATGAATTAG-3' | (SEQ ID NO: 3002) |
| | 5'-AUUACAAUUAAUUAGAGUGAUUAUGAA-3' | (SEQ ID NO: 7439) |
| | 3'-UAAUGUUAAUUAAUCUCACUAAUACUU-5' | (SEQ ID NO: 1894) |
| βc-3411 Target: | 5'-ATTACAATTAATTAGAGTGATTATGAA-3' | (SEQ ID NO: 3003) |
| | 5'-GAUUACAAUUAAUUAGAGUGAUUAUGA-3' | (SEQ ID NO: 7440) |
| | 3'-CUAAUGUUAAUUAAUCUCACUAAUACU-5' | (SEQ ID NO: 1895) |
| βc-3412 Target: | 5'-GATTACAATTAATTAGAGTGATTATGA-3' | (SEQ ID NO: 3004) |
| | 5'-AGAUUACAAUUAAUUAGAGUGAUUAUG-3' | (SEQ ID NO: 7441) |
| | 3'-UCUAAUGUUAAUUAAUCUCACUAAUAC-5' | (SEQ ID NO: 1896) |
| βc-3413 Target: | 5'-AGATTACAATTAATTAGAGTGATTATG-3' | (SEQ ID NO: 3005) |
| | 5'-CUUUAUUCAGAUUACAAUUAAUUAGAG-3' | (SEQ ID NO: 7442) |
| | 3'-GAAAUAAGUCUAAUGUUAAUUAAUCUC-5' | (SEQ ID NO: 1897) |
| βc-3421 Target: | 5'-CTTTATTCAGATTACAATTAATTAGAG-3' | (SEQ ID NO: 3006) |
| | 5'-ACUUUAUUCAGAUUACAAUUAAUUAGA-3' | (SEQ ID NO: 7443) |
| | 3'-UGAAAUAAGUCUAAUGUUAAUUAAUCU-5' | (SEQ ID NO: 1898) |
| βc-3422 Target: | 5'-ACTTTATTCAGATTACAATTAATTAGA-3' | (SEQ ID NO: 3007) |
| | 5'-UUACACUUUAUUCAGAUUACAAUUAAU-3' | (SEQ ID NO: 7444) |
| | 3'-AAUGUGAAAUAAGUCUAAUGUUAAUUA-5' | (SEQ ID NO: 1899) |
| βc-3426 Target: | 5'-TTACACTTTATTCAGATTACAATTAAT-3' | (SEQ ID NO: 3008) |
| | 5'-GUUACACUUUAUUCAGAUUACAAUUAA-3' | (SEQ ID NO: 7445) |
| | 3'-CAAUGUGAAAUAAGUCUAAUGUUAAUU-5' | (SEQ ID NO: 1900) |
| βc-3427 Target: | 5'-GTTACACTTTATTCAGATTACAATTAA-3' | (SEQ ID NO: 3009) |
| | 5'-UGUUACACUUUAUUCAGAUUACAAUUA-3' | (SEQ ID NO: 7446) |
| | 3'-ACAAUGUGAAAUAAGUCUAAUGUUAAU-5' | (SEQ ID NO: 1901) |
| βc-3428 Target: | 5'-TGTTACACTTTATTCAGATTACAATTA-3' | (SEQ ID NO: 3010) |
| | 5'-UUGUUACACUUUAUUCAGAUUACAAUU-3' | (SEQ ID NO: 7447) |
| | 3'-AACAAUGUGAAAUAAGUCUAAUGUUAA-5' | (SEQ ID NO: 1902) |
| βc-3429 Target: | 5'-TTGTTACACTTTATTCAGATTACAATT-3' | (SEQ ID NO: 3011) |
| | 5'-AUUGUUACACUUUAUUCAGAUUACAAU-3' | (SEQ ID NO: 7448) |
| | 3'-UAACAAUGUGAAAUAAGUCUAAUGUUA-5' | (SEQ ID NO: 1903) |
| βc-3430 Target: | 5'-ATTGTTACACTTTATTCAGATTACAAT-3' | (SEQ ID NO: 3012) |
| | 5'-CUACACAAUUGUUACACUUUAUUCAGA-3' | (SEQ ID NO: 7449) |
| | 3'-GAUGUGUUAACAAUGUGAAAUAAGUCU-5' | (SEQ ID NO: 1904) |
| βc-3437 Target: | 5'-CTACACAATTGTTACACTTTATTCAGA-3' | (SEQ ID NO: 3013) |
| | 5'-AAGGCUACACAAUUGUUACACUUUAUU-3' | (SEQ ID NO: 7450) |
| | 3'-UUCCGAUGUGUUAACAAUGUGAAAUAA-5' | (SEQ ID NO: 1905) |
| βc-3441 Target: | 5'-AAGGCTACACAATTGTTACACTTTATT-3' | (SEQ ID NO: 3014) |

TABLE 13-continued

Additional Selected Anti-β-catenin DsiRNAs, Blunt, Unfrayed Duplexes

|  |  |  |  |
|---|---|---|---|
|  | 5'-ACAAAAAGGCUACACAAUUGUUACACU-3' | (SEQ ID NO: 7451) |  |
|  | 3'-UGUUUUUCCGAUGUGUUAACAAUGUGA-5' | (SEQ ID NO: 1906) |  |
| βc-3446 Target: | 5'-ACAAAAAGGCTACACAATTGTTACACT-3' | (SEQ ID NO: 3015) |  |
|  | 5'-UUUUAUACAAAAAGGCUACACAAUUGU-3' | (SEQ ID NO: 7452) |  |
|  | 3'-AAAAUAUGUUUUUCCGAUGUGUUAACA-5' | (SEQ ID NO: 1907) |  |
| βc-3452 Target: | 5'-TTTTATACAAAAAGGCTACACAATTGT-3' | (SEQ ID NO: 3016) |  |
|  | 5'-AUUUUAUACAAAAAGGCUACACAAUUG-3' | (SEQ ID NO: 7453) |  |
|  | 3'-UAAAAUAUGUUUUUCCGAUGUGUUAAC-5' | (SEQ ID NO: 1908) |  |
| βc-3453 Target: | 5'-ATTTTATACAAAAAGGCTACACAATTG-3' | (SEQ ID NO: 3017) |  |
|  | 5'-CUAUUUUAUACAAAAAGGCUACACAAU-3' | (SEQ ID NO: 7454) |  |
|  | 3'-GAUAAAAUAUGUUUUUCCGAUGUGUUA-5' | (SEQ ID NO: 1909) |  |
| βc-3455 Target: | 5'-CTATTTTATACAAAAAGGCTACACAAT-3' | (SEQ ID NO: 3018) |  |
|  | 5'-UCUAUUUUAUACAAAAAGGCUACACAA-3' | (SEQ ID NO: 7455) |  |
|  | 3'-AGAUAAAAUAUGUUUUUCCGAUGUGUU-5' | (SEQ ID NO: 1910) |  |
| βc-3456 Target: | 5'-TCTATTTTATACAAAAAGGCTACACA-3' | (SEQ ID NO: 3019) |  |
|  | 5'-UGUCUAUUUUAUACAAAAAGGCUACAC-3' | (SEQ ID NO: 7456) |  |
|  | 3'-ACAGAUAAAAUAUGUUUUUCCGAUGUG-5' | (SEQ ID NO: 1911) |  |
| βc-3458 Target: | 5'-TGTCTATTTTATACAAAAAGGCTACAC-3' | (SEQ ID NO: 3020) |  |
|  | 5'-UCUAUUUGUCUAUUUUAUACAAAAAGG-3' | (SEQ ID NO: 7457) |  |
|  | 3'-AGAUAAACAGAUAAAAUAUGUUUUUCC-5' | (SEQ ID NO: 1912) |  |
| βc-3464 Target: | 5'-TCTATTTGTCTATTTTATACAAAAAGG-3' | (SEQ ID NO: 3021) |  |
|  | 5'-UUUCUAUUUGUCUAUUUUAUACAAAAA-3' | (SEQ ID NO: 7458) |  |
|  | 3'-AAAGAUAAACAGAUAAAAUAUGUUUUU-5' | (SEQ ID NO: 1913) |  |
| βc-3466 Target: | 5'-TTTCTATTTGTCTATTTTATACAAAAA-3' | (SEQ ID NO: 3022) |  |
|  | 5'-UUUUCUAUUUGUCUAUUUUAUACAAAA-3' | (SEQ ID NO: 7459) |  |
|  | 3'-AAAAGAUAAACAGAUAAAAUAUGUUUU-5' | (SEQ ID NO: 1914) |  |
| βc-3467 Target: | 5'-TTTTCTATTTGTCTATTTTATACAAAA-3' | (SEQ ID NO: 3023) |  |
|  | 5'-AUUUUCUAUUUGUCUAUUUUAUACAAA-3' | (SEQ ID NO: 7460) |  |
|  | 3'-UAAAAGAUAAACAGAUAAAAUAUGUUU-5' | (SEQ ID NO: 1915) |  |
| βc-3468 Target: | 5'-ATTTTCTATTTGTCTATTTTATACAAA-3' | (SEQ ID NO: 3024) |  |
|  | 5'-CAUUUUCUAUUUGUCUAUUUUAUACAA-3' | (SEQ ID NO: 7461) |  |
|  | 3'-GUAAAAGAUAAACAGAUAAAAUAUGUU-5' | (SEQ ID NO: 1916) |  |
| βc-3469 Target: | 5'-CATTTTCTATTTGTCTATTTTATACAA-3' | (SEQ ID NO: 3025) |  |
|  | 5'-CCAUUUUCUAUUUGUCUAUUUUAUACA-3' | (SEQ ID NO: 7462) |  |
|  | 3'-GGUAAAAGAUAAACAGAUAAAAUAUGU-5' | (SEQ ID NO: 1917) |  |
| βc-3470 Target: | 5'-CCATTTTCTATTTGTCTATTTTATACA-3' | (SEQ ID NO: 3026) |  |
|  | 5'-GGACCAUUUUCUAUUUGUCUAUUUUAU-3' | (SEQ ID NO: 7463) |  |
|  | 3'-CCUGGUAAAAGAUAAACAGAUAAAAUA-5' | (SEQ ID NO: 1918) |  |
| βc-3473 Target: | 5'-GGACCATTTTCTATTTGTCTATTTTAT-3' | (SEQ ID NO: 3027) |  |

TABLE 13-continued

Additional Selected Anti-β-catenin DsiRNAs, Blunt, Unfrayed Duplexes

|  |  |  |  |
|---|---|---|---|
|  | 5'-UGGACCAUUUUCUAUUUGUCUAUUUUA-3' | (SEQ ID NO: 7464) |
|  | 3'-ACCUGGUAAAAGAUAAACAGAUAAAAU-5' | (SEQ ID NO: 1919) |
| βc-3474 Target: | 5'-TGGACCATTTTCTATTTGTCTATTTTA-3' | (SEQ ID NO: 3028) |
|  | 5'-UUGGACCAUUUUCUAUUUGUCUAUUUU-3' | (SEQ ID NO: 7465) |
|  | 3'-AACCUGGUAAAAGAUAAACAGAUAAAA-5' | (SEQ ID NO: 1920) |
| βc-3475 Target: | 5'-TTGGACCATTTTCTATTTGTCTATTTT-3' | (SEQ ID NO: 3029) |
|  | 5'-AAACUAAUUGGACCAUUUUCUAUUUGU-3' | (SEQ ID NO: 7466) |
|  | 3'-UUUGAUUAACCUGGUAAAAGAUAAACA-5' | (SEQ ID NO: 1921) |
| βc-3482 Target: | 5'-AAACTAATTGGACCATTTTCTATTTGT-3' | (SEQ ID NO: 3030) |
|  | 5'-GAAACUAAUUGGACCAUUUUCUAUUUG-3' | (SEQ ID NO: 7467) |
|  | 3'-CUUUGAUUAACCUGGUAAAAGAUAAAC-5' | (SEQ ID NO: 1922) |
| βc-3483 Target: | 5'-GAAACTAATTGGACCATTTTCTATTTG-3' | (SEQ ID NO: 3031) |
|  | 5'-GGAAACUAAUUGGACCAUUUUCUAUUU-3' | (SEQ ID NO: 7468) |
|  | 3'-CCUUUGAUUAACCUGGUAAAAGAUAAA-5' | (SEQ ID NO: 1923) |
| βc-3484 Target: | 5'-GGAAACTAATTGGACCATTTTCTATTT-3' | (SEQ ID NO: 3032) |
|  | 5'-AGGAAACUAAUUGGACCAUUUUCUAUU-3' | (SEQ ID NO: 7469) |
|  | 3'-UCCUUUGAUUAACCUGGUAAAAGAUAA-5' | (SEQ ID NO: 1924) |
| βc-3485 Target: | 5'-AGGAAACTAATTGGACCATTTTCTATT-3' | (SEQ ID NO: 3033) |
|  | 5'-UUAAAAAGGAAACUAAUUGGACCAUUU-3' | (SEQ ID NO: 7470) |
|  | 3'-AAUUUUUCCUUUGAUUAACCUGGUAAA-5' | (SEQ ID NO: 1925) |
| βc-3491 Target: | 5'-TTAAAAAGGAAACTAATTGGACCATTT-3' | (SEQ ID NO: 3034) |
|  | 5'-AUUAAAAAGGAAACUAAUUGGACCAUU-3' | (SEQ ID NO: 7471) |
|  | 3'-UAAUUUUUCCUUUGAUUAACCUGGUAA-5' | (SEQ ID NO: 1926) |
| βc-3492 Target: | 5'-ATTAAAAAGGAAACTAATTGGACCATT-3' | (SEQ ID NO: 3035) |
|  | 5'-AAGCAUAUUAAAAGGAAACUAAUUGG-3' | (SEQ ID NO: 7472) |
|  | 3'-UUCGUAUAAUUUUUCCUUUGAUUAACC-5' | (SEQ ID NO: 1927) |
| βc-3498 Target: | 5'-AAGCATATTAAAAGGAAACTAATTGG-3' | (SEQ ID NO: 3036) |
|  | 5'-UAAGCAUAUUAAAAAGGAAACUAAUUG-3' | (SEQ ID NO: 7473) |
|  | 3'-AUUCGUAUAAUUUUUCCUUUGAUUAAC-5' | (SEQ ID NO: 1928) |
| βc-3499 Target: | 5'-TAAGCATATTAAAAAGGAAACTAATTG-3' | (SEQ ID NO: 3037) |
|  | 5'-AUUUUAAGCAUAUUAAAAAGGAAACUA-3' | (SEQ ID NO: 7474) |
|  | 3'-UAAAAUUCGUAUAAUUUUUCCUUUGAU-5' | (SEQ ID NO: 1929) |
| βc-3503 Target: | 5'-ATTTTAAGCATATTAAAAAGGAAACTA-3' | (SEQ ID NO: 3038) |
|  | 5'-CUGCUUAUUUUAAGCAUAUUAAAAAGG-3' | (SEQ ID NO: 7475) |
|  | 3'-GACGAAUAAAAUUCGUAUAAUUUUUCC-5' | (SEQ ID NO: 1930) |
| βc-3509 Target: | 5'-CTGCTTATTTTAAGCATATTAAAAAGG-3' | (SEQ ID NO: 3039) |
|  | 5'-CCUGCUUAUUUUAAGCAUAUUAAAAAG-3' | (SEQ ID NO: 7476) |
|  | 3'-GGACGAAUAAAAUUCGUAUAAUUUUUC-5' | (SEQ ID NO: 1931) |
| βc-3510 Target: | 5'-CCTGCTTATTTTAAGCATATTAAAAAG-3' | (SEQ ID NO: 3040) |

TABLE 13-continued

Additional Selected Anti-β-catenin DsiRNAs, Blunt, Unfrayed Duplexes

|  |  |  |  |
|---|---|---|---|
|  | 5'-GAUCCACCUGCUUAUUUUAAGCAUAUU-3' | (SEQ ID NO: 7477) |  |
|  | 3'-CUAGGUGGACGAAUAAAAUUCGUAUAA-5' | (SEQ ID NO: 1932) |  |
| βc-3516 Target: | 5'-GATCCACCTGCTTATTTTAAGCATATT-3' | (SEQ ID NO: 3041) |  |
|  | 5'-CAAAAACAUGAAAUAGAUCCACCUGCU-3' | (SEQ ID NO: 7478) |  |
|  | 3'-GUUUUUGUACUUUAUCUAGGUGGACGA-5' | (SEQ ID NO: 1933) |  |
| βc-3531 Target: | 5'-CAAAAACATGAAATAGATCCACCTGCT-3' | (SEQ ID NO: 3042) |  |
|  | 5'-UCAAAAACAUGAAAUAGAUCCACCUGC-3' | (SEQ ID NO: 7479) |  |
|  | 3'-AGUUUUUGUACUUUAUCUAGGUGGACG-5' | (SEQ ID NO: 1934) |  |
| βc-3532 Target: | 5'-TCAAAAACATGAAATAGATCCACCTGC-3' | (SEQ ID NO: 3043) |  |
|  | 5'-GAUCAAAAACAUGAAAUAGAUCCACCU-3' | (SEQ ID NO: 7480) |  |
|  | 3'-CUAGUUUUUGUACUUUAUCUAGGUGGA-5' | (SEQ ID NO: 1935) |  |
| βc-3534 Target: | 5'-GATCAAAAACATGAAATAGATCCACCT-3' | (SEQ ID NO: 3044) |  |
|  | 5'-UGAUCAAAAACAUGAAAUAGAUCCACC-3' | (SEQ ID NO: 7481) |  |
|  | 3'-ACUAGUUUUUGUACUUUAUCUAGGUGG-5' | (SEQ ID NO: 1936) |  |
| βc-3535 Target: | 5'-TGATCAAAAACATGAAATAGATCCACC-3' | (SEQ ID NO: 3045) |  |
|  | 5'-UUGAUCAAAAACAUGAAAUAGAUCCAC-3' | (SEQ ID NO: 7482) |  |
|  | 3'-AACUAGUUUUUGUACUUUAUCUAGGUG-5' | (SEQ ID NO: 1937) |  |
| βc-3536 Target: | 5'-TTGATCAAAAACATGAAATAGATCCAC-3' | (SEQ ID NO: 3046) |  |
|  | 5'-AGUUUUUGAUCAAAAACAUGAAAUAGA-3' | (SEQ ID NO: 7483) |  |
|  | 3'-UCAAAAACUAGUUUUUGUACUUUAUCU-5' | (SEQ ID NO: 1938) |  |
| βc-3541 Target: | 5'-AGTTTTTGATCAAAAACATGAAATAGA-3' | (SEQ ID NO: 3047) |  |
|  | 5'-CCAAAUAGUUUUUGAUCAAAAACAUGA-3' | (SEQ ID NO: 7484) |  |
|  | 3'-GGUUUAUCAAAAACUAGUUUUUGUACU-5' | (SEQ ID NO: 1939) |  |
| βc-3547 Target: | 5'-CCAAATAGTTTTTGATCAAAAACATGA-3' | (SEQ ID NO: 3048) |  |
|  | 5'-UAUCCCAAAUAGUUUUUGAUCAAAAAC-3' | (SEQ ID NO: 7485) |  |
|  | 3'-AUAGGGUUUAUCAAAAACUAGUUUUUG-5' | (SEQ ID NO: 1940) |  |
| βc-3551 Target: | 5'-TATCCCAAATAGTTTTTGATCAAAAAC-3' | (SEQ ID NO: 3049) |  |
|  | 5'-AUAUCCCAAAUAGUUUUUGAUCAAAAA-3' | (SEQ ID NO: 7486) |  |
|  | 3'-UAUAGGGUUUAUCAAAAACUAGUUUUU-5' | (SEQ ID NO: 1941) |  |
| βc-3552 Target: | 5'-ATATCCCAAATAGTTTTTGATCAAAAA-3' | (SEQ ID NO: 3050) |  |
|  | 5'-CAUAUCCCAAAUAGUUUUUGAUCAAAA-3' | (SEQ ID NO: 7487) |  |
|  | 3'-GUAUAGGGUUUAUCAAAAACUAGUUUU-5' | (SEQ ID NO: 1942) |  |
| βc-3553 Target: | 5'-CATATCCCAAATAGTTTTTGATCAAAA-3' | (SEQ ID NO: 3051) |  |
|  | 5'-ACAUAUCCCAAAUAGUUUUUGAUCAAA-3' | (SEQ ID NO: 7488) |  |
|  | 3'-UGUAUAGGGUUUAUCAAAAACUAGUUU-5' | (SEQ ID NO: 1943) |  |
| βc-3554 Target: | 5'-ACATATCCCAAATAGTTTTTGATCAAA-3' | (SEQ ID NO: 3052) |  |
|  | 5'-CCAUACAUAUCCCAAAUAGUUUUUGAU-3' | (SEQ ID NO: 7489) |  |
|  | 3'-GGUAUGUAUAGGGUUUAUCAAAAACUA-5' | (SEQ ID NO: 1944) |  |
| βc-3558 Target: | 5'-CCATACATATCCCAAATAGTTTTTGAT-3' | (SEQ ID NO: 3053) |  |

TABLE 13-continued

Additional Selected Anti-β-catenin DsiRNAs, Blunt, Unfrayed Duplexes

|  |  |  |  |
|---|---|---|---|
| | 5'-UUACCCUACCCAUACAUAUCCCAAAUA-3' | (SEQ ID NO: 7490) |
| | 3'-AAUGGGAUGGGUAUGUAUAGGGUUUAU-5' | (SEQ ID NO: 1945) |
| βc-3567 Target: | 5'-TTACCCTACCCATACATATCCCAAATA-3' | (SEQ ID NO: 3054) |
| | 5'-UUUACCCUACCCAUACAUAUCCCAAAU-3' | (SEQ ID NO: 7491) |
| | 3'-AAAUGGGAUGGGUAUGUAUAGGGUUUA-5' | (SEQ ID NO: 1946) |
| βc-3568 Target: | 5'-TTTACCCTACCCATACATATCCCAAAT-3' | (SEQ ID NO: 3055) |
| | 5'-AUUUACCCUACCCAUACAUAUCCCAAA-3' | (SEQ ID NO: 7492) |
| | 3'-UAAAUGGGAUGGGUAUGUAUAGGGUUU-5' | (SEQ ID NO: 1947) |
| βc-3569 Target: | 5'-ATTTACCCTACCCATACATATCCCAAA-3' | (SEQ ID NO: 3056) |
| | 5'-ACACCUCUUACUGAUUUACCCUACCCA-3' | (SEQ ID NO: 7493) |
| | 3'-UGUGGAGAAUGACUAAAUGGGAUGGGU-5' | (SEQ ID NO: 1948) |
| βc-3582 Target: | 5'-ACACCTCTTACTGATTTACCCTACCCA-3' | (SEQ ID NO: 3057) |
| | 5'-UAACACCUCUUACUGAUUUACCCUACC-3' | (SEQ ID NO: 7494) |
| | 3'-AUUGUGGAGAAUGACUAAAUGGGAUGG-5' | (SEQ ID NO: 1949) |
| βc-3584 Target: | 5'-TAACACCTCTTACTGATTTACCCTACC-3' | (SEQ ID NO: 3058) |
| | 5'-AUAACACCUCUUACUGAUUUACCCUAC-3' | (SEQ ID NO: 7495) |
| | 3'-UAUUGUGGAGAAUGACUAAAUGGGAUG-5' | (SEQ ID NO: 1950) |
| βc-3585 Target: | 5'-ATAACACCTCTTACTGATTTACCCTAC-3' | (SEQ ID NO: 3059) |
| | 5'-AAUAACACCUCUUACUGAUUUACCCUA-3' | (SEQ ID NO: 7496) |
| | 3'-UUAUUGUGGAGAAUGACUAAAUGGGAU-5' | (SEQ ID NO: 1951) |
| βc-3586 Target: | 5'-AATAACACCTCTTACTGATTTACCCTA-3' | (SEQ ID NO: 3060) |
| | 5'-AAAUAACACCUCUUACUGAUUUACCCU-3' | (SEQ ID NO: 7497) |
| | 3'-UUUAUUGUGGAGAAUGACUAAAUGGGA-5' | (SEQ ID NO: 1952) |
| βc-3587 Target: | 5'-AAATAACACCTCTTACTGATTTACCCT-3' | (SEQ ID NO: 3061) |
| | 5'-CAAAUAACACCUCUUACUGAUUUACCC-3' | (SEQ ID NO: 7498) |
| | 3'-GUUUAUUGUGGAGAAUGACUAAAUGGG-5' | (SEQ ID NO: 1953) |
| βc-3588 Target: | 5'-CAAATAACACCTCTTACTGATTTACCC-3' | (SEQ ID NO: 3062) |
| | 5'-AGGUUCCAAAUAACACCUCUUACUGAU-3' | (SEQ ID NO: 7499) |
| | 3'-UCCAAGGUUUAUUGUGGAGAAUGACUA-5' | (SEQ ID NO: 1954) |
| βc-3594 Target: | 5'-AGGTTCCAAATAACACCTCTTACTGAT-3' | (SEQ ID NO: 3063) |
| | 5'-AAAACAAGGUUCCAAAUAACACCUCUU-3' | (SEQ ID NO: 7500) |
| | 3'-UUUUGUUCCAAGGUUUAUUGUGGAGAA-5' | (SEQ ID NO: 1955) |
| βc-3600 Target: | 5'-AAAACAAGGTTCCAAATAACACCTCTT-3' | (SEQ ID NO: 3064) |
| | 5'-CAAAACAAGGUUCCAAAUAACACCUCU-3' | (SEQ ID NO: 7501) |
| | 3'-GUUUUGUUCCAAGGUUUAUUGUGGAGA-5' | (SEQ ID NO: 1956) |
| βc-3601 Target: | 5'-CAAAACAAGGTTCCAAATAACACCTCT-3' | (SEQ ID NO: 3065) |
| | 5'-CCAAAACAAGGUUCCAAAUAACACCUC-3' | (SEQ ID NO: 7502) |
| | 3'-GGUUUUGUUCCAAGGUUUAUUGUGGAG-5' | (SEQ ID NO: 1957) |
| βc-3602 Target: | 5'-CCAAAACAAGGTTCCAAATAACACCTC-3' | (SEQ ID NO: 3066) |

TABLE 13-continued

Additional Selected Anti-β-catenin DsiRNAs, Blunt, Unfrayed Duplexes

|  |  |  |  |
|---|---|---|---|
|  | 5'-ACUGUCCAAAACAAGGUUCCAAAUAAC-3' | (SEQ ID NO: 7503) |
|  | 3'-UGACAGGUUUUGUUCCAAGGUUUAUUG-5' | (SEQ ID NO: 1958) |
| βc-3607 Target: | 5'-ACTGTCCAAAACAAGGTTCCAAATAAC-3' | (SEQ ID NO: 3067) |
|  | 5'-GUAAACUGUCCAAAACAAGGUUCCAAA-3' | (SEQ ID NO: 7504) |
|  | 3'-CAUUUGACAGGUUUUGUUCCAAGGUUU-5' | (SEQ ID NO: 1959) |
| βc-3611 Target: | 5'-GTAAACTGTCCAAAACAAGGTTCCAAA-3' | (SEQ ID NO: 3068) |
|  | 5'-GGUAAACUGUCCAAAACAAGGUUCCAA-3' | (SEQ ID NO: 7505) |
|  | 3'-CCAUUUGACAGGUUUUGUUCCAAGGUU-5' | (SEQ ID NO: 1960) |
| βc-3612 Target: | 5'-GGTAAACTGTCCAAAACAAGGTTCCAA-3' | (SEQ ID NO: 3069) |
|  | 5'-AGGCAACUGGUAAACUGUCCAAAACAA-3' | (SEQ ID NO: 7506) |
|  | 3'-UCCGUUGACCAUUUGACAGGUUUUGUU-5' | (SEQ ID NO: 1961) |
| βc-3620 Target: | 5'-AGGCAACTGGTAAACTGTCCAAAACAA-3' | (SEQ ID NO: 3070) |
|  | 5'-GGGAUAAAAGGCAACUGGUAAACUGUC-3' | (SEQ ID NO: 7507) |
|  | 3'-CCCUAUUUUCCGUUGACCAUUUGACAG-5' | (SEQ ID NO: 1962) |
| βc-3628 Target: | 5'-GGGATAAAAGGCAACTGGTAAACTGTC-3' | (SEQ ID NO: 3071) |
|  | 5'-UGGGAUAAAAGGCAACUGGUAAACUGU-3' | (SEQ ID NO: 7508) |
|  | 3'-ACCCUAUUUUCCGUUGACCAUUUGACA-5' | (SEQ ID NO: 1963) |
| βc-3629 Target: | 5'-TGGGATAAAAGGCAACTGGTAAACTGT-3' | (SEQ ID NO: 3072) |
|  | 5'-ACAACUUUGGGAUAAAAGGCAACUGGU-3' | (SEQ ID NO: 7509) |
|  | 3'-UGUUGAAACCCUAUUUUCCGUUGACCA-5' | (SEQ ID NO: 1964) |
| βc-3636 Target: | 5'-ACAACTTTGGGATAAAAGGCAACTGGT-3' | (SEQ ID NO: 3073) |
|  | 5'-CAACAACUUUGGGAUAAAAGGCAACUG-3' | (SEQ ID NO: 7510) |
|  | 3'-GUUGUUGAAACCCUAUUUUCCGUUGAC-5' | (SEQ ID NO: 1965) |
| βc-3638 Target: | 5'-CAACAACTTTGGGATAAAAGGCAACTG-3' | (SEQ ID NO: 3074) |
|  | 5'-GGUUACAACAACUUUGGGAUAAAAGGC-3' | (SEQ ID NO: 7511) |
|  | 3'-CCAAUGUUGUUGAAACCCUAUUUUCCG-5' | (SEQ ID NO: 1966) |
| βc-3643 Target: | 5'-GGTTACAACAACTTTGGGATAAAAGGC-3' | (SEQ ID NO: 3075) |
|  | 5'-AGGUUACAACAACUUUGGGAUAAAAGG-3' | (SEQ ID NO: 7512) |
|  | 3'-UCCAAUGUUGUUGAAACCCUAUUUUCC-5' | (SEQ ID NO: 1967) |
| βc-3644 Target: | 5'-AGGTTACAACAACTTTGGGATAAAAGG-3' | (SEQ ID NO: 3076) |
|  | 5'-CAGGUUACAACAACUUUGGGAUAAAAG-3' | (SEQ ID NO: 7513) |
|  | 3'-GUCCAAUGUUGUUGAAACCCUAUUUUC-5' | (SEQ ID NO: 1968) |
| βc-3645 Target: | 5'-CAGGTTACAACAACTTTGGGATAAAAG-3' | (SEQ ID NO: 3077) |
|  | 5'-UAUCACAGCAGGUUACAACAACUUUGG-3' | (SEQ ID NO: 7514) |
|  | 3'-AUAGUGUCGUCCAAUGUUGUUGAAACC-5' | (SEQ ID NO: 1969) |
| βc-3653 Target: | 5'-TATCACAGCAGGTTACAACAACTTTGG-3' | (SEQ ID NO: 3078) |
|  | 5'-GUAUCACAGCAGGUUACAACAACUUUG-3' | (SEQ ID NO: 7515) |
|  | 3'-CAUAGUGUCGUCCAAUGUUGUUGAAAC-5' | (SEQ ID NO: 1970) |
| βc-3654 Target: | 5'-GTATCACAGCAGGTTACAACAACTTTG-3' | (SEQ ID NO: 3079) |

TABLE 13-continued

Additional Selected Anti-β-catenin DsiRNAs, Blunt, Unfrayed Duplexes

|  |  |  |
|---|---|---|
|  | 5'-UCGUAUCACAGCAGGUUACAACAACUU-3' | (SEQ ID NO: 7516) |
|  | 3'-AGCAUAGUGUCGUCCAAUGUUGUUGAA-5' | (SEQ ID NO: 1971) |
| βc-3656 Target: | 5'-TCGTATCACAGCAGGTTACAACAACTT-3' | (SEQ ID NO: 3080) |
|  | 5'-UUUCUCUUGAAGCAUCGUAUCACAGCA-3' | (SEQ ID NO: 7517) |
|  | 3'-AAAGAGAACUUCGUAGCAUAGUGUCGU-5' | (SEQ ID NO: 1972) |
| βc-3670 Target: | 5'-TTTCTCTTGAAGCATCGTATCACAGCA-3' | (SEQ ID NO: 3081) |
|  | 5'-UUUUCUCUUGAAGCAUCGUAUCACAGC-3' | (SEQ ID NO: 7518) |
|  | 3'-AAAAGAGAACUUCGUAGCAUAGUGUCG-5' | (SEQ ID NO: 1973) |
| βc-3671 Target: | 5'-TTTTCTCTTGAAGCATCGTATCACAGC-3' | (SEQ ID NO: 3082) |
|  | 5'-CAUUUCUCUUGAAGCAUCGUAUCACA-3' | (SEQ ID NO: 7519) |
|  | 3'-GUAAAGAGAACUUCGUAGCAUAGUGU-5' | (SEQ ID NO: 1974) |
| βc-3673 Target: | 5'-CATTTCTCTTGAAGCATCGTATCACA-3' | (SEQ ID NO: 3083) |
|  | 5'-UUUUUUAUAACCGCAUUUUCUCUUGAA-3' | (SEQ ID NO: 7520) |
|  | 3'-AAAAAAUAUUGGCGUAAAAGAGAACUU-5' | (SEQ ID NO: 1975) |
| βc-3686 Target: | 5'-TTTTTTATAACCGCATTTTCTCTTGAA-3' | (SEQ ID NO: 3084) |
|  | 5'-AUUUUUUAUAACCGCAUUUUCUCUUGA-3' | (SEQ ID NO: 7521) |
|  | 3'-UAAAAAAUAUUGGCGUAAAAGAGAACU-5' | (SEQ ID NO: 1976) |
| βc-3687 Target: | 5'-ATTTTTTATAACCGCATTTTCTCTTGA-3' | (SEQ ID NO: 3085) |
|  | 5'-CAUUUUUUAUAACCGCAUUUUCUCUUG-3' | (SEQ ID NO: 7522) |
|  | 3'-GUAAAAAAUAUUGGCGUAAAAGAGAAC-5' | (SEQ ID NO: 1977) |
| βc-3688 Target: | 5'-CATTTTTTATAACCGCATTTTCTCTTG-3' | (SEQ ID NO: 3086) |
|  | 5'-CCAUUUUUUAUAACCGCAUUUUCUCUU-3' | (SEQ ID NO: 7523) |
|  | 3'-GGUAAAAAAUAUUGGCGUAAAAGAGAA-5' | (SEQ ID NO: 1978) |
| βc-3689 Target: | 5'-CCATTTTTTATAACCGCATTTTCTCTT-3' | (SEQ ID NO: 3087) |
|  | 5'-CUGAACCAUUUUUUAUAACCGCAUUUU-3' | (SEQ ID NO: 7524) |
|  | 3'-GACUUGGUAAAAAAUAUUGGCGUAAAA-5' | (SEQ ID NO: 1979) |
| βc-3694 Target: | 5'-CTGAACCATTTTTTATAACCGCATTTT-3' | (SEQ ID NO: 3088) |
|  | 5'-UAAUUCUGAACCAUUUUUUAUAACCGC-3' | (SEQ ID NO: 7525) |
|  | 3'-AUUAAGACUUGGUAAAAAAUAUUGGCG-5' | (SEQ ID NO: 1980) |
| βc-3699 Target: | 5'-TAATTCTGAACCATTTTTTATAACCGC-3' | (SEQ ID NO: 3089) |
|  | 5'-UUAAUUCUGAACCAUUUUUUAUAACCG-3' | (SEQ ID NO: 7526) |
|  | 3'-AAUUAAGACUUGGUAAAAAAUAUUGGC-5' | (SEQ ID NO: 1981) |
| βc-3700 Target: | 5'-TTAATTCTGAACCATTTTTTATAACCG-3' | (SEQ ID NO: 3090) |
|  | 5'-UUUAAUUCUGAACCAUUUUUUAUAACC-3' | (SEQ ID NO: 7527) |
|  | 3'-AAAUUAAGACUUGGUAAAAAAUAUUGG-5' | (SEQ ID NO: 1982) |
| βc-3701 Target: | 5'-TTTAATTCTGAACCATTTTTTATAACC-3' | (SEQ ID NO: 3091) |
|  | 5'-GUUUAAUUCUGAACCAUUUUUUAUAAC-3' | (SEQ ID NO: 7528) |
|  | 3'-CAAAUUAAGACUUGGUAAAAAAUAUUG-5' | (SEQ ID NO: 1983) |
| βc-3702 Target: | 5'-GTTTAATTCTGAACCATTTTTTATAAC-3' | (SEQ ID NO: 3092) |

TABLE 13-continued

Additional Selected Anti-β-catenin DsiRNAs, Blunt, Unfrayed Duplexes

|  |  |  |  |
|---|---|---|---|
|  | 5'-AGUUUAAUUCUGAACCAUUUUUAUAA-3' | (SEQ ID NO: 7529) |  |
|  | 3'-UCAAAUUAAGACUUGGUAAAAAAUAUU-5' | (SEQ ID NO: 1984) |  |
| βc-3703 Target: | 5'-AGTTTAATTCTGAACCATTTTTATAA-3' | (SEQ ID NO: 3093) |  |
|  | 5'-AAGUUUAAUUCUGAACCAUUUUUAUA-3' | (SEQ ID NO: 7530) |  |
|  | 3'-UUCAAAUUAAGACUUGGUAAAAAAUAU-5' | (SEQ ID NO: 1985) |  |
| βc-3704 Target: | 5'-AAGTTTAATTCTGAACCATTTTTATA-3' | (SEQ ID NO: 3094) |  |
|  | 5'-AUUAAAAGUUUAAUUCUGAACCAUUUU-3' | (SEQ ID NO: 7531) |  |
|  | 3'-UAAUUUUCAAAUUAAGACUUGGUAAAA-5' | (SEQ ID NO: 1986) |  |
| βc-3709 Target: | 5'-ATTAAAAGTTTAATTCTGAACCATTTT-3' | (SEQ ID NO: 3095) |  |
|  | 5'-AAUUAAAAGUUUAAUUCUGAACCAUUU-3' | (SEQ ID NO: 7532) |  |
|  | 3'-UUAAUUUUCAAAUUAAGACUUGGUAAA-5' | (SEQ ID NO: 1987) |  |
| βc-3710 Target: | 5'-AATTAAAAGTTTAATTCTGAACCATTT-3' | (SEQ ID NO: 3096) |  |
|  | 5'-UGAAUUAAAAGUUUAAUUCUGAACCAU-3' | (SEQ ID NO: 7533) |  |
|  | 3'-ACUUAAUUUUCAAAUUAAGACUUGGUA-5' | (SEQ ID NO: 1988) |  |
| βc-3712 Target: | 5'-TGAATTAAAAGTTTAATTCTGAACC-3' | (SEQ ID NO: 3097) |  |
|  | 5'-CAAUACAGCUAAAGGAUGAUUUACAGG-3' | (SEQ ID NO: 7534) |  |
|  | 3'-GUUAUGUCGAUUUCCUACUAAAUGUCC-5' | (SEQ ID NO: 1989) |  |
| βc-2634t2 Target: | 5'-CAATACAGCTAAAGGATGATTTACAGG-3' | (SEQ ID NO: 3098) |  |
|  | 5'-ACAAUACAGCUAAAGGAUGAUUUACAG-3' | (SEQ ID NO: 7535) |  |
|  | 3'-UGUUAUGUCGAUUUCCUACUAAAUGUC-5' | (SEQ ID NO: 1990) |  |
| βc-2635t2 Target: | 5'-ACAATACAGCTAAAGGATGATTTACAG-3' | (SEQ ID NO: 3099) |  |
|  | 5'-AGACAAUACAGCUAAAGGAUGAUUUAC-3' | (SEQ ID NO: 7536) |  |
|  | 3'-UCUGUUAUGUCGAUUUCCUACUAAAUG-5' | (SEQ ID NO: 1991) |  |
| βc-2637t2 Target: | 5'-AGACAATACAGCTAAAGGATGATTTAC-3' | (SEQ ID NO: 3100) |  |
|  | 5'-GUUACUCCUAAAGGAUGAUUUACAGGU-3' | (SEQ ID NO: 7537) |  |
|  | 3'-CAAUGAGGAUUUCCUACUAAAUGUCCA-5' | (SEQ ID NO: 1992) |  |
| βc-2633t3 Target: | 5'-GTTACTCCTAAAGGATGATTTACAGGT-3' | (SEQ ID NO: 3101) |  |
|  | 5'-UGUUACUCCUAAAGGAUGAUUUACAGG-3' | (SEQ ID NO: 7538) |  |
|  | 3'-ACAAUGAGGAUUUCCUACUAAAUGUCC-5' | (SEQ ID NO: 1993) |  |
| βc-2634t3 Target: | 5'-TGTTACTCCTAAAGGATGATTTACAGG-3' | (SEQ ID NO: 3102) |  |
|  | 5'-UUGUUACUCCUAAAGGAUGAUUUACAG-3' | (SEQ ID NO: 7539) |  |
|  | 3'-AACAAUGAGGAUUUCCUACUAAAUGUC-5' | (SEQ ID NO: 1994) |  |
| βc-2635t3 Target: | 5'-TTGTTACTCCTAAAGGATGATTTACAG-3' | (SEQ ID NO: 3103) |  |
|  | 5'-AUUGUUACUCCUAAAGGAUGAUUUACA-3' | (SEQ ID NO: 7540) |  |
|  | 3'-UAACAAUGAGGAUUUCCUACUAAAUGU-5' | (SEQ ID NO: 1995) |  |
| βc-2636t3 Target: | 5'-ATTGTTACTCCTAAAGGATGATTTACA-3' | (SEQ ID NO: 3104) |  |
|  | 5'-GGAUUCCAGAAUCCAAGUAAGACUGCU-3' | (SEQ ID NO: 7541) |  |
|  | 3'-CCUAAGGUCUUAGGUUCAUUCUGACGA-5' | (SEQ ID NO: 1996) |  |
| βc-m318 Target: | 5'-GGATTCCAGAATCCAAGTAAGACTGCT-3' | (SEQ ID NO: 3105) |  |

TABLE 13-continued

Additional Selected Anti-β-catenin DsiRNAs, Blunt, Unfrayed Duplexes

|  |  |  |
|---|---|---|
|  | 5'-CUUGCUCCCAUUCAUAAAGGACUUGGG-3' | (SEQ ID NO: 7542) |
|  | 3'-GAACGAGGGUAAGUAUUUCCUGAACCC-5' | (SEQ ID NO: 1997) |
| βc-m417 Target: | 5'-CTTGCTCCCATTCATAAAGGACTTGGG-3' | (SEQ ID NO: 3106) |
|  | 5'-CGUCAAUAUCAGCUACUUGCUCUUGCG-3' | (SEQ ID NO: 7543) |
|  | 3'-GCAGUUAUAGUCGAUGAACGAGAACGC-5' | (SEQ ID NO: 1998) |
| βc-m462 Target: | 5'-CGTCAATATCAGCTACTTGCTCTTGCG-3' | (SEQ ID NO: 3107) |
|  | 5'-CCGUCAAUAUCAGCUACUUGCUCUUGC-3' | (SEQ ID NO: 7544) |
|  | 3'-GGCAGUUAUAGUCGAUGAACGAGAACG-5' | (SEQ ID NO: 1999) |
| βc-m463 Target: | 5'-CCGTCAATATCAGCTACTTGCTCTTGC-3' | (SEQ ID NO: 3108) |
|  | 5'-ACUGCCCGUCAAUAUCAGCUACUUGCU-3' | (SEQ ID NO: 7545) |
|  | 3'-UGACGGGCAGUUAUAGUCGAUGAACGA-5' | (SEQ ID NO: 2000) |
| βc-m468 Target: | 5'-ACTGCCCGTCAATATCAGCTACTTGCT-3' | (SEQ ID NO: 3109) |
|  | 5'-UGUUUCAACAUCUGUGAUGGUUCAGCC-3' | (SEQ ID NO: 7546) |
|  | 3'-ACAAAGUUGUAGACACUACCAAGUCGG-5' | (SEQ ID NO: 2001) |
| βc-m613 Target: | 5'-TGTTTCAACATCTGTGATGGTTCAGCC-3' | (SEQ ID NO: 3110) |
|  | 5'-AUGUUUCAACAUCUGUGAUGGUUCAGC-3' | (SEQ ID NO: 7547) |
|  | 3'-UACAAAGUUGUAGACACUACCAAGUCG-5' | (SEQ ID NO: 2002) |
| βc-m614 Target: | 5'-ATGTTTCAACATCTGTGATGGTTCAGC-3' | (SEQ ID NO: 3111) |
|  | 5'-UGACAACUGCAUGUUUCAACAUCUGUG-3' | (SEQ ID NO: 7548) |
|  | 3'-ACUGUUGACGUACAAAGUUGUAGACAC-5' | (SEQ ID NO: 2003) |
| βc-m624 Target: | 5'-TGACAACTGCATGTTTCAACATCTGTG-3' | (SEQ ID NO: 3112) |
|  | 5'-AUUGACAACUGCAUGUUUCAACAUCUG-3' | (SEQ ID NO: 7549) |
|  | 3'-UAACUGUUGACGUACAAAGUUGUAGAC-5' | (SEQ ID NO: 2004) |
| βc-m626 Target: | 5'-ATTGACAACTGCATGTTTCAACATCTG-3' | (SEQ ID NO: 3113) |
|  | 5'-UCAAAUUGACAACUGCAUGUUUCAACA-3' | (SEQ ID NO: 7550) |
|  | 3'-AGUUUAACUGUUGACGUACAAAGUUGU-5' | (SEQ ID NO: 2005) |
| βc-m630 Target: | 5'-TCAAATTGACAACTGCATGTTTCAACA-3' | (SEQ ID NO: 3114) |
|  | 5'-AGUUAAUCAAAUUGACAACUGCAUGUU-3' | (SEQ ID NO: 7551) |
|  | 3'-UCAAUUAGUUUAACUGUUGACGUACAA-5' | (SEQ ID NO: 2006) |
| βc-m636 Target: | 5'-AGTTAATCAAATTGACAACTGCATGTT-3' | (SEQ ID NO: 3115) |
|  | 5'-CCUGAUAGUUAAUCAAAUUGACAACUG-3' | (SEQ ID NO: 7552) |
|  | 3'-GGACUAUCAAUUAGUUUAACUGUUGAC-5' | (SEQ ID NO: 2007) |
| βc-m642 Target: | 5'-CCTGATAGTTAATCAAATTGACAACTG-3' | (SEQ ID NO: 3116) |
|  | 5'-CGUCAUCCUGAUAGUUAAUCAAAUUGA-3' | (SEQ ID NO: 7553) |
|  | 3'-GCAGUAGGACUAUCAAUUAGUUUAACU-5' | (SEQ ID NO: 2008) |
| βc-m648 Target: | 5'-CGTCATCCTGATAGTTAATCAAATTGA-3' | (SEQ ID NO: 3117) |
|  | 5'-GCGUCAUCCUGAUAGUUAAUCAAAUUG-3' | (SEQ ID NO: 7554) |
|  | 3'-CGCAGUAGGACUAUCAAUUAGUUUAAC-5' | (SEQ ID NO: 2009) |
| βc-m649 Target: | 5'-GCGTCATCCTGATAGTTAATCAAATTG-3' | (SEQ ID NO: 3118) |

TABLE 13-continued

Additional Selected Anti-β-catenin DsiRNAs, Blunt, Unfrayed Duplexes

|  |  |  |
|---|---|---|
|  | 5'-CCUCAUCGUUUAGCAGUUUUGUCAGCU-3' | (SEQ ID NO: 7555) |
|  | 3'-GGAGUAGCAAAUCGUCAAAACAGUCGA-5' | (SEQ ID NO: 2010) |
| βc-m702 Target: | 5'-CCTCATCGTTTAGCAGTTTTGTCAGCT-3' | (SEQ ID NO: 3119) |
|  | 5'-CUGGUCCUCAUCGUUUAGCAGUUUUGU-3' | (SEQ ID NO: 7556) |
|  | 3'-GACCAGGAGUAGCAAAUCGUCAAAACA-5' | (SEQ ID NO: 2011) |
| βc-m707 Target: | 5'-CTGGTCCTCATCGTTTAGCAGTTTTGT-3' | (SEQ ID NO: 3120) |
|  | 5'-CAUAACAGCAGCUUUAUUAACUACCAC-3' | (SEQ ID NO: 7557) |
|  | 3'-GUAUUGUCGUCGAAAUAAUUGAUGGUG-5' | (SEQ ID NO: 2012) |
| βc-m734 Target: | 5'-CATAACAGCAGCTTTATTAACTACCAC-3' | (SEQ ID NO: 3121) |
|  | 5'-CCAUAACAGCAGCUUUAUUAACUACCA-3' | (SEQ ID NO: 7558) |
|  | 3'-GGUAUUGUCGUCGAAAUAAUUGAUGGU-5' | (SEQ ID NO: 2013) |
| βc-m735 Target: | 5'-CCATAACAGCAGCTTTATTAACTACCA-3' | (SEQ ID NO: 3122) |
|  | 5'-GGACCAUAACAGCAGCUUUAUUAACUA-3' | (SEQ ID NO: 7559) |
|  | 3'-CCUGGUAUUGUCGUCGAAAUAAUUGAU-5' | (SEQ ID NO: 2014) |
| βc-m738 Target: | 5'-GGACCATAACAGCAGCTTTATTAACTA-3' | (SEQ ID NO: 3123) |
|  | 5'-UGGACCAUAACAGCAGCUUUAUUAACU-3' | (SEQ ID NO: 7560) |
|  | 3'-ACCUGGUAUUGUCGUCGAAAUAAUUGA-5' | (SEQ ID NO: 2015) |
| βc-m739 Target: | 5'-TGGACCATAACAGCAGCTTTATTAACT-3' | (SEQ ID NO: 3124) |
|  | 5'-CUGUCUCUACAUCAUUUGUAUUCUGCA-3' | (SEQ ID NO: 7561) |
|  | 3'-GACAGAGAUGUAGUAAACAUAAGACGU-5' | (SEQ ID NO: 2016) |
| βc-m843 Target: | 5'-CTGTCTCTACATCATTTGTATTCTGCA-3' | (SEQ ID NO: 3125) |
|  | 5'-GCUGUCUCUACAUCAUUUGUAUUCUGC-3' | (SEQ ID NO: 7562) |
|  | 3'-CGACAGAGAUGUAGUAAACAUAAGACG-5' | (SEQ ID NO: 2017) |
| βc-m844 Target: | 5'-GCTGTCTCTACATCATTTGTATTCTGC-3' | (SEQ ID NO: 3126) |
|  | 5'-GCAACCAUUUUCUGCAGUCCACCAGCU-3' | (SEQ ID NO: 7563) |
|  | 3'-CGUUGGUAAAAGACGUCAGGUGGUCGA-5' | (SEQ ID NO: 2018) |
| βc-m1063 Target: | 5'-GCAACCATTTTCTGCAGTCCACCAGCT-3' | (SEQ ID NO: 3127) |
|  | 5'-AAGCAACCAUUUUCUGCAGUCCACCAG-3' | (SEQ ID NO: 7564) |
|  | 3'-UUCGUUGGUAAAAGACGUCAGGUGGUC-5' | (SEQ ID NO: 2019) |
| βc-m1065 Target: | 5'-AAGCAACCATTTTCTGCAGTCCACCAG-3' | (SEQ ID NO: 3128) |
|  | 5'-UUGUUUUGUUGAGCAAAGCAACCAUUU-3' | (SEQ ID NO: 7565) |
|  | 3'-AACAAAACAACUCGUUUCGUUGGUAAA-5' | (SEQ ID NO: 2020) |
| βc-m1080 Target: | 5'-TTGTTTTGTTGAGCAAAGCAACCATTT-3' | (SEQ ID NO: 3129) |
|  | 5'-UUUGUUUUGUUGAGCAAAGCAACCAUU-3' | (SEQ ID NO: 7566) |
|  | 3'-AAACAAAACAACUCGUUUCGUUGGUAA-5' | (SEQ ID NO: 2021) |
| βc-m1081 Target: | 5'-TTTGTTTTGTTGAGCAAAGCAACCATT-3' | (SEQ ID NO: 3130) |
|  | 5'-UAGCCAAGAAUUUCACGUUUGUUUUGU-3' | (SEQ ID NO: 7567) |
|  | 3'-AUCGGUUCUUAAAGUGCAAACAAAACA-5' | (SEQ ID NO: 2022) |
| βc-m1098 Target: | 5'-TAGCCAAGAATTTCACGTTTGTTTTGT-3' | (SEQ ID NO: 3131) |

TABLE 13-continued

Additional Selected Anti-β-catenin DsiRNAs, Blunt, Unfrayed Duplexes

|  |  |  |  |
|---|---|---|---|
|  | 5'-CUUGAUUGCCAUAAGCUAAGAUCUGAA-3' | (SEQ ID NO: 7568) |
|  | 3'-GAACUAACGGUAUUCGAUUCUAGACUU-5' | (SEQ ID NO: 2023) |
| βc-m1140 Target: | 5'-CTTGATTGCCATAAGCTAAGATCTGAA-3' | (SEQ ID NO: 3132) |
|  | 5'-GCUCUCUUGAUUGCCAUAAGCUAAGAU-3' | (SEQ ID NO: 7569) |
|  | 3'-CGAGAGAACUAACGGUAUUCGAUUCUA-5' | (SEQ ID NO: 2024) |
| βc-m1145 Target: | 5'-GCTCTCTTGATTGCCATAAGCTAAGAT-3' | (SEQ ID NO: 3133) |
|  | 5'-CUUCUCAUAAGUGUAGGUCCUCAUUAU-3' | (SEQ ID NO: 7570) |
|  | 3'-GAAGAGUAUUCACAUCCAGGAGUAAUA-5' | (SEQ ID NO: 2025) |
| βc-m1217 Target: | 5'-CTTCTCATAAGTGTAGGTCCTCATTAT-3' | (SEQ ID NO: 3134) |
|  | 5'-GCUUCUCAUAAGUGUAGGUCCUCAUUA-3' | (SEQ ID NO: 7571) |
|  | 3'-CGAAGAGUAUUCACAUCCAGGAGUAAU-5' | (SEQ ID NO: 2026) |
| βc-m1218 Target: | 5'-GCTTCTCATAAGTGTAGGTCCTCATTA-3' | (SEQ ID NO: 3135) |
|  | 5'-AAGCUUCUCAUAAGUGUAGGUCCUCAU-3' | (SEQ ID NO: 7572) |
|  | 3'-UUCGAAGAGUAUUCACAUCCAGGAGUA-5' | (SEQ ID NO: 2027) |
| βc-m1220 Target: | 5'-AAGCTTCTCATAAGTGTAGGTCCTC-3' | (SEQ ID NO: 3136) |
|  | 5'-GAAGCUUCUCAUAAGUGUAGGUCCUCA-3' | (SEQ ID NO: 7573) |
|  | 3'-CUUCGAAGAGUAUUCACAUCCAGGAGU-5' | (SEQ ID NO: 2028) |
| βc-m1221 Target: | 5'-GAAGCTTCTCATAAGTGTAGGTCCTCA-3' | (SEQ ID NO: 3137) |
|  | 5'-GAGUCCAAAGACAGUUUUGAACAAGUC-3' | (SEQ ID NO: 7574) |
|  | 3'-CUCAGGUUUCUGUCAAAACUUGUUCAG-5' | (SEQ ID NO: 2029) |
| βc-m1365 Target: | 5'-GAGTCCAAAGACAGTTTTGAACAAGTC-3' | (SEQ ID NO: 3138) |
|  | 5'-AGAGUCCAAAGACAGUUUUGAACAAGU-3' | (SEQ ID NO: 7575) |
|  | 3'-UCUCAGGUUUCUGUCAAAACUUGUUCA-5' | (SEQ ID NO: 2030) |
| βc-m1366 Target: | 5'-AGAGTCCAAAGACAGTTTTGAACAAGT-3' | (SEQ ID NO: 3139) |
|  | 5'-CCACAUUUAUAUCAUCGGAACCCAGAA-3' | (SEQ ID NO: 7576) |
|  | 3'-GGUGUAAAUAUAGUAGCCUUGGGUCUU-5' | (SEQ ID NO: 2031) |
| βc-m1461 Target: | 5'-CCACATTTATATCATCGGAACCCAGAA-3' | (SEQ ID NO: 3140) |
|  | 5'-UGACCACAUUUAUAUCAUCGGAACCCA-3' | (SEQ ID NO: 7577) |
|  | 3'-ACUGGUGUAAAUAUAGUAGCCUUGGGU-5' | (SEQ ID NO: 2032) |
| βc-m1464 Target: | 5'-TGACCACATTTATATCATCGGAACCCA-3' | (SEQ ID NO: 3141) |
|  | 5'-CUGCACAGGUGACCACAUUUAUAUCAU-3' | (SEQ ID NO: 7578) |
|  | 3'-GACGUGUCCACUGGUGUAAAUAUAGUA-5' | (SEQ ID NO: 2033) |
| βc-m1473 Target: | 5'-CTGCACAGGTGACCACATTTATATC-3' | (SEQ ID NO: 3142) |
|  | 5'-GCUGCACAGGUGACCACAUUUAUAUCA-3' | (SEQ ID NO: 7579) |
|  | 3'-CGACGUGUCCACUGGUGUAAAUAUAGU-5' | (SEQ ID NO: 2034) |
| βc-m1474 Target: | 5'-GCTGCACAGGTGACCACATTTATATCA-3' | (SEQ ID NO: 3143) |
|  | 5'-UUGUAAUUAUUGCAAGUGAGGUUAGAG-3' | (SEQ ID NO: 7580) |
|  | 3'-AACAUUAAUAACGUUCACUCCAAUCUC-5' | (SEQ ID NO: 2035) |
| βc-m1510 Target: | 5'-TTGTAATTATTGCAAGTGAGGTTAGAG-3' | (SEQ ID NO: 3144) |

TABLE 13-continued

Additional Selected Anti-β-catenin DsiRNAs, Blunt, Unfrayed Duplexes

|  |  |  |  |
|---|---|---|---|
|  | 5'-CAUCAUCUUGUUUUUGUAAUUAUUGCA-3' | (SEQ ID NO: 7581) |
|  | 3'-GUAGUAGAACAAAAACAUUAAUAACGU-5' | (SEQ ID NO: 2036) |
| βc-m1523 Target: | 5'-CATCATCTTGTTTTTGTAATTATTGCA-3' | (SEQ ID NO: 3145) |
|  | 5'-CCAUCAUCUUGUUUUUGUAAUUAUUGC-3' | (SEQ ID NO: 7582) |
|  | 3'-GGUAGUAGAACAAAAACAUUAAUAACG-5' | (SEQ ID NO: 2037) |
| βc-m1524 Target: | 5'-CCATCATCTTGTTTTTGTAATTATTGC-3' | (SEQ ID NO: 3146) |
|  | 5'-ACACCAUCAUCUUGUUUUUGUAAUUAU-3' | (SEQ ID NO: 7583) |
|  | 3'-UGUGGUAGUAGAACAAAAACAUUAAUA-5' | (SEQ ID NO: 2038) |
| βc-m1527 Target: | 5'-ACACCATCATCTTGTTTTTGTAATTAT-3' | (SEQ ID NO: 3147) |
|  | 5'-UUGGCACACCAUCAUCUUGUUUUUGUA-3' | (SEQ ID NO: 7584) |
|  | 3'-AACCGUGUGGUAGUAGAACAAAAACAU-5' | (SEQ ID NO: 2039) |
| βc-m1532 Target: | 5'-TTGGCACACCATCATCTTGTTTTTGTA-3' | (SEQ ID NO: 3148) |
|  | 5'-UCAAUCCAACAGUUGCCUUUAUCAGAG-3' | (SEQ ID NO: 7585) |
|  | 3'-AGUUAGGUUGUCAACGGAAAUAGUCUC-5' | (SEQ ID NO: 2040) |
| βc-m1752 Target: | 5'-TCAATCCAACAGTTGCCTTTATCAGAG-3' | (SEQ ID NO: 3149) |
|  | 5'-UCGAAUCAAUCCAACAGUUGCCUUUAU-3' | (SEQ ID NO: 7586) |
|  | 3'-AGCUUAGUUAGGUUGUCAACGGAAAUA-5' | (SEQ ID NO: 2041) |
| βc-m1757 Target: | 5'-TCGAATCAATCCAACAGTTGCCTTTAT-3' | (SEQ ID NO: 3150) |
|  | 5'-GCUGAACUAGUCGUGGAAUAGCACCCU-3' | (SEQ ID NO: 7587) |
|  | 3'-CGACUUGAUCAGCACCUUAUCGUGGGA-5' | (SEQ ID NO: 2042) |
| βc-m1827 Target: | 5'-GCTGAACTAGTCGTGGAATAGCACCCT-3' | (SEQ ID NO: 3151) |
|  | 5'-AGUACACCCUUCUACUAUCUCCUCCAU-3' | (SEQ ID NO: 7588) |
|  | 3'-UCAUGUGGGAAGAUGAUAGAGGAGGUA-5' | (SEQ ID NO: 2043) |
| βc-m1934 Target: | 5'-AGTACACCCTTCTACTATCTCCTCC-3' | (SEQ ID NO: 3152) |
|  | 5'-CAGUACACCCUUCUACUAUCUCCUCCA-3' | (SEQ ID NO: 7589) |
|  | 3'-GUCAUGUGGGAAGAUGAUAGAGGAGGU-5' | (SEQ ID NO: 2044) |
| βc-m1935 Target: | 5'-CAGTACACCCTTCTACTATCTCCTCCA-3' | (SEQ ID NO: 3153) |
|  | 5'-CCAGUACACCCUUCUACUAUCUCCUCC-3' | (SEQ ID NO: 7590) |
|  | 3'-GGUCAUGUGGGAAGAUGAUAGAGGAGG-5' | (SEQ ID NO: 2045) |
| βc-m1936 Target: | 5'-CCAGTACACCCTTCTACTATCTCCTCC-3' | (SEQ ID NO: 3154) |
|  | 5'-GAGCUCCAGUACACCCUUCUACUAUCU-3' | (SEQ ID NO: 7591) |
|  | 3'-CUCGAGGUCAUGUGGGAAGAUGAUAGA-5' | (SEQ ID NO: 2046) |
| βc-m1941 Target: | 5'-GAGCTCCAGTACACCCTTCTACTATCT-3' | (SEQ ID NO: 3155) |
|  | 5'-AAACAAUGGAAUGGUAUUGAGUCCUCG-3' | (SEQ ID NO: 7592) |
|  | 3'-UUUGUUACCUUACCAUAACUCAGGAGC-5' | (SEQ ID NO: 2047) |
| βc-m2009 Target: | 5'-AAACAATGGAATGGTATTGAGTCCTCG-3' | (SEQ ID NO: 3156) |
|  | 5'-CUGCACAAACAAUGGAAUGGUAUUGAG-3' | (SEQ ID NO: 7593) |
|  | 3'-GACGUGUUUGUUACCUUACCAUAACUC-5' | (SEQ ID NO: 2048) |
| βc-m2015 Target: | 5'-CTGCACAAACAATGGAATGGTATTGAG-3' | (SEQ ID NO: 3157) |

TABLE 13-continued

Additional Selected Anti-β-catenin DsiRNAs, Blunt, Unfrayed Duplexes

|  |  |  |  |
|---|---|---|---|
|  | 5'-ACUGCACAAACAAUGGAAUGGUAUUGA-3' | (SEQ ID NO: 7594) |
|  | 3'-UGACGUGUUUGUUACCUUACCAUAACU-5' | (SEQ ID NO: 2049) |
| βc-m2016 Target: | 5'-ACTGCACAAACAATGGAATGGTATTGA-3' | (SEQ ID NO: 3158) |
|  | 5'-AAGCAACUGCACAAACAAUGGAAUGGU-3' | (SEQ ID NO: 7595) |
|  | 3'-UUCGUUGACGUGUUUGUUACCUUACCA-5' | (SEQ ID NO: 2050) |
| βc-m2021 Target: | 5'-AAGCAACTGCACAAACAATGGAATGGT-3' | (SEQ ID NO: 3159) |
|  | 5'-GAGAAUAAAGCAACUGCACAAACAAUG-3' | (SEQ ID NO: 7596) |
|  | 3'-CUCUUAUUUCGUUGACGUGUUUGUUAC-5' | (SEQ ID NO: 2051) |
| βc-m2028 Target: | 5'-GAGAATAAAGCAACTGCACAAACAATG-3' | (SEQ ID NO: 3160) |
|  | 5'-UUUCAAUGGGAGAAUAAAGCAACUGCA-3' | (SEQ ID NO: 7597) |
|  | 3'-AAAGUUACCCUCUUAUUUCGUUGACGU-5' | (SEQ ID NO: 2052) |
| βc-m2037 Target: | 5'-TTTCAATGGGAGAATAAAGCAACTGCA-3' | (SEQ ID NO: 3161) |
|  | 5'-UUUUCAAUGGGAGAAUAAAGCAACUGC-3' | (SEQ ID NO: 7598) |
|  | 3'-AAAAGUUACCCUCUUAUUUCGUUGACG-5' | (SEQ ID NO: 2053) |
| βc-m2038 Target: | 5'-TTTTCAATGGGAGAATAAAGCAACTGC-3' | (SEQ ID NO: 3162) |
|  | 5'-AUUUUCAAUGGGAGAAUAAAGCAACUG-3' | (SEQ ID NO: 7599) |
|  | 3'-UAAAAGUUACCCUCUUAUUUCGUUGAC-5' | (SEQ ID NO: 2054) |
| βc-m2039 Target: | 5'-ATTTTCAATGGGAGAATAAAGCAACTG-3' | (SEQ ID NO: 3163) |
|  | 5'-GGAUAUUUUCAAUGGGAGAAUAAAGCA-3' | (SEQ ID NO: 7600) |
|  | 3'-CCUAUAAAAGUUACCCUCUUAUUUCGU-5' | (SEQ ID NO: 2055) |
| βc-m2043 Target: | 5'-GGATATTTTCAATGGGAGAATAAAGCA-3' | (SEQ ID NO: 3164) |
|  | 5'-UGGAUAUUUUCAAUGGGAGAAUAAAGC-3' | (SEQ ID NO: 7601) |
|  | 3'-ACCUAUAAAAGUUACCCUCUUAUUUCG-5' | (SEQ ID NO: 2056) |
| βc-m2044 Target: | 5'-TGGATATTTTCAATGGGAGAATAAAGC-3' | (SEQ ID NO: 3165) |
|  | 5'-UUGGAUAUUUUCAAUGGGAGAAUAAAG-3' | (SEQ ID NO: 7602) |
|  | 3'-AACCUAUAAAAGUUACCCUCUUAUUUC-5' | (SEQ ID NO: 2057) |
| βc-m2045 Target: | 5'-TTGGATATTTTCAATGGGAGAATAAAG-3' | (SEQ ID NO: 3166) |
|  | 5'-CAGCUACUCUUUGGAUAUUUUCAAUGG-3' | (SEQ ID NO: 7603) |
|  | 3'-GUCGAUGAGAAACCUAUAAAAGUUACC-5' | (SEQ ID NO: 2058) |
| βc-m2055 Target: | 5'-CAGCTACTCTTTGGATATTTTCAATGG-3' | (SEQ ID NO: 3167) |
|  | 5'-GCAGCUACUCUUUGGAUAUUUUCAAUG-3' | (SEQ ID NO: 7604) |
|  | 3'-CGUCGAUGAGAAACCUAUAAAAGUUAC-5' | (SEQ ID NO: 2059) |
| βc-m2056 Target: | 5'-GCAGCTACTCTTTGGATATTTTCAATG-3' | (SEQ ID NO: 3168) |
|  | 5'-CCGCUUCUUGUAAUCCUGUGGCUUGUC-3' | (SEQ ID NO: 7605) |
|  | 3'-GGCGAAGAACAUUAGGACACCGAACAG-5' | (SEQ ID NO: 2060) |
| βc-m2231 Target: | 5'-CCGCTTCTTGTAATCCTGTGGCTTGTC-3' | (SEQ ID NO: 3169) |
|  | 5'-CCAGUCCAAGAUCUGCAGUCUCAUUCC-3' | (SEQ ID NO: 7606) |
|  | 3'-GGUCAGGUUCUAGACGUCAGAGUAAGG-5' | (SEQ ID NO: 2061) |
| βc-m2307 Target: | 5'-CCAGTCCAAGATCTGCAGTCTCATTCC-3' | (SEQ ID NO: 3170) |

TABLE 13-continued

Additional Selected Anti-β-catenin DsiRNAs, Blunt, Unfrayed Duplexes

|  |  |  |  |
|---|---|---|---|
|  | 5'-CGUAUCCACCAGAGUGAAAAGAACGGU-3' | (SEQ ID NO: 7607) |
|  | 3'-GCAUAGGUGGUCUCACUUUUCUUGCCA-5' | (SEQ ID NO: 2062) |
| βc-m2385 Target: | 5'-CGTATCCACCAGAGTGAAAAGAACGGT-3' | (SEQ ID NO: 3171) |
|  | 5'-CAGGCCAGCUGAUUGCUAUCACCUGGG-3' | (SEQ ID NO: 7608) |
|  | 3'-GUCCGGUCGACUAACGAUAGUGGACCC-5' | (SEQ ID NO: 2063) |
| βc-m2539 Target: | 5'-CAGGCCAGCTGATTGCTATCACCTGGG-3' | (SEQ ID NO: 3172) |
|  | 5'-CGAUUUACAGGUCAGUAUCAAACCAGG-3' | (SEQ ID NO: 7609) |
|  | 3'-GCUAAAUGUCCAGUCAUAGUUUGGUCC-5' | (SEQ ID NO: 2064) |
| βc-m2562 Target: | 5'-CGATTTACAGGTCAGTATCAAACCAGG-3' | (SEQ ID NO: 3173) |
|  | 5'-ACGAUUUACAGGUCAGUAUCAAACCAG-3' | (SEQ ID NO: 7610) |
|  | 3'-UGCUAAAUGUCCAGUCAUAGUUUGGUC-5' | (SEQ ID NO: 2065) |
| βc-m2563 Target: | 5'-ACGATTTACAGGTCAGTATCAAACCAG-3' | (SEQ ID NO: 3174) |
|  | 5'-UUUCUUACCUAAAGGACGAUUUACAGG-3' | (SEQ ID NO: 7611) |
|  | 3'-AAAGAAUGGAUUUCCUGCUAAAUGUCC-5' | (SEQ ID NO: 2066) |
| βc-m2578 Target: | 5'-TTTCTTACCTAAAGGACGATTTACAGG-3' | (SEQ ID NO: 3175) |
|  | 5'-GCUUUCUUACCUAAAGGACGAUUUACA-3' | (SEQ ID NO: 7612) |
|  | 3'-CGAAAGAAUGGAUUUCCUGCUAAAUGU-5' | (SEQ ID NO: 2067) |
| βc-m2580 Target: | 5'-GCTTTCTTACCTAAAGGACGATTTACA-3' | (SEQ ID NO: 3176) |
|  | 5'-CUUUUAUAAGCUUUCUUACCUAAAGGA-3' | (SEQ ID NO: 7613) |
|  | 3'-GAAAAUAUUCGAAAGAAUGGAUUUCCU-5' | (SEQ ID NO: 2068) |
| βc-m2589 Target: | 5'-CTTTTATAAGCTTTCTTACCTAAAGGA-3' | (SEQ ID NO: 3177) |
|  | 5'-GCUUUUAUAAGCUUUCUUACCUAAAGG-3' | (SEQ ID NO: 7614) |
|  | 3'-CGAAAAUAUUCGAAAGAAUGGAUUUCC-5' | (SEQ ID NO: 2069) |
| βc-m2590 Target: | 5'-GCTTTTATAAGCTTTCTTACCTAAAGG-3' | (SEQ ID NO: 3178) |
|  | 5'-CUGGCUUUUAUAAGCUUUCUUACCUAA-3' | (SEQ ID NO: 7615) |
|  | 3'-GACCGAAAAUAUUCGAAAGAAUGGAUU-5' | (SEQ ID NO: 2070) |
| βc-m2593 Target: | 5'-CTGGCTTTTATAAGCTTTCTTACCTAA-3' | (SEQ ID NO: 3179) |
|  | 5'-CCACACUGGCUUUUAUAAGCUUUCUUA-3' | (SEQ ID NO: 7616) |
|  | 3'-GGUGUGACCGAAAAUAUUCGAAAGAAU-5' | (SEQ ID NO: 2071) |
| βc-m2598 Target: | 5'-CCACACTGGCTTTTATAAGCTTTCTTA-3' | (SEQ ID NO: 3180) |
|  | 5'-AUUCACCCACACUGGCUUUUAUAAGCU-3' | (SEQ ID NO: 7617) |
|  | 3'-UAAGUGGGUGUGACCGAAAAUAUUCGA-5' | (SEQ ID NO: 2072) |
| βc-m2604 Target: | 5'-ATTCACCCACACTGGCTTTTATAAGCT-3' | (SEQ ID NO: 3181) |
|  | 5'-CCUACCAAGUCUUUCUGGAGUUCUGCA-3' | (SEQ ID NO: 7618) |
|  | 3'-GGAUGGUUCAGAAAGACCUCAAGACGU-5' | (SEQ ID NO: 2073) |
| βc-m2644 Target: | 5'-CCTACCAAGTCTTTCTGGAGTTCTGCA-3' | (SEQ ID NO: 3182) |
|  | 5'-AUUUACAAACAGGCCUAAAACCAUUCC-3' | (SEQ ID NO: 7619) |
|  | 3'-UAAAUGUUUGUCCGGAUUUUGGUAAGG-5' | (SEQ ID NO: 2074) |
| βc-m2674 Target: | 5'-ATTTACAAACAGGCCTAAAACCATTCC-3' | (SEQ ID NO: 3183) |

TABLE 13-continued

Additional Selected Anti-β-catenin DsiRNAs, Blunt, Unfrayed Duplexes

|               |                                             |                  |
|---------------|---------------------------------------------|------------------|
|               | 5'-GAUUUACAAACAGGCCUAAAACCAUUC-3'           | (SEQ ID NO: 7620) |
|               | 3'-CUAAAUGUUUGUCCGGAUUUUGGUAAG-5'           | (SEQ ID NO: 2075) |
| βc-m2675 Target: | 5'-GATTTACAAACAGGCCTAAAACCATTC-3'         | (SEQ ID NO: 3184) |
|               | 5'-AGAUUUACAAACAGGCCUAAAACCAUU-3'           | (SEQ ID NO: 7621) |
|               | 3'-UCUAAAUGUUUGUCCGGAUUUUGGUAA-5'           | (SEQ ID NO: 2076) |
| βc-m2676 Target: | 5'-AGATTTACAAACAGGCCTAAAACCATT-3'         | (SEQ ID NO: 3185) |
|               | 5'-CAUCUCCUUCCAAGGUAUGUAUCUGUU-3'           | (SEQ ID NO: 7622) |
|               | 3'-GUAGAGGAAGGUUCCAUACAUAGACAA-5'           | (SEQ ID NO: 2077) |
| βc-m2710 Target: | 5'-CATCTCCTTCCAAGGTATGTATCTGTT-3'         | (SEQ ID NO: 3186) |
|               | 5'-ACAUCUCCUUCCAAGGUAUGUAUCUGU-3'           | (SEQ ID NO: 7623) |
|               | 3'-UGUAGAGGAAGGUUCCAUACAUAGACA-5'           | (SEQ ID NO: 2078) |
| βc-m2711 Target: | 5'-ACATCTCCTTCCAAGGTATGTATCTGT-3'         | (SEQ ID NO: 3187) |
|               | 5'-ACUUCCACACAUGAACAUCUCCUUCCA-3'           | (SEQ ID NO: 7624) |
|               | 3'-UGAAGGUGUGUACUUGUAGAGGAAGGU-5'           | (SEQ ID NO: 2079) |
| βc-m2725 Target: | 5'-ACTTCCACACATGAACATCTCCTTCCA-3'         | (SEQ ID NO: 3188) |
|               | 5'-GAAACUUCCACACAUGAACAUCUCCUU-3'           | (SEQ ID NO: 7625) |
|               | 3'-CUUUGAAGGUGUGUACUUGUAGAGGAA-5'           | (SEQ ID NO: 2080) |
| βc-m2728 Target: | 5'-GAAACTTCCACACATGAACATCTCCTT-3'         | (SEQ ID NO: 3189) |
|               | 5'-AGAAACUUCCACACAUGAACAUCUCCU-3'           | (SEQ ID NO: 7626) |
|               | 3'-UCUUUGAAGGUGUGUACUUGUAGAGGA-5'           | (SEQ ID NO: 2081) |
| βc-m2729 Target: | 5'-AGAAACTTCCACACATGAACATCTCCT-3'         | (SEQ ID NO: 3190) |
|               | 5'-GAGAAACUUCCACACAUGAACAUCUCC-3'           | (SEQ ID NO: 7627) |
|               | 3'-CUCUUUGAAGGUGUGUACUUGUAGAGG-5'           | (SEQ ID NO: 2082) |
| βc-m2730 Target: | 5'-GAGAAACTTCCACACATGAACATCTCC-3'         | (SEQ ID NO: 3191) |
|               | 5'-UGAGAAACUUCCACACAUGAACAUCUC-3'           | (SEQ ID NO: 7628) |
|               | 3'-ACUCUUUGAAGGUGUGUACUUGUAGAG-5'           | (SEQ ID NO: 2083) |
| βc-m2731 Target: | 5'-TGAGAAACTTCCACACATGAACATCTC-3'         | (SEQ ID NO: 3192) |
|               | 5'-CAUCAACGUGAGAAACUUCCACACAUG-3'           | (SEQ ID NO: 7629) |
|               | 3'-GUAGUUGCACUCUUUGAAGGUGUGUAC-5'           | (SEQ ID NO: 2084) |
| βc-m2739 Target: | 5'-CATCAACGTGAGAAACTTCCACACATG-3'         | (SEQ ID NO: 3193) |
|               | 5'-AAACAUCAACGUGAGAAACUUCCACAC-3'           | (SEQ ID NO: 7630) |
|               | 3'-UUUGUAGUUGCACUCUUUGAAGGUGUG-5'           | (SEQ ID NO: 2085) |
| βc-m2742 Target: | 5'-AAACATCAACGTGAGAAACTTCCACAC-3'         | (SEQ ID NO: 3194) |
|               | 5'-AAAACAUCAACGUGAGAAACUUCCACA-3'           | (SEQ ID NO: 7631) |
|               | 3'-UUUUGUAGUUGCACUCUUUGAAGGUGU-5'           | (SEQ ID NO: 2086) |
| βc-m2743 Target: | 5'-AAAACATCAACGTGAGAAACTTCCACA-3'         | (SEQ ID NO: 3195) |
|               | 5'-AAAAACAUCAACGUGAGAAACUUCCAC-3'           | (SEQ ID NO: 7632) |
|               | 3'-UUUUUGUAGUUGCACUCUUUGAAGGUG-5'           | (SEQ ID NO: 2087) |
| βc-m2744 Target: | 5'-AAAAACATCAACGTGAGAAACTTCCAC-3'         | (SEQ ID NO: 3196) |

TABLE 13-continued

Additional Selected Anti-β-catenin DsiRNAs, Blunt, Unfrayed Duplexes

|  |  |  |  |
|---|---|---|---|
|  | 5'-CAAAAACAUCAACGUGAGAAACUUCCA-3' | (SEQ ID NO: 7633) |  |
|  | 3'-GUUUUUGUAGUUGCACUCUUUGAAGGU-5' | (SEQ ID NO: 2088) |  |
| βc-m2745 Target: | 5'-CAAAAACATCAACGTGAGAAACTTCCA-3' | (SEQ ID NO: 3197) |  |
|  | 5'-GCAAAAACAUCAACGUGAGAAACUUCC-3' | (SEQ ID NO: 7634) |  |
|  | 3'-CGUUUUUGUAGUUGCACUCUUUGAAGG-5' | (SEQ ID NO: 2089) |  |
| βc-m2746 Target: | 5'-GCAAAAACATCAACGTGAGAAACTTCC-3' | (SEQ ID NO: 3198) |  |
|  | 5'-UGGCAAAAACAUCAACGUGAGAAACUU-3' | (SEQ ID NO: 7635) |  |
|  | 3'-ACCGUUUUUGUAGUUGCACUCUUUGAA-5' | (SEQ ID NO: 2090) |  |
| βc-m2748 Target: | 5'-TGGCAAAAACATCAACGTGAGAAACTT-3' | (SEQ ID NO: 3199) |  |
|  | 5'-CUGCAAAAGCUGUGGCAAAAACAUCAA-3' | (SEQ ID NO: 7636) |  |
|  | 3'-GACGUUUUCGACACCGUUUUUGUAGUU-5' | (SEQ ID NO: 2091) |  |
| βc-m2760 Target: | 5'-CTGCAAAAGCTGTGGCAAAAACATCAA-3' | (SEQ ID NO: 3200) |  |
|  | 5'-GCUGCAAAAGCUGUGGCAAAAACAUCA-3' | (SEQ ID NO: 7637) |  |
|  | 3'-CGACGUUUUCGACACCGUUUUUGUAGU-5' | (SEQ ID NO: 2092) |  |
| βc-m2761 Target: | 5'-GCTGCAAAAGCTGTGGCAAAAACATCA-3' | (SEQ ID NO: 3201) |  |
|  | 5'-ACUCAUCUGAGUAUAACGCUGCAAAAG-3' | (SEQ ID NO: 7638) |  |
|  | 3'-UGAGUAGACUCAUAUUGCGACGUUUUC-5' | (SEQ ID NO: 2093) |  |
| βc-m2778 Target: | 5'-ACTCATCTGAGTATAACGCTGCAAAAG-3' | (SEQ ID NO: 3202) |  |
|  | 5'-UGAAAACAGCAAAUGUUACUCAUCUGA-3' | (SEQ ID NO: 7639) |  |
|  | 3'-ACUUUUGUCGUUUACAAUGAGUAGACU-5' | (SEQ ID NO: 2094) |  |
| βc-m2795 Target: | 5'-TGAAAACAGCAAATGTTACTCATCTGA-3' | (SEQ ID NO: 3203) |  |
|  | 5'-UUGAAAACAGCAAAUGUUACUCAUCUG-3' | (SEQ ID NO: 7640) |  |
|  | 3'-AACUUUUGUCGUUUACAAUGAGUAGAC-5' | (SEQ ID NO: 2095) |  |
| βc-m2796 Target: | 5'-TTGAAAACAGCAAATGTTACTCATCTG-3' | (SEQ ID NO: 3204) |  |
|  | 5'-GUUGAAAACAGCAAAUGUUACUCAUCU-3' | (SEQ ID NO: 7641) |  |
|  | 3'-CAACUUUUGUCGUUUACAAUGAGUAGA-5' | (SEQ ID NO: 2096) |  |
| βc-m2797 Target: | 5'-GTTGAAAACAGCAAATGTTACTCATCT-3' | (SEQ ID NO: 3205) |  |
|  | 5'-CUAUUAAUGUUGAAAACAGCAAAUGUU-3' | (SEQ ID NO: 7642) |  |
|  | 3'-GAUAAUUACAACUUUUGUCGUUUACAA-5' | (SEQ ID NO: 2097) |  |
| βc-m2805 Target: | 5'-CTATTAATGTTGAAAACAGCAAATGTT-3' | (SEQ ID NO: 3206) |  |
|  | 5'-ACACUACAGCUGUAUAGAGAGAAAGGC-3' | (SEQ ID NO: 7643) |  |
|  | 3'-UGUGAUGUCGACAUAUCUCUCUUUCCG-5' | (SEQ ID NO: 2098) |  |
| βc-m2834 Target: | 5'-ACACTACAGCTGTATAGAGAGAAAGGC-3' | (SEQ ID NO: 3207) |  |
|  | 5'-CAGGCCAAUCACAAUGCACGUUCAGAC-3' | (SEQ ID NO: 7644) |  |
|  | 3'-GUCCGGUUAGUGUUACGUGCAAGUCUG-5' | (SEQ ID NO: 2099) |  |
| βc-m2859 Target: | 5'-CAGGCCAATCACAATGCACGTTCAGAC-3' | (SEQ ID NO: 3208) |  |
|  | 5'-CUGUUCCCAUAGGAAACUCAGCUUGGU-3' | (SEQ ID NO: 7645) |  |
|  | 3'-GACAAGGGUAUCCUUUGAGUCGAACCA-5' | (SEQ ID NO: 2100) |  |
| βc-m2946 Target: | 5'-CTGTTCCCATAGGAAACTCAGCTTGGT-3' | (SEQ ID NO: 3209) |  |

TABLE 13-continued

Additional Selected Anti-β-catenin DsiRNAs, Blunt, Unfrayed Duplexes

|  |  |  |  |
|---|---|---|---|
|  | 5'-CAGAACAAAAAGCGUACUUCGACUGUU-3' | (SEQ ID NO: 7646) |  |
|  | 3'-GUCUUGUUUUUCGCAUGAAGCUGACAA-5' | (SEQ ID NO: 2101) |  |
| βc-m2968 Target: | 5'-CAGAACAAAAAGCGTACTTCGACTGTT-3' | (SEQ ID NO: 3210) |  |
|  | 5'-AAGGACCAGAACAAAAAGCGUACUUCG-3' | (SEQ ID NO: 7647) |  |
|  | 3'-UUCCUGGUCUUGUUUUUCGCAUGAAGC-5' | (SEQ ID NO: 2102) |  |
| βc-m2974 Target: | 5'-AAGGACCAGAACAAAAAGCGTACTTCG-3' | (SEQ ID NO: 3211) |  |
|  | 5'-CGACCAAAAAGGACCAGAACAAAAAGC-3' | (SEQ ID NO: 7648) |  |
|  | 3'-GCUGGUUUUUCCUGGUCUUGUUUUUCG-5' | (SEQ ID NO: 2103) |  |
| βc-m2982 Target: | 5'-CGACCAAAAAGGACCAGAACAAAAAGC-3' | (SEQ ID NO: 3212) |  |
|  | 5'-UCGACCAAAAAGGACCAGAACAAAAAG-3' | (SEQ ID NO: 7649) |  |
|  | 3'-AGCUGGUUUUUCCUGGUCUUGUUUUUC-5' | (SEQ ID NO: 2104) |  |
| βc-m2983 Target: | 5'-TCGACCAAAAAGGACCAGAACAAAAAG-3' | (SEQ ID NO: 3213) |  |
|  | 5'-UUACUCCUCGACCAAAAAGGACCAGAA-3' | (SEQ ID NO: 7650) |  |
|  | 3'-AAUGAGGAGCUGGUUUUUCCUGGUCUU-5' | (SEQ ID NO: 2105) |  |
| βc-m2990 Target: | 5'-TTACTCCTCGACCAAAAAGGACCAGAA-3' | (SEQ ID NO: 3214) |  |
|  | 5'-AAUCCAUUUGUAUUGUUACUCCUCGAC-3' | (SEQ ID NO: 7651) |  |
|  | 3'-UUAGGUAAACAUAACAAUGAGGAGCUG-5' | (SEQ ID NO: 2106) |  |
| βc-m3005 Target: | 5'-AATCCATTTGTATTGTTACTCCTCGAC-3' | (SEQ ID NO: 3215) |  |
|  | 5'-AAAUCCAUUUGUAUUGUUACUCCUCGA-3' | (SEQ ID NO: 7652) |  |
|  | 3'-UUUAGGUAAACAUAACAAUGAGGAGCU-5' | (SEQ ID NO: 2107) |  |
| βc-m3006 Target: | 5'-AAATCCATTTGTATTGTTACTCCTCGA-3' | (SEQ ID NO: 3216) |  |
|  | 5'-CAAAUCCAUUUGUAUUGUUACUCCUCG-3' | (SEQ ID NO: 7653) |  |
|  | 3'-GUUUAGGUAAACAUAACAAUGAGGAGC-5' | (SEQ ID NO: 2108) |  |
| βc-m3007 Target: | 5'-CAAATCCATTTGTATTGTTACTCCTCG-3' | (SEQ ID NO: 3217) |  |
|  | 5'-CCAAAUCCAUUUGUAUUGUUACUCCUC-3' | (SEQ ID NO: 7654) |  |
|  | 3'-GGUUUAGGUAAACAUAACAAUGAGGAG-5' | (SEQ ID NO: 2109) |  |
| βc-m3008 Target: | 5'-CCAAATCCATTTGTATTGTTACTCCTC-3' | (SEQ ID NO: 3218) |  |
|  | 5'-UCACUCCCCAAAUCCAUUUGUAUUGUU-3' | (SEQ ID NO: 7655) |  |
|  | 3'-AGUGAGGGGUUUAGGUAAACAUAACAA-5' | (SEQ ID NO: 2110) |  |
| βc-m3015 Target: | 5'-TCACTCCCCAAATCCATTTGTATTGTT-3' | (SEQ ID NO: 3219) |  |
|  | 5'-GAUCCAUUCGUGUGCAUUCUUCACUGC-3' | (SEQ ID NO: 7656) |  |
|  | 3'-CUAGGUAAGCACACGUAAGAAGUGACG-5' | (SEQ ID NO: 2111) |  |
| βc-m3047 Target: | 5'-GATCCATTCGTGTGCATTCTTCACTGC-3' | (SEQ ID NO: 3220) |  |
|  | 5'-UGAUCCAUUCGUGUGCAUUCUUCACUG-3' | (SEQ ID NO: 7657) |  |
|  | 3'-ACUAGGUAAGCACACGUAAGAAGUGAC-5' | (SEQ ID NO: 2112) |  |
| βc-m3048 Target: | 5'-TGATCCATTCGTGTGCATTCTTCACTG-3' | (SEQ ID NO: 3221) |  |
|  | 5'-GUGAUCCAUUCGUGUGCAUUCUUCACU-3' | (SEQ ID NO: 7658) |  |
|  | 3'-CACUAGGUAAGCACACGUAAGAAGUGA-5' | (SEQ ID NO: 2113) |  |
| βc-m3049 Target: | 5'-GTGATCCATTCGTGTGCATTCTTCACT-3' | (SEQ ID NO: 3222) |  |

TABLE 13-continued

Additional Selected Anti-β-catenin DsiRNAs, Blunt, Unfrayed Duplexes

|  |  |  |  |
|---|---|---|---|
|  | 5'-UAAAACAAAGAACAAGCAAGGCUAGGG-3' | (SEQ ID NO: 7659) |
|  | 3'-AUUUUGUUUCUUGUUCGUUCCGAUCCC-5' | (SEQ ID NO: 2114) |
| βc-m3093 Target: | 5'-TAAAACAAAGAACAAGCAAGGCTAGGG-3' | (SEQ ID NO: 3223) |
|  | 5'-GCACCACUACAGAUAUUAAACAAAGA-3' | (SEQ ID NO: 7660) |
|  | 3'-CGUGGUGAUGUCUAUAAUUUGUUUCU-5' | (SEQ ID NO: 2115) |
| βc-m3109 Target: | 5'-GCACCACTACAGATATTAAACAAAGA-3' | (SEQ ID NO: 3224) |
|  | 5'-CAGCACCACUACAGAUAUUAAACAAA-3' | (SEQ ID NO: 7661) |
|  | 3'-GUCGUGGUGAUGUCUAUAAUUUGUUU-5' | (SEQ ID NO: 2116) |
| βc-m3111 Target: | 5'-CAGCACCACTACAGATATTAAACAAA-3' | (SEQ ID NO: 3225) |
|  | 5'-UCAGCACCACUACAGAUAUUAAACAA-3' | (SEQ ID NO: 7662) |
|  | 3'-AGUCGUGGUGAUGUCUAUAAUUUGUU-5' | (SEQ ID NO: 2117) |
| βc-m3112 Target: | 5'-TCAGCACCACTACAGATATTAAACAA-3' | (SEQ ID NO: 3226) |
|  | 5'-AAAAAAUAAAGCAAGCAAAGUCAGCA-3' | (SEQ ID NO: 7663) |
|  | 3'-UUUUUUAUUUCGUUCGUUUCAGUCGU-5' | (SEQ ID NO: 2118) |
| βc-m3133 Target: | 5'-AAAAAATAAAGCAAGCAAAGTCAGCA-3' | (SEQ ID NO: 3227) |
|  | 5'-CUGCAAAAAAUAAAGCAAGCAAAGUC-3' | (SEQ ID NO: 7664) |
|  | 3'-GACGUUUUUUAUUUCGUUCGUUUCAG-5' | (SEQ ID NO: 2119) |
| βc-m3137 Target: | 5'-CTGCAAAAAATAAAGCAAGCAAAGTC-3' | (SEQ ID NO: 3228) |
|  | 5'-AGUUACUGCAAAAAAUAAAGCAAGCA-3' | (SEQ ID NO: 7665) |
|  | 3'-UCAAUGACGUUUUUUAUUUCGUUCGU-5' | (SEQ ID NO: 2120) |
| βc-m3142 Target: | 5'-AGTTACTGCAAAAAATAAAGCAAGCA-3' | (SEQ ID NO: 3229) |
|  | 5'-ACUAACAGUUACUGCAAAAAAUAAAG-3' | (SEQ ID NO: 7666) |
|  | 3'-UGAUUGUCAAUGACGUUUUUUAUUUC-5' | (SEQ ID NO: 2121) |
| βc-m3148 Target: | 5'-ACTAACAGTTACTGCAAAAAATAAAG-3' | (SEQ ID NO: 3230) |
|  | 5'-AAACUAACAGUUACUGCAAAAAAUAAA-3' | (SEQ ID NO: 7667) |
|  | 3'-UUUGAUUGUCAAUGACGUUUUUUAUUU-5' | (SEQ ID NO: 2122) |
| βc-m3150 Target: | 5'-AAACTAACAGTTACTGCAAAAAATAAA-3' | (SEQ ID NO: 3231) |
|  | 5'-AAAAACUAACAGUUACUGCAAAAAAUA-3' | (SEQ ID NO: 7668) |
|  | 3'-UUUUUGAUUGUCAAUGACGUUUUUUAU-5' | (SEQ ID NO: 2123) |
| βc-m3152 Target: | 5'-AAAAACTAACAGTTACTGCAAAAAATA-3' | (SEQ ID NO: 3232) |
|  | 5'-UAAAAACUAACAGUUACUGCAAAAAAU-3' | (SEQ ID NO: 7669) |
|  | 3'-AUUUUUGAUUGUCAAUGACGUUUUUUA-5' | (SEQ ID NO: 2124) |
| βc-m3153 Target: | 5'-TAAAAACTAACAGTTACTGCAAAAAAT-3' | (SEQ ID NO: 3233) |
|  | 5'-CUUAAAAACUAACAGUUACUGCAAAAA-3' | (SEQ ID NO: 7670) |
|  | 3'-GAAUUUUUGAUUGUCAAUGACGUUUUU-5' | (SEQ ID NO: 2125) |
| βc-m3155 Target: | 5'-CTTAAAAACTAACAGTTACTGCAAAAA-3' | (SEQ ID NO: 3234) |
|  | 5'-ACUACUUAAAAACUAACAGUUACUGCA-3' | (SEQ ID NO: 7671) |
|  | 3'-UGAUGAAUUUUUGAUUGUCAAUGACGU-5' | (SEQ ID NO: 2126) |
| βc-m3159 Target: | 5'-ACTACTTAAAAACTAACAGTTACTGCA-3' | (SEQ ID NO: 3235) |

TABLE 13-continued

Additional Selected Anti-β-catenin DsiRNAs, Blunt, Unfrayed Duplexes

|  |  |  |  |
|---|---|---|---|
|  |  | 5'-ACACUACUUAAAAACUAACAGUUACUG-3' | (SEQ ID NO: 7672) |
|  |  | 3'-UGUGAUGAAUUUUUGAUUGUCAAUGAC-5' | (SEQ ID NO: 2127) |
| βc-m3161 | Target: | 5'-ACACTACTTAAAAACTAACAGTTACTG-3' | (SEQ ID NO: 3236) |
|  |  | 5'-CAUAACACUACUUAAAAACUAACAGUU-3' | (SEQ ID NO: 7673) |
|  |  | 3'-GUAUUGUGAUGAAUUUUUGAUUGUCAA-5' | (SEQ ID NO: 2128) |
| βc-m3165 | Target: | 5'-CATAACACTACTTAAAAACTAACAGTT-3' | (SEQ ID NO: 3237) |
|  |  | 5'-ACAUAACACUACUUAAAAACUAACAGU-3' | (SEQ ID NO: 7674) |
|  |  | 3'-UGUAUUGUGAUGAAUUUUUGAUUGUCA-5' | (SEQ ID NO: 2129) |
| βc-m3166 | Target: | 5'-ACATAACACTACTTAAAAACTAACAGT-3' | (SEQ ID NO: 3238) |
|  |  | 5'-GAACAUAACACUACUUAAAAACUAACA-3' | (SEQ ID NO: 7675) |
|  |  | 3'-CUUGUAUUGUGAUGAAUUUUUGAUUGU-5' | (SEQ ID NO: 2130) |
| βc-m3168 | Target: | 5'-GAACATAACACTACTTAAAAACTAACA-3' | (SEQ ID NO: 3239) |
|  |  | 5'-AGAACAUAACACUACUUAAAAACUAAC-3' | (SEQ ID NO: 7676) |
|  |  | 3'-UCUUGUAUUGUGAUGAAUUUUUGAUUG-5' | (SEQ ID NO: 2131) |
| βc-m3169 | Target: | 5'-AGAACATAACACTACTTAAAAACTAAC-3' | (SEQ ID NO: 3240) |
|  |  | 5'-UAGAACAUAACACUACUUAAAAACUAA-3' | (SEQ ID NO: 7677) |
|  |  | 3'-AUCUUGUAUUGUGAUGAAUUUUUGAUU-5' | (SEQ ID NO: 2132) |
| βc-m3170 | Target: | 5'-TAGAACATAACACTACTTAAAAACTAA-3' | (SEQ ID NO: 3241) |
|  |  | 5'-CUAGAACAUAACACUACUUAAAAACUA-3' | (SEQ ID NO: 7678) |
|  |  | 3'-GAUCUUGUAUUGUGAUGAAUUUUUGAU-5' | (SEQ ID NO: 2133) |
| βc-m3171 | Target: | 5'-CTAGAACATAACACTACTTAAAAACTA-3' | (SEQ ID NO: 3242) |
|  |  | 5'-GUUCACUAGAACAUAACACUACUUAAA-3' | (SEQ ID NO: 7679) |
|  |  | 3'-CAAGUGAUCUUGUAUUGUGAUGAAUUU-5' | (SEQ ID NO: 2134) |
| βc-m3176 | Target: | 5'-GTTCACTAGAACATAACACTACTTAAA-3' | (SEQ ID NO: 3243) |
|  |  | 5'-AGGUUCACUAGAACAUAACACUACUUA-3' | (SEQ ID NO: 7680) |
|  |  | 3'-UCCAAGUGAUCUUGUAUUGUGAUGAAU-5' | (SEQ ID NO: 2135) |
| βc-m3178 | Target: | 5'-AGGTTCACTAGAACATAACACTACTTA-3' | (SEQ ID NO: 3244) |
|  |  | 5'-CAGGUUCACUAGAACAUAACACUACUU-3' | (SEQ ID NO: 7681) |
|  |  | 3'-GUCCAAGUGAUCUUGUAUUGUGAUGAA-5' | (SEQ ID NO: 2136) |
| βc-m3179 | Target: | 5'-CAGGTTCACTAGAACATAACACTACTT-3' | (SEQ ID NO: 3245) |
|  |  | 5'-CCAUUACUCGGUUCUUAGAAAUCAGAA-3' | (SEQ ID NO: 7682) |
|  |  | 3'-GGUAAUGAGCCAAGAAUCUUUAGUCUU-5' | (SEQ ID NO: 2137) |
| βc-m3216 | Target: | 5'-CCATTACTCGGTTCTTAGAAATCAGAA-3' | (SEQ ID NO: 3246) |
|  |  | 5'-ACACCAUUACUCGGUUCUUAGAAAUCA-3' | (SEQ ID NO: 7683) |
|  |  | 3'-UGUGGUAAUGAGCCAAGAAUCUUUAGU-5' | (SEQ ID NO: 2138) |
| βc-m3219 | Target: | 5'-ACACCATTACTCGGTTCTTAGAAATCA-3' | (SEQ ID NO: 3247) |
|  |  | 5'-GUUCUACACCAUUACUCGGUUCUUAGA-3' | (SEQ ID NO: 7684) |
|  |  | 3'-CAAGAUGUGGUAAUGAGCCAAGAAUCU-5' | (SEQ ID NO: 2139) |
| βc-m3224 | Target: | 5'-GTTCTACACCATTACTCGGTTCTTAGA-3' | (SEQ ID NO: 3248) |

TABLE 13-continued

Additional Selected Anti-β-catenin DsiRNAs, Blunt, Unfrayed Duplexes

|  |  |  |  |
|---|---|---|---|
|  | 5'-AUGAAUUAGUGUUCUACACCAUUACUC-3' | (SEQ ID NO: 7685) |  |
|  | 3'-UACUUAAUCACAAGAUGUGGUAAUGAG-5' | (SEQ ID NO: 2140) |  |
| βc-m3234 Target: | 5'-ATGAATTAGTGTTCTACACCATTACTC-3' | (SEQ ID NO: 3249) |  |
|  | 5'-UGAUUAUGAAUUAGUGUUCUACACCAU-3' | (SEQ ID NO: 7686) |  |
|  | 3'-ACUAAUACUUAAUCACAAGAUGUGGUA-5' | (SEQ ID NO: 2141) |  |
| βc-m3239 Target: | 5'-TGATTATGAATTAGTGTTCTACACC-3' | (SEQ ID NO: 3250) |  |
|  | 5'-GUGAUUAUGAAUUAGUGUUCUACACCA-3' | (SEQ ID NO: 7687) |  |
|  | 3'-CACUAAUACUUAAUCACAAGAUGUGGU-5' | (SEQ ID NO: 2142) |  |
| βc-m3240 Target: | 5'-GTGATTATGAATTAGTGTTCTACACCA-3' | (SEQ ID NO: 3251) |  |
|  | 5'-CGUGAUUAUGAAUUAGUGUUCUACACC-3' | (SEQ ID NO: 7688) |  |
|  | 3'-GCACUAAUACUUAAUCACAAGAUGUGG-5' | (SEQ ID NO: 2143) |  |
| βc-m3241 Target: | 5'-CGTGATTATGAATTAGTGTTCTACACC-3' | (SEQ ID NO: 3252) |  |
|  | 5'-UUACAAUUAGCGUGAUUAUGAAUUAGU-3' | (SEQ ID NO: 7689) |  |
|  | 3'-AAUGUUAAUCGCACUAAUACUUAAUCA-5' | (SEQ ID NO: 2144) |  |
| βc-m3251 Target: | 5'-TTACAATTAGCGTGATTATGAATTAGT-3' | (SEQ ID NO: 3253) |  |
|  | 5'-AUUACAAUUAGCGUGAUUAUGAAUUAG-3' | (SEQ ID NO: 7690) |  |
|  | 3'-UAAUGUUAAUCGCACUAAUACUUAAUC-5' | (SEQ ID NO: 2145) |  |
| βc-m3252 Target: | 5'-ATTACAATTAGCGTGATTATGAATTAG-3' | (SEQ ID NO: 3254) |  |
|  | 5'-CCAGAUUACAAUUAGCGUGAUUAUGAA-3' | (SEQ ID NO: 7691) |  |
|  | 3'-GGUCUAAUGUUAAUCGCACUAAUACUU-5' | (SEQ ID NO: 2146) |  |
| βc-m3256 Target: | 5'-CCAGATTACAATTAGCGTGATTATGAA-3' | (SEQ ID NO: 3255) |  |
|  | 5'-GUUACACGUCUCCAGAUUACAAUUAGC-3' | (SEQ ID NO: 7692) |  |
|  | 3'-CAAUGUGCAGAGGUCUAAUGUUAAUCG-5' | (SEQ ID NO: 2147) |  |
| βc-m3267 Target: | 5'-GTTACACGTCTCCAGATTACAATTAGC-3' | (SEQ ID NO: 3256) |  |
|  | 5'-AUGUUACACGUCUCCAGAUUACAAUUA-3' | (SEQ ID NO: 7693) |  |
|  | 3'-UACAAUGUGCAGAGGUCUAAUGUUAAU-5' | (SEQ ID NO: 2148) |  |
| βc-m3269 Target: | 5'-ATGTTACACGTCTCCAGATTACAATTA-3' | (SEQ ID NO: 3257) |  |
|  | 5'-GCUACACAAUGUUACACGUCUCCAGAU-3' | (SEQ ID NO: 7694) |  |
|  | 3'-CGAUGUGUUACAAUGUGCAGAGGUCUA-5' | (SEQ ID NO: 2149) |  |
| βc-m3277 Target: | 5'-GCTACACAATGTTACACGTCTCCAGAT-3' | (SEQ ID NO: 3258) |  |
|  | 5'-AGGCUACACAAUGUUACACGUCUCCAG-3' | (SEQ ID NO: 7695) |  |
|  | 3'-UCCGAUGUGUUACAAUGUGCAGAGGUC-5' | (SEQ ID NO: 2150) |  |
| βc-m3279 Target: | 5'-AGGCTACACAATGTTACACGTCTCCAG-3' | (SEQ ID NO: 3259) |  |
|  | 5'-AUACAAAGGCUACACAAUGUUACACG-3' | (SEQ ID NO: 7696) |  |
|  | 3'-UAUGUUUCCGAUGUGUUACAAUGUGC-5' | (SEQ ID NO: 2151) |  |
| βc-m3286 Target: | 5'-ATACAAAGGCTACACAATGTTACACG-3' | (SEQ ID NO: 3260) |  |
|  | 5'-UAUACAAAGGCUACACAAUGUUACAC-3' | (SEQ ID NO: 7697) |  |
|  | 3'-AUAUGUUUCCGAUGUGUUACAAUGUG-5' | (SEQ ID NO: 2152) |  |
| βc-m3287 Target: | 5'-TATACAAAGGCTACACAATGTTACAC-3' | (SEQ ID NO: 3261) |  |

TABLE 13-continued

Additional Selected Anti-β-catenin DsiRNAs, Blunt, Unfrayed Duplexes

|  |  |  |  |
|---|---|---|---|
|  | 5'-UAUUUAUACAAAAGGCUACACAAUGUU-3' | (SEQ ID NO: 7698) |  |
|  | 3'-AUAAAUAUGUUUUCCGAUGUGUUACAA-5' | (SEQ ID NO: 2153) |  |
| βc-m3291 Target: | 5'-TATTTATACAAAAGGCTACACAATGTT-3' | (SEQ ID NO: 3262) |  |
|  | 5'-CUAUUUAUACAAAAGGCUACACAAUGU-3' | (SEQ ID NO: 7699) |  |
|  | 3'-GAUAAAUAUGUUUUCCGAUGUGUUACA-5' | (SEQ ID NO: 2154) |  |
| βc-m3292 Target: | 5'-CTATTTATACAAAAGGCTACACAATGT-3' | (SEQ ID NO: 3263) |  |
|  | 5'-UGUCUAUUUAUACAAAAGGCUACACAA-3' | (SEQ ID NO: 7700) |  |
|  | 3'-ACAGAUAAAUAUGUUUUCCGAUGUGUU-5' | (SEQ ID NO: 2155) |  |
| βc-m3295 Target: | 5'-TGTCTATTTATACAAAAGGCTACACA-3' | (SEQ ID NO: 3264) |  |
|  | 5'-CUGUCUAUUUAUACAAAAGGCUACACA-3' | (SEQ ID NO: 7701) |  |
|  | 3'-GACAGAUAAAUAUGUUUUCCGAUGUGU-5' | (SEQ ID NO: 2156) |  |
| βc-m3296 Target: | 5'-CTGTCTATTTATACAAAAGGCTACACA-3' | (SEQ ID NO: 3265) |  |
|  | 5'-UCUGUCUAUUUAUACAAAAGGCUACAC-3' | (SEQ ID NO: 7702) |  |
|  | 3'-AGACAGAUAAAUAUGUUUUCCGAUGUG-5' | (SEQ ID NO: 2157) |  |
| βc-m3297 Target: | 5'-TCTGTCTATTTATACAAAAGGCTACAC-3' | (SEQ ID NO: 3266) |  |
|  | 5'-UUUCUAUCUGUCUAUUUAUACAAAAGG-3' | (SEQ ID NO: 7703) |  |
|  | 3'-AAAGAUAGACAGAUAAAUAUGUUUUCC-5' | (SEQ ID NO: 2158) |  |
| βc-m3303 Target: | 5'-TTTCTATCTGTCTATTTATACAAAAGG-3' | (SEQ ID NO: 3267) |  |
|  | 5'-AUUUCUAUCUGUCUAUUUAUACAAAAG-3' | (SEQ ID NO: 7704) |  |
|  | 3'-UAAAGAUAGACAGAUAAAUAUGUUUUC-5' | (SEQ ID NO: 2159) |  |
| βc-m3304 Target: | 5'-ATTTCTATCTGTCTATTTATACAAAAG-3' | (SEQ ID NO: 3268) |  |
|  | 5'-CAUUUCUAUCUGUCUAUUUAUACAAAA-3' | (SEQ ID NO: 7705) |  |
|  | 3'-GUAAAGAUAGACAGAUAAAUAUGUUUU-5' | (SEQ ID NO: 2160) |  |
| βc-m3305 Target: | 5'-CATTTCTATCTGTCTATTTATACAAAA-3' | (SEQ ID NO: 3269) |  |
|  | 5'-CCAUUUCUAUCUGUCUAUUUAUACAAA-3' | (SEQ ID NO: 7706) |  |
|  | 3'-GGUAAAGAUAGACAGAUAAAUAUGUUU-5' | (SEQ ID NO: 2161) |  |
| βc-m3306 Target: | 5'-CCATTTCTATCTGTCTATTTATACAAA-3' | (SEQ ID NO: 3270) |  |
|  | 5'-CGGACCAUUUCUAUCUGUCUAUUUAUA-3' | (SEQ ID NO: 7707) |  |
|  | 3'-GCCUGGUAAAGAUAGACAGAUAAAUAU-5' | (SEQ ID NO: 2162) |  |
| βc-m3310 Target: | 5'-CGGACCATTTCTATCTGTCTATTTATA-3' | (SEQ ID NO: 3271) |  |
|  | 5'-UCGGACCAUUUCUAUCUGUCUAUUUAU-3' | (SEQ ID NO: 7708) |  |
|  | 3'-AGCCUGGUAAAGAUAGACAGAUAAAUA-5' | (SEQ ID NO: 2163) |  |
| βc-m3311 Target: | 5'-TCGGACCATTTCTATCTGTCTATTTAT-3' | (SEQ ID NO: 3272) |  |
|  | 5'-AAACUAAUCGGACCAUUUCUAUCUGUC-3' | (SEQ ID NO: 7709) |  |
|  | 3'-UUUGAUUAGCCUGGUAAAGAUAGACAG-5' | (SEQ ID NO: 2164) |  |
| βc-m3318 Target: | 5'-AAACTAATCGGACCATTTCTATCTGTC-3' | (SEQ ID NO: 3273) |  |
|  | 5'-GAAACUAAUCGGACCAUUUCUAUCUGU-3' | (SEQ ID NO: 7710) |  |
|  | 3'-CUUUGAUUAGCCUGGUAAAGAUAGACA-5' | (SEQ ID NO: 2165) |  |
| βc-m3319 Target: | 5'-GAAACTAATCGGACCATTTCTATCTGT-3' | (SEQ ID NO: 3274) |  |

TABLE 13-continued

Additional Selected Anti-β-catenin DsiRNAs, Blunt, Unfrayed Duplexes

|  |  |  |  |
|---|---|---|---|
|  | 5'-GGAAACUAAUCGGACCAUUUCUAUCUG-3' | (SEQ ID NO: 7711) |  |
|  | 3'-CCUUUGAUUAGCCUGGUAAAGAUAGAC-5' | (SEQ ID NO: 2166) |  |
| βc-m3320 Target: | 5'-GGAAACTAATCGGACCATTTCTATCTG-3' | (SEQ ID NO: 3275) |  |
|  | 5'-AGGAAACUAAUCGGACCAUUUCUAUCU-3' | (SEQ ID NO: 7712) |  |
|  | 3'-UCCUUUGAUUAGCCUGGUAAAGAUAGA-5' | (SEQ ID NO: 2167) |  |
| βc-m3321 Target: | 5'-AGGAAACTAATCGGACCATTTCTATCT-3' | (SEQ ID NO: 3276) |  |
|  | 5'-AUUAAAAGGAAACUAAUCGGACCAUU-3' | (SEQ ID NO: 7713) |  |
|  | 3'-UAAUUUUCCUUUGAUUAGCCUGGUAA-5' | (SEQ ID NO: 2168) |  |
| βc-m3328 Target: | 5'-ATTAAAAGGAAACTAATCGGACCATT-3' | (SEQ ID NO: 3277) |  |
|  | 5'-AAGCAUAUUAAAAGGAAACUAAUCGG-3' | (SEQ ID NO: 7714) |  |
|  | 3'-UUCGUAUAAUUUUCCUUUGAUUAGCC-5' | (SEQ ID NO: 2169) |  |
| βc-m3334 Target: | 5'-AAGCATATTAAAAGGAAACTAATCGG-3' | (SEQ ID NO: 3278) |  |
|  | 5'-UAAGCAUAUUAAAAGGAAACUAAUCG-3' | (SEQ ID NO: 7715) |  |
|  | 3'-AUUCGUAUAAUUUUCCUUUGAUUAGC-5' | (SEQ ID NO: 2170) |  |
| βc-m3335 Target: | 5'-TAAGCATATTAAAAGGAAACTAATCG-3' | (SEQ ID NO: 3279) |  |
|  | 5'-AUUUUAAGCAUAUUAAAAGGAAACUA-3' | (SEQ ID NO: 7716) |  |
|  | 3'-UAAAAUUCGUAUAAUUUUCCUUUGAU-5' | (SEQ ID NO: 2171) |  |
| βc-m3339 Target: | 5'-ATTTTAAGCATATTAAAAGGAAACTA-3' | (SEQ ID NO: 3280) |  |
|  | 5'-CUGCUUAUUUUAAGCAUAUUAAAAGG-3' | (SEQ ID NO: 7717) |  |
|  | 3'-GACGAAUAAAAUUCGUAUAAUUUUCC-5' | (SEQ ID NO: 2172) |  |
| βc-m3345 Target: | 5'-CTGCTTATTTTAAGCATATTAAAAGG-3' | (SEQ ID NO: 3281) |  |
|  | 5'-CCUGCUUAUUUUAAGCAUAUUAAAAG-3' | (SEQ ID NO: 7718) |  |
|  | 3'-GGACGAAUAAAAUUCGUAUAAUUUUC-5' | (SEQ ID NO: 2173) |  |
| βc-m3346 Target: | 5'-CCTGCTTATTTTAAGCATATTAAAAG-3' | (SEQ ID NO: 3282) |  |
|  | 5'-GAUCCACCUGCUUAUUUUAAGCAUAUU-3' | (SEQ ID NO: 7719) |  |
|  | 3'-CUAGGUGGACGAAUAAAAUUCGUAUAA-5' | (SEQ ID NO: 2174) |  |
| βc-m3352 Target: | 5'-GATCCACCTGCTTATTTTAAGCATATT-3' | (SEQ ID NO: 3283) |  |
|  | 5'-CAAAAACAUGAAAUAGAUCCACCUGCU-3' | (SEQ ID NO: 7720) |  |
|  | 3'-GUUUUUGUACUUUAUCUAGGUGGACGA-5' | (SEQ ID NO: 2175) |  |
| βc-m3367 Target: | 5'-CAAAAACATGAAATAGATCCACCTGCT-3' | (SEQ ID NO: 3284) |  |
|  | 5'-UCAAAAACAUGAAAUAGAUCCACCUGC-3' | (SEQ ID NO: 7721) |  |
|  | 3'-AGUUUUUGUACUUUAUCUAGGUGGACG-5' | (SEQ ID NO: 2176) |  |
| βc-m3368 Target: | 5'-TCAAAAACATGAAATAGATCCACCTGC-3' | (SEQ ID NO: 3285) |  |
|  | 5'-GUUCAAAAACAUGAAAUAGAUCCACCU-3' | (SEQ ID NO: 7722) |  |
|  | 3'-CAAGUUUUUGUACUUUAUCUAGGUGGA-5' | (SEQ ID NO: 2177) |  |
| βc-m3370 Target: | 5'-GTTCAAAAACATGAAATAGATCCACCT-3' | (SEQ ID NO: 3286) |  |
|  | 5'-UGUUCAAAAACAUGAAAUAGAUCCACC-3' | (SEQ ID NO: 7723) |  |
|  | 3'-ACAAGUUUUUGUACUUUAUCUAGGUGG-5' | (SEQ ID NO: 2178) |  |
| βc-m3371 Target: | 5'-TGTTCAAAAACATGAAATAGATCCACC-3' | (SEQ ID NO: 3287) |  |

TABLE 13-continued

Additional Selected Anti-β-catenin DsiRNAs, Blunt, Unfrayed Duplexes

|  |  |  |  |
|---|---|---|---|
|  | 5'-UUGUUCAAAAACAUGAAAUAGAUCCAC-3' | (SEQ ID NO: 7724) |
|  | 3'-AACAAGUUUUUGUACUUUAUCUAGGUG-5' | (SEQ ID NO: 2179) |
| βc-m3372 Target: | 5'-TTGTTCAAAAACATGAAATAGATCCAC-3' | (SEQ ID NO: 3288) |
|  | 5'-AGUUUUUGUUCAAAAACAUGAAAUAGA-3' | (SEQ ID NO: 7725) |
|  | 3'-UCAAAAACAAGUUUUUGUACUUUAUCU-5' | (SEQ ID NO: 2180) |
| βc-m3377 Target: | 5'-AGTTTTTGTTCAAAAACATGAAATAGA-3' | (SEQ ID NO: 3289) |
|  | 5'-CGAUAAAGUUUUUGUUCAAAAACAUGA-3' | (SEQ ID NO: 7726) |
|  | 3'-GCUAUUUCAAAAACAAGUUUUUGUACU-5' | (SEQ ID NO: 2181) |
| βc-m3383 Target: | 5'-CGATAAAGTTTTTGTTCAAAAACATGA-3' | (SEQ ID NO: 3290) |
|  | 5'-UAUCCCCGAUAAAGUUUUUGUUCAAAA-3' | (SEQ ID NO: 7727) |
|  | 3'-AUAGGGGCUAUUUCAAAAACAAGUUUU-5' | (SEQ ID NO: 2182) |
| βc-m3389 Target: | 5'-TATCCCCGATAAAGTTTTTGTTCAAAA-3' | (SEQ ID NO: 3291) |
|  | 5'-GUAUCCCCGAUAAAGUUUUUGUUCAAA-3' | (SEQ ID NO: 7728) |
|  | 3'-CAUAGGGGCUAUUUCAAAAACAAGUUU-5' | (SEQ ID NO: 2183) |
| βc-m3390 Target: | 5'-GTATCCCCGATAAAGTTTTTGTTCAAA-3' | (SEQ ID NO: 3292) |
|  | 5'-ACACCUCUUACUGAUUUACCCUACCGC-3' | (SEQ ID NO: 7729) |
|  | 3'-UGUGGAGAAUGACUAAAUGGGAUGGCG-5' | (SEQ ID NO: 2184) |
| βc-m3419 Target: | 5'-ACACCTCTTACTGATTTACCCTACCGC-3' | (SEQ ID NO: 3293) |
|  | 5'-UAACACCUCUUACUGAUUUACCCUACC-3' | (SEQ ID NO: 7730) |
|  | 3'-AUUGUGGAGAAUGACUAAAUGGGAUGG-5' | (SEQ ID NO: 2185) |
| βc-m3421 Target: | 5'-TAACACCTCTTACTGATTTACCCTACC-3' | (SEQ ID NO: 3294) |
|  | 5'-AUAACACCUCUUACUGAUUUACCCUAC-3' | (SEQ ID NO: 7731) |
|  | 3'-UAUUGUGGAGAAUGACUAAAUGGGAUG-5' | (SEQ ID NO: 2186) |
| βc-m3422 Target: | 5'-ATAACACCTCTTACTGATTTACCCTAC-3' | (SEQ ID NO: 3295) |
|  | 5'-AAUAACACCUCUUACUGAUUUACCCUA-3' | (SEQ ID NO: 7732) |
|  | 3'-UUAUUGUGGAGAAUGACUAAAUGGGAU-5' | (SEQ ID NO: 2187) |
| βc-m3423 Target: | 5'-AATAACACCTCTTACTGATTTACCCTA-3' | (SEQ ID NO: 3296) |
|  | 5'-AAAUAACACCUCUUACUGAUUUACCCU-3' | (SEQ ID NO: 7733) |
|  | 3'-UUUAUUGUGGAGAAUGACUAAAUGGGA-5' | (SEQ ID NO: 2188) |
| βc-m3424 Target: | 5'-AAATAACACCTCTTACTGATTTACCCT-3' | (SEQ ID NO: 3297) |
|  | 5'-CAAAUAACACCUCUUACUGAUUUACCC-3' | (SEQ ID NO: 7734) |
|  | 3'-GUUUAUUGUGGAGAAUGACUAAAUGGG-5' | (SEQ ID NO: 2189) |
| βc-m3425 Target: | 5'-CAAATAACACCTCTTACTGATTTACCC-3' | (SEQ ID NO: 3298) |
|  | 5'-AAGGCUCAAAUAACACCUCUUACUGAU-3' | (SEQ ID NO: 7735) |
|  | 3'-UUCCGAGUUUAUUGUGGAGAAUGACUA-5' | (SEQ ID NO: 2190) |
| βc-m3431 Target: | 5'-AAGGCTCAAATAACACCTCTTACTGAT-3' | (SEQ ID NO: 3299) |
|  | 5'-AAAACAAGGCUCAAAUAACACCUCUUA-3' | (SEQ ID NO: 7736) |
|  | 3'-UUUUGUUCCGAGUUUAUUGUGGAGAAU-5' | (SEQ ID NO: 2191) |
| βc-m3436 Target: | 5'-AAAACAAGGCTCAAATAACACCTCTTA-3' | (SEQ ID NO: 3300) |

TABLE 13-continued

Additional Selected Anti-β-catenin DsiRNAs, Blunt, Unfrayed Duplexes

|  |  |  |
|---|---|---|
|  | 5'-CAAAACAAGGCUCAAAUAACACCUCUU-3' | (SEQ ID NO: 7737) |
|  | 3'-GUUUUGUUCCGAGUUUAUUGUGGAGAA-5' | (SEQ ID NO: 2192) |
| βc-m3437 Target: | 5'-CAAAACAAGGCTCAAATAACACCTCTT-3' | (SEQ ID NO: 3301) |
|  | 5'-CCAAAACAAGGCUCAAAUAACACCUCU-3' | (SEQ ID NO: 7738) |
|  | 3'-GGUUUUGUUCCGAGUUUAUUGUGGAGA-5' | (SEQ ID NO: 2193) |
| βc-m3438 Target: | 5'-CCAAAACAAGGCTCAAATAACACCTCT-3' | (SEQ ID NO: 3302) |
|  | 5'-UGUCCAAAACAAGGCUCAAAUAACACC-3' | (SEQ ID NO: 7739) |
|  | 3'-ACAGGUUUUGUUCCGAGUUUAUUGUGG-5' | (SEQ ID NO: 2194) |
| βc-m3441 Target: | 5'-TGTCCAAAACAAGGCTCAAATAACACC-3' | (SEQ ID NO: 3303) |
|  | 5'-ACUGUCCAAAACAAGGCUCAAAUAACA-3' | (SEQ ID NO: 7740) |
|  | 3'-UGACAGGUUUUGUUCCGAGUUUAUUGU-5' | (SEQ ID NO: 2195) |
| βc-m3443 Target: | 5'-ACTGTCCAAAACAAGGCTCAAATAACA-3' | (SEQ ID NO: 3304) |
|  | 5'-GGUAUACUGUCCAAAACAAGGCUCAAA-3' | (SEQ ID NO: 7741) |
|  | 3'-CCAUAUGACAGGUUUUGUUCCGAGUUU-5' | (SEQ ID NO: 2196) |
| βc-m3448 Target: | 5'-GGTATACTGTCCAAAACAAGGCTCAAA-3' | (SEQ ID NO: 3305) |
|  | 5'-AGGCAACUGGUAUACUGUCCAAAACAA-3' | (SEQ ID NO: 7742) |
|  | 3'-UCCGUUGACCAUAUGACAGGUUUUGUU-5' | (SEQ ID NO: 2197) |
| βc-m3456 Target: | 5'-AGGCAACTGGTATACTGTCCAAAACAA-3' | (SEQ ID NO: 3306) |
|  | 5'-GGGAUAAAAGGCAACUGGUAUACUGUC-3' | (SEQ ID NO: 7743) |
|  | 3'-CCCUAUUUUCCGUUGACCAUAUGACAG-5' | (SEQ ID NO: 2198) |
| βc-m3464 Target: | 5'-GGGATAAAAGGCAACTGGTATACTGTC-3' | (SEQ ID NO: 3307) |
|  | 5'-UGGGAUAAAAGGCAACUGGUAUACUGU-3' | (SEQ ID NO: 7744) |
|  | 3'-ACCCUAUUUUCCGUUGACCAUAUGACA-5' | (SEQ ID NO: 2199) |
| βc-m3465 Target: | 5'-TGGGATAAAAGGCAACTGGTATACTGT-3' | (SEQ ID NO: 3308) |
|  | 5'-ACAACUUUGGGAUAAAAGGCAACUGGU-3' | (SEQ ID NO: 7745) |
|  | 3'-UGUUGAAACCCUAUUUUCCGUUGACCA-5' | (SEQ ID NO: 2200) |
| βc-m3472 Target: | 5'-ACAACTTTGGGATAAAAGGCAACTGGT-3' | (SEQ ID NO: 3309) |
|  | 5'-CAACAACUUUGGGAUAAAAGGCAACUG-3' | (SEQ ID NO: 7746) |
|  | 3'-GUUGUUGAAACCCUAUUUUCCGUUGAC-5' | (SEQ ID NO: 2201) |
| βc-m3474 Target: | 5'-CAACAACTTTGGGATAAAAGGCAACTG-3' | (SEQ ID NO: 3310) |
|  | 5'-GGUUACAACAACUUUGGGAUAAAAGGC-3' | (SEQ ID NO: 7747) |
|  | 3'-CCAAUGUUGUUGAAACCCUAUUUUCCG-5' | (SEQ ID NO: 2202) |
| βc-m3479 Target: | 5'-GGTTACAACAACTTTGGGATAAAAGGC-3' | (SEQ ID NO: 3311) |
|  | 5'-AGGUUACAACAACUUUGGGAUAAAAGG-3' | (SEQ ID NO: 7748) |
|  | 3'-UCCAAUGUUGUUGAAACCCUAUUUUCC-5' | (SEQ ID NO: 2203) |
| βc-m3480 Target: | 5'-AGGTTACAACAACTTTGGGATAAAAGG-3' | (SEQ ID NO: 3312) |
|  | 5'-CAGGUUACAACAACUUUGGGAUAAAAG-3' | (SEQ ID NO: 7749) |
|  | 3'-GUCCAAUGUUGUUGAAACCCUAUUUUC-5' | (SEQ ID NO: 2204) |
| βc-m3481 Target: | 5'-CAGGTTACAACAACTTTGGGATAAAAG-3' | (SEQ ID NO: 3313) |

TABLE 13-continued

Additional Selected Anti-β-catenin DsiRNAs, Blunt, Unfrayed Duplexes

|  |  |  |  |
|---|---|---|---|
|  | 5'-UAUCACAGCAGGUUACAACAACUUUGG-3' | (SEQ ID NO: 7750) |
|  | 3'-AUAGUGUCGUCCAAUGUUGUUGAAACC-5' | (SEQ ID NO: 2205) |
| βc-m3489 Target: | 5'-TATCACAGCAGGTTACAACAACTTTGG-3' | (SEQ ID NO: 3314) |
|  | 5'-GUAUCACAGCAGGUUACAACAACUUUG-3' | (SEQ ID NO: 7751) |
|  | 3'-CAUAGUGUCGUCCAAUGUUGUUGAAAC-5' | (SEQ ID NO: 2206) |
| βc-m3490 Target: | 5'-GTATCACAGCAGGTTACAACAACTTTG-3' | (SEQ ID NO: 3315) |
|  | 5'-UUGUAUCACAGCAGGUUACAACAACUU-3' | (SEQ ID NO: 7752) |
|  | 3'-AACAUAGUGUCGUCCAAUGUUGUUGAA-5' | (SEQ ID NO: 2207) |
| βc-m3492 Target: | 5'-TTGTATCACAGCAGGTTACAACAACTT-3' | (SEQ ID NO: 3316) |
|  | 5'-CCGCAUCUGUUGAAGCAUUGUAUCACA-3' | (SEQ ID NO: 7753) |
|  | 3'-GGCGUAGACAACUUCGUAACAUAGUGU-5' | (SEQ ID NO: 2208) |
| βc-m3509 Target: | 5'-CCGCATCTGTTGAAGCATTGTATCACA-3' | (SEQ ID NO: 3317) |
|  | 5'-UCUGAACCAUUUCUAUAACCGCAUCUG-3' | (SEQ ID NO: 7754) |
|  | 3'-AGACUUGGUAAAGAUAUUGGCGUAGAC-5' | (SEQ ID NO: 2209) |
| βc-m3527 Target: | 5'-TCTGAACCATTTCTATAACCGCATCTG-3' | (SEQ ID NO: 3318) |
|  | 5'-UAAUUCUGAACCAUUUCUAUAACCGCA-3' | (SEQ ID NO: 7755) |
|  | 3'-AUUAAGACUUGGUAAAGAUAUUGGCGU-5' | (SEQ ID NO: 2210) |
| βc-m3531 Target: | 5'-TAATTCTGAACCATTTCTATAACCGCA-3' | (SEQ ID NO: 3319) |
|  | 5'-UUUAAUUCUGAACCAUUUCUAUAACCG-3' | (SEQ ID NO: 7756) |
|  | 3'-AAAUUAAGACUUGGUAAAGAUAUUGGC-5' | (SEQ ID NO: 2211) |
| βc-m3533 Target: | 5'-TTTAATTCTGAACCATTTCTATAACCG-3' | (SEQ ID NO: 3320) |
|  | 5'-GUUUAAUUCUGAACCAUUUCUAUAACC-3' | (SEQ ID NO: 7757) |
|  | 3'-CAAAUUAAGACUUGGUAAAGAUAUUGG-5' | (SEQ ID NO: 2212) |
| βc-m3534 Target: | 5'-GTTTAATTCTGAACCATTTCTATAACC-3' | (SEQ ID NO: 3321) |
|  | 5'-AGUUUAAUUCUGAACCAUUUCUAUAAC-3' | (SEQ ID NO: 7758) |
|  | 3'-UCAAAUUAAGACUUGGUAAAGAUAUUG-5' | (SEQ ID NO: 2213) |
| βc-m3535 Target: | 5'-AGTTTAATTCTGAACCATTTCTATAAC-3' | (SEQ ID NO: 3322) |
|  | 5'-AAGUUUAAUUCUGAACCAUUUCUAUAA-3' | (SEQ ID NO: 7759) |
|  | 3'-UUCAAAUUAAGACUUGGUAAAGAUAUU-5' | (SEQ ID NO: 2214) |
| βc-m3536 Target: | 5'-AAGTTTAATTCTGAACCATTTCTATAA-3' | (SEQ ID NO: 3323) |
|  | 5'-AUUAAAAGUUUAAUUCUGAACCAUUUC-3' | (SEQ ID NO: 7760) |
|  | 3'-UAAUUUUCAAAUUAAGACUUGGUAAAG-5' | (SEQ ID NO: 2215) |
| βc-m3541 Target: | 5'-ATTAAAAGTTTAATTCTGAACCATTTC-3' | (SEQ ID NO: 3324) |
|  | 5'-AAUUAAAAGUUUAAUUCUGAACCAUUU-3' | (SEQ ID NO: 7761) |
|  | 3'-UUAAUUUUCAAAUUAAGACUUGGUAAA-5' | (SEQ ID NO: 2216) |
| βc-m3542 Target: | 5'-AATTAAAAGTTTAATTCTGAACCATTT-3' | (SEQ ID NO: 3325) |
|  | 5'-UGAAUUAAAAGUUUAAUUCUGAACCAU-3' | (SEQ ID NO: 7762) |
|  | 3'-ACUUAAUUUUCAAAUUAAGACUUGGUA-5' | (SEQ ID NO: 2217) |
| βc-m3544 Target: | 5'-TGAATTAAAAGTTTAATTCTGAACC-3' | (SEQ ID NO: 3326) |

TABLE 13-continued

Additional Selected Anti-β-catenin DsiRNAs, Blunt, Unfrayed Duplexes

|  |  |  |  |
|---|---|---|---|
|  | 5'-UUUGAAUGAAUUAAAAGUUUAAUUCUG-3' | (SEQ ID NO: 7763) |  |
|  | 3'-AAACUUACUUAAUUUUCAAAUUAAGAC-5' | (SEQ ID NO: 2218) |  |
| βc-m3550 Target: | 5'-TTTGAATGAATTAAAAGTTTAATTCTG-3' | (SEQ ID NO: 3327) |  |
|  | 5'-UUUUUUUGAAUGAAUUAAAAGUUUAAU-3' | (SEQ ID NO: 7764) |  |
|  | 3'-AAAAAAACUUACUUAAUUUUCAAAUUA-5' | (SEQ ID NO: 2219) |  |
| βc-m3554 Target: | 5'-TTTTTTTGAATGAATTAAAAGTTTAAT-3' | (SEQ ID NO: 3328) |  |
|  | 5'-UUUUUUUUUUUGAAUGAAUUAAAAGUU-3' | (SEQ ID NO: 7765) |  |
|  | 3'-AAAAAAAAAAACUUACUUAAUUUUCAA-5' | (SEQ ID NO: 2220) |  |
| βc-m3558 Target: | 5'-TTTTTTTTTTGAATGAATTAAAAGTT-3' | (SEQ ID NO: 3329) |  |
|  | 5'-UUUUUUUUUUUUGAAUGAAUUAAAAGU-3' | (SEQ ID NO: 7766) |  |
|  | 3'-AAAAAAAAAAAACUUACUUAAUUUUCA-5' | (SEQ ID NO: 2221) |  |
| βc-m3559 Target: | 5'-TTTTTTTTTTTGAATGAATTAAAAGT-3' | (SEQ ID NO: 3330) |  |
|  | 5'-UUUUUUUUUUUUUGAAUGAAUUAAAAG-3' | (SEQ ID NO: 7767) |  |
|  | 3'-AAAAAAAAAAAAACUUACUUAAUUUUC-5' | (SEQ ID NO: 2222) |  |
| βc-m3560 Target: | 5'-TTTTTTTTTTTTGAATGAATTAAAAG-3' | (SEQ ID NO: 3331) |  |
|  | 5'-UUUUUUUUUUUUUUGAAUGAAUUAAAA-3' | (SEQ ID NO: 7768) |  |
|  | 3'-AAAAAAAAAAAAAACUUACUUAAUUUU-5' | (SEQ ID NO: 2223) |  |
| βc-m3561 Target: | 5'-TTTTTTTTTTTTTGAATGAATTAAAA-3' | (SEQ ID NO: 3332) |  |
|  | 5'-UUUUUUUUUUUUUUUGAAUGAAUUAAA-3' | (SEQ ID NO: 7769) |  |
|  | 3'-AAAAAAAAAAAAAAACUUACUUAAUUU-5' | (SEQ ID NO: 2224) |  |
| βc-m3562 Target: | 5'-TTTTTTTTTTTTTTGAATGAATTAAA-3' | (SEQ ID NO: 3333) |  |
|  | 5'-UUUUUUUUUUUUUUUUGAAUGAAUUAA-3' | (SEQ ID NO: 7770) |  |
|  | 3'-AAAAAAAAAAAAAAAACUUACUUAAUU-5' | (SEQ ID NO: 2225) |  |
| βc-m3563 Target: | 5'-TTTTTTTTTTTTTTTGAATGAATTAA-3' | (SEQ ID NO: 3334) |  |

Within Tables 2-4 and 9 above, underlined residues indicate 2'-O-methyl residues. In Tables 2-4, 6-9 and 11-13 above, UPPER CASE indicates ribonucleotides, and lower case denotes deoxyribonucleotides. The DsiRNA agents of Tables 2-4 and 9 above are 25/27mer agents possessing a blunt end. The structures and/or modification patterning of the agents of Tables 2-4, 6, 9 and 11 above can be readily adapted to the above generic sequence structures, e.g., the 3' overhang of the second strand can be extended or contracted, 2'-O-methylation of the second strand can be expanded towards the 5' end of the second strand, optionally at alternating sites, etc. Such further modifications are optional, as 25/27mer DsiRNAs with such modifications can also be readily designed from the above DsiRNA agents and are also expected to be functional inhibitors of β-catenin expression. Similarly, the 27mer "blunt/fray" and "blunt/blunt" DsiRNA structures and/or modification patterns of the agents of Tables 7-8 and 12-13 above can also be readily adapted to the above generic sequence structures, e.g., for application of modification patterning of the antisense strand to such structures and/or adaptation of such sequences to the above generic structures.

In certain embodiments, 27mer DsiRNAs possessing independent strand lengths each of 27 nucleotides are designed and synthesized for targeting of the same sites within the β-catenin transcript as the asymmetric "25/27" structures shown in Tables 2-4, 6, 9 and 11 herein. Exemplary "27/27" DsiRNAs are optionally designed with a "blunt/fray" structure as shown for the DsiRNAs of Tables 7 and 12 above, or with a "blunt/blunt" structure as shown for the DsiRNAs of Tables 8 and 13 above.

In certain embodiments, the DsiRNA agents of the invention require, e.g., at least 19, at least 20, at least 21, at least 22, at least 23, at least 24, at least 25 or at least 26 residues of the first strand to be complementary to corresponding residues of the second strand. In certain related embodiments, these first strand residues complementary to corresponding residues of the second strand are optionally consecutive residues.

As used herein "DsiRNAmm" refers to a DisRNA having a "mismatch tolerant region" containing one, two, three or four mismatched base pairs of the duplex formed by the sense and antisense strands of the DsiRNA, where such mismatches are positioned within the DsiRNA at a location(s) lying between (and thus not including) the two terminal base pairs of either end of the DsiRNA. The mismatched base pairs are located within a "mismatch-tolerant region" which is defined herein with respect to the location of the projected Ago2 cut site of the corresponding target nucleic acid. The mismatch tolerant region is located "upstream of" the projected Ago2 cut site of the target strand. "Upstream" in this context will be understood as the 5'-most portion of the DsiRNAmm duplex, where 5' refers to the orientation of the sense strand of the DsiRNA duplex. Therefore, the mismatch tolerant region is upstream of the base on the sense (passenger) strand that corresponds to the projected Ago2 cut site of the target nucleic acid (see FIG. 1); alternatively, when referring to the antisense (guide) strand of the DsiRNAmm, the mismatch tolerant region can also be described as positioned downstream of the base that is complementary to the projected Ago2 cut site of the target nucleic acid, that is, the 3'-most portion of the antisense strand of the DsiRNAmm (where position 1 of the antisense strand is the 5' terminal nucleotide of the antisense strand, see FIG. 1).

In one embodiment, for example with numbering as depicted in FIG. 1, the mismatch tolerant region is positioned between and including base pairs 3-9 when numbered from the nucleotide starting at the 5' end of the sense strand of the duplex. Therefore, a DsiRNAmm of the invention possesses a single mismatched base pair at any one of positions 3, 4, 5, 6, 7, 8 or 9 of the sense strand of a right-hand extended DsiRNA (where position 1 is the 5' terminal nucleotide of the sense strand and position 9 is the nucleotide residue of the sense strand that is immediately 5' of the projected Ago2 cut site of the target β-catenin RNA sequence corresponding to the sense strand sequence). In certain embodiments, for a DsiRNAmm that possesses a mismatched base pair nucleotide at any of positions 3, 4, 5, 6, 7, 8 or 9 of the sense strand, the corresponding mismatched base pair nucleotide of the antisense strand not only forms a mismatched base pair with the DsiRNAmm sense strand sequence, but also forms a mismatched base pair with a DsiRNAmm target β-catenin RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target (β-catenin RNA sequence). In alternative embodiments, the mismatch base pair nucleotide of the antisense strand of a DsiRNAmm only form a mismatched base pair with a corresponding nucleotide of the sense strand sequence of the DsiRNAmm, yet base pairs with its corresponding target β-catenin RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target β-catenin RNA sequence).

A DsiRNAmm of the invention that possesses a single mismatched base pair within the mismatch-tolerant region (mismatch region) as described above (e.g., a DsiRNAmm harboring a mismatched nucleotide residue at any one of positions 3, 4, 5, 6, 7, 8 or 9 of the sense strand) can further include one, two or even three additional mismatched base pairs. In preferred embodiments, these one, two or three additional mismatched base pairs of the DsiRNAmm occur at position(s) 3, 4, 5, 6, 7, 8 and/or 9 of the sense strand (and at corresponding residues of the antisense strand). In one embodiment where one additional mismatched base pair is present within a DsiRNAmm, the two mismatched base pairs of the sense strand can occur, e.g., at nucleotides of both position 4 and position 6 of the sense strand (with mismatch also occurring at corresponding nucleotide residues of the antisense strand).

In DsiRNAmm agents possessing two mismatched base pairs, mismatches can occur consecutively (e.g., at consecutive positions along the sense strand nucleotide sequence). Alternatively, nucleotides of the sense strand that form mismatched base pairs with the antisense strand sequence can be interspersed by nucleotides that base pair with the antisense strand sequence (e.g., for a DsiRNAmm possessing mismatched nucleotides at positions 3 and 6, but not at positions 4 and 5, the mismatched residues of sense strand positions 3 and 6 are interspersed by two nucleotides that form matched base pairs with corresponding residues of the antisense strand). For example, two residues of the sense strand (located within the mismatch-tolerant region of the sense strand) that form mismatched base pairs with the corresponding antisense strand sequence can occur with zero, one, two, three, four or five matched base pairs located between these mismatched base pairs.

For certain DsiRNAmm agents possessing three mismatched base pairs, mismatches can occur consecutively (e.g., in a triplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 4 and 8, but not at positions 5, 6 and 7, the mismatched residues of sense strand positions 3 and 4 are adjacent to one another, while the mismatched residues of sense strand positions 4 and 8 are interspersed by three nucleotides that form matched base pairs with corresponding residues of the antisense strand). For example, three residues of the sense strand (located within the mismatch-tolerant region of the sense strand) that form mismatched base pairs with the corresponding antisense strand sequence can occur with zero, one, two, three or four matched base pairs located between any two of these mismatched base pairs.

For certain DsiRNAmm agents possessing four mismatched base pairs, mismatches can occur consecutively (e.g., in a quadruplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 5, 7 and 8, but not at positions 4 and 6, the mismatched residues of sense strand positions 7 and 8 are adjacent to one another, while the mismatched residues of sense strand positions 3 and 5 are interspersed by one nucleotide that forms a matched base pair with the corresponding residue of the antisense strand—similarly, the mismatched residues of sense strand positions 5 and 7 are also interspersed by one nucleotide that forms a matched base pair with the corresponding residue of the antisense strand). For example, four residues of the sense strand (located within the mismatch-tolerant region of the sense strand) that form mismatched base pairs with the corresponding antisense strand sequence can occur with zero, one, two or three matched base pairs located between any two of these mismatched base pairs.

In another embodiment, for example with numbering also as depicted in FIG. 1, a DsiRNAmm of the invention comprises a mismatch tolerant region which possesses a single mismatched base pair nucleotide at any one of positions 17, 18, 19, 20, 21, 22 or 23 of the antisense strand of the DsiRNA (where position 1 is the 5' terminal nucleotide of the antisense strand and position 17 is the nucleotide residue of the antisense strand that is immediately 3' (downstream) in the antisense strand of the projected Ago2 cut site of the target β-catenin RNA sequence sufficiently complementary to the antisense strand sequence). In certain embodiments, for a DsiRNAmm that possesses a mismatched base pair nucleotide at any of positions 17, 18, 19, 20, 21, 22 or 23 of the antisense strand with respect to the sense strand of the DsiRNAmm, the mismatched base pair nucleotide of the antisense strand not only forms a mismatched base pair with the DsiRNAmm sense strand sequence, but also forms a mismatched base pair with a DsiRNAmm target β-catenin RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target (β-catenin RNA sequence). In alternative embodiments, the mismatch base pair nucleotide of the antisense strand of a DsiRNAmm only forms a mismatched base pair with a corresponding nucleotide of the sense strand sequence of the DsiRNAmm, yet base pairs with its corresponding target β-catenin RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target β-catenin RNA sequence).

A DsiRNAmm of the invention that possesses a single mismatched base pair within the mismatch-tolerant region as described above (e.g., a DsiRNAmm harboring a mismatched nucleotide residue at positions 17, 18, 19, 20, 21, 22 or 23 of the antisense strand) can further include one, two or even three additional mismatched base pairs. In preferred embodiments, these one, two or three additional mismatched base pairs of the DsiRNAmm occur at position(s) 17, 18, 19, 20, 21, 22 and/or 23 of the antisense strand (and at corresponding residues of the sense strand). In one embodiment where one additional mismatched base pair is present within a DsiRNAmm, the two mismatched base pairs of the antisense strand can occur, e.g., at nucleotides of both position 18 and position 20 of the antisense strand (with mismatch also occurring at corresponding nucleotide residues of the sense strand).

In DsiRNAmm agents possessing two mismatched base pairs, mismatches can occur consecutively (e.g., at consecutive positions along the antisense strand nucleotide sequence). Alternatively, nucleotides of the antisense strand that form mismatched base pairs with the sense strand sequence can be interspersed by nucleotides that base pair with the sense strand sequence (e.g., for a DsiRNAmm possessing mismatched nucleotides at positions 17 and 20, but not at positions 18 and 19, the mismatched residues of antisense strand positions 17 and 20 are interspersed by two nucleotides that form matched base pairs with corresponding residues of the sense strand). For example, two residues of the antisense strand (located within the mismatch-tolerant region of the sense strand) that form mismatched base pairs with the corresponding sense strand sequence can occur with zero, one, two, three, four, five, six or seven matched base pairs located between these mismatched base pairs.

For certain DsiRNAmm agents possessing three mismatched base pairs, mismatches can occur consecutively (e.g., in a triplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 17, 18 and 22, but not at positions 19, 20 and 21, the mismatched residues of antisense strand positions 17 and 18 are adjacent to one another, while the mismatched residues of antisense strand positions 18 and 122 are interspersed by three nucleotides that form matched base pairs with corresponding residues of the sense strand). For example, three residues of the antisense strand (located within the mismatch-tolerant region of the antisense strand) that form mismatched base pairs with the corresponding sense strand sequence can occur with zero, one, two, three, four, five or six matched base pairs located between any two of these mismatched base pairs.

For certain DsiRNAmm agents possessing four mismatched base pairs, mismatches can occur consecutively (e.g., in a quadruplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 18, 20, 22 and 23, but not at positions 19 and 21, the mismatched residues of antisense strand positions 22 and 23 are adjacent to one another, while the mismatched residues of antisense strand positions 18 and 20 are interspersed by one nucleotide that forms a matched base pair with the corresponding residue of the sense strand—similarly, the mismatched residues of antisense strand positions 20 and 22 are also interspersed by one nucleotide that forms a matched base pair with the corresponding residue of the sense strand). For example, four residues of the antisense strand (located within the mismatch-tolerant region of the antisense strand) that form mismatched base pairs with the corresponding sense strand sequence can occur with zero, one, two, three, four or five matched base pairs located between any two of these mismatched base pairs.

For reasons of clarity, the location(s) of mismatched nucleotide residues within the above DsiRNAmm agents are numbered in reference to the 5' terminal residue of either sense or antisense strands of the DsiRNAmm. The numbering of positions located within the mismatch-tolerant region (mismatch region) of the antisense strand can shift with variations in the proximity of the 5' terminus of the sense or antisense strand to the projected Ago2 cleavage site. Thus, the location(s) of preferred mismatch sites within either antisense strand or sense strand can also be identified as the permissible proximity of such mismatches to the projected Ago2 cut site. Accordingly, in one preferred embodiment, the position of a mismatch nucleotide of the sense strand of a DsiRNAmm is the nucleotide residue of the sense strand that is located immediately 5' (upstream) of the projected Ago2 cleavage site of the corresponding target β-catenin RNA sequence. In other preferred embodiments, a mismatch nucleotide of the sense strand of a DsiRNAmm is positioned at the nucleotide residue of the sense strand that is located two nucleotides 5' (upstream) of the projected Ago2 cleavage site, three nucleotides 5' (upstream) of the projected Ago2 cleavage site, four nucleotides 5' (upstream) of the projected Ago2 cleavage site, five nucleotides 5' (upstream) of the projected Ago2 cleavage site, six nucleotides 5' (upstream) of the projected Ago2 cleavage site, seven nucleotides 5' (upstream) of the projected Ago2 cleavage site, eight nucleotides 5' (upstream) of the projected Ago2 cleavage site, or nine nucleotides 5' (upstream) of the projected Ago2 cleavage site.

Exemplary single mismatch-containing 25/27mer DsiRNAs (DsiRNAmm) include the following structures (such mismatch-containing structures may also be incorporated into other exemplary DsiRNA structures shown herein).

```
5'-XX^MXXXXXXXXXXXXXXXXXXXXXDD-3'

3'-XXXX_MXXXXXXXXXXXXXXXXXXXXXXX-5'

5'-XXX^MXXXXXXXXXXXXXXXXXXXXDD-3'

3'-XXXXX_MXXXXXXXXXXXXXXXXXXXXXXX-5'

5'-XXXX^MXXXXXXXXXXXXXXXXXXXDD-3'

3'-XXXXXX_MXXXXXXXXXXXXXXXXXXXXXXX-5'

5'-XXXXX^MXXXXXXXXXXXXXXXXXXDD-3'

3'-XXXXXXX_MXXXXXXXXXXXXXXXXXXXXXXX-5'

5'-XXXXXX^MXXXXXXXXXXXXXXXXXDD-3'

3'-XXXXXXXX_MXXXXXXXXXXXXXXXXXXXXXXX-5'

5'-XXXXXXX^MXXXXXXXXXXXXXXXXDD-3'

3'-XXXXXXXXX_MXXXXXXXXXXXXXXXXXXXXXXX-5'

5'-XXXXXXXX^MXXXXXXXXXXXXXXXDD-3'

3'-XXXXXXXXXX_MXXXXXXXXXXXXXXXXXXXXXXX-5'
``` wherein "X"=RNA, "D"=DNA and "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNAmm agents. For the above mismatch structures, the top strand is the sense strand, and the bottom strand is the antisense strand.

In certain embodiments, a DsiRNA of the invention can contain mismatches that exist in reference to the target β-catenin RNA sequence yet do not necessarily exist as mismatched base pairs within the two strands of the DsiRNA—thus, a DsiRNA can possess perfect complementarity between first and second strands of a DsiRNA, yet still possess mismatched residues in reference to a target β-catenin RNA (which, in certain embodiments, may be advantageous in promoting efficacy and/or potency and/or duration of effect). In certain embodiments, where mismatches occur between antisense strand and target β-catenin RNA sequence, the position of a mismatch is located within the antisense strand at a position(s) that corresponds to a sequence of the sense strand located 5' of the projected Ago2 cut site of the target region—e.g., antisense strand residue(s) positioned within the antisense strand to the 3' of the antisense residue which is complementary to the projected Ago2 cut site of the target sequence.

Exemplary 25/27mer DsiRNAs that harbor a single mismatched residue in reference to target sequences include the following structures.

```
Target RNA Sequence:       5'-...AXXXXXXXXXXXXXXXXXXXXX...-3'
DsiRNAmm Sense Strand:     5'-XXXXXXXXXXXXXXXXXXXXXXXDD-3'
DsiRNAmm Antisense Strand: 3'-EXXXXXXXXXXXXXXXXXXXXXXXXX-5'

Target RNA Sequence:       5'-...XAXXXXXXXXXXXXXXXXXXXX...-3'
DsiRNAmm Sense Strand:     5'-XXXXXXXXXXXXXXXXXXXXXXXDD-3'
DsiRNAmm Antisense Strand: 3'-XEXXXXXXXXXXXXXXXXXXXXXXXX-5'

Target RNA Sequence:       5'-...AXXXXXXXXXXXXXXXXXXXX...-3'
DsiRNAmm Sense Strand:     5'-BXXXXXXXXXXXXXXXXXXXXXXDD-3'
DsiRNAmm Antisense Strand: 3'-XXEXXXXXXXXXXXXXXXXXXXXXXXX-5'

Target RNA Sequence:       5'-...XAXXXXXXXXXXXXXXXXXXX...-3'
DsiRNAmm Sense Strand:     5'-XBXXXXXXXXXXXXXXXXXXXXXDD-3'
DsiRNAmm Antisense Strand: 3'-XXXEXXXXXXXXXXXXXXXXXXXXXXXX-5'

Target RNA Sequence:       5'-...XXAXXXXXXXXXXXXXXXXXX...-3'
DsiRNAmm Sense Strand:     5'-XXBXXXXXXXXXXXXXXXXXXXXDD-3'
DsiRNAmm Antisense Strand: 3'-XXXXEXXXXXXXXXXXXXXXXXXXXXXXX-5'

Target RNA Sequence:       5'-...XXXAXXXXXXXXXXXXXXXXX...-3'
DsiRNAmm Sense Strand:     5'-XXXBXXXXXXXXXXXXXXXXXXXDD-3'
DsiRNAmm Antisense Strand: 3'-XXXXXEXXXXXXXXXXXXXXXXXXXXXXXX-5'

Target RNA Sequence:       5'-...XXXXAXXXXXXXXXXXXXXXX...-3'
DsiRNAmm Sense Strand:     5'-XXXXBXXXXXXXXXXXXXXXXXXDD-3'
DsiRNAmm Antisense Strand: 3'-XXXXXXEXXXXXXXXXXXXXXXXXXXXXXXX-5'

Target RNA Sequence:       5'-...XXXXXAXXXXXXXXXXXXXXX...-3'
DsiRNAmm Sense Strand:     5'-XXXXXBXXXXXXXXXXXXXXXXXDD-3'
DsiRNAmm Antisense Strand: 3'-XXXXXXXEXXXXXXXXXXXXXXXXXXXXXXXX-5'

Target RNA Sequence:       5'-...XXXXXXAXXXXXXXXXXXXXX...-3'
DsiRNAmm Sense Strand:     5'-XXXXXXBXXXXXXXXXXXXXXXXDD-3'
DsiRNAmm Antisense Strand: 3'-XXXXXXXXEXXXXXXXXXXXXXXXXXXXXXXXX-5'

Target RNA Sequence:       5'-...XXXXXXXAXXXXXXXXXXXXX...-3'
DsiRNAmm Sense Strand:     5'-XXXXXXXBXXXXXXXXXXXXXXXDD-3'
DsiRNAmm Antisense Strand: 3'-XXXXXXXXXEXXXXXXXXXXXXXXXXXXXXXXXX-5'

Target RNA Sequence:       5'-...XXXXXXXXAXXXXXXXXXXXX...-3'
DsiRNAmm Sense Strand:     5'-XXXXXXXXBXXXXXXXXXXXXXXDD-3'
DsiRNAmm Antisense Strand: 3'-XXXXXXXXXXEXXXXXXXXXXXXXXXXXXXXXXXX-5'
``` wherein "X"=RNA, "D"=DNA and "E"=Nucleic acid residues (RNA, DNA or non-natural or modified nucleic acids) that do not base pair (hydrogen bond) with corresponding "A" RNA residues of otherwise complementary (target) strand when strands are annealed, yet optionally do base pair with corresponding "B" residues ("B" residues are also RNA, DNA or non-natural or modified nucleic acids). Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNA agents.

In addition to the above-exemplified structures, DsiRNAs of the invention can also possess one, two or three additional residues that form further mismatches with the target β-catenin RNA sequence. Such mismatches can be consecutive, or can be interspersed by nucleotides that form matched base pairs with the target β-catenin RNA sequence. Where interspersed by nucleotides that form matched base pairs, mismatched residues can be spaced apart from each other within a single strand at an interval of one, two, three, four, five, six, seven or even eight base paired nucleotides between such mismatch-forming residues.

As for the above-described DsiRNAmm agents, a preferred location within DsiRNAs for antisense strand nucleotides that form mismatched base pairs with target β-catenin RNA sequence (yet may or may not form mismatches with corresponding sense strand nucleotides) is within the antisense strand region that is located 3' (downstream) of the antisense strand sequence which is complementary to the projected Ago2 cut site of the DsiRNA (e.g., in FIG. 1, the region of the antisense strand which is 3' of the projected Ago2 cut site is preferred for mismatch-forming residues and happens to be located at positions 17-23 of the antisense strand for the 25/27mer agent shown in FIG. 1). Thus, in one embodiment, the position of a mismatch nucleotide (in relation to the target (β-catenin RNA sequence) of the antisense strand of a DsiRNAmm is the nucleotide residue of the antisense strand that is located immediately 3' (downstream) within the antisense strand sequence of the projected Ago2 cleavage site of the corresponding target β-catenin RNA sequence. In other preferred embodiments, a mismatch nucleotide of the antisense strand of a DsiRNAmm (in relation to the target (β-catenin RNA sequence) is positioned at the nucleotide residue of the antisense strand that is located two nucleotides 3' (downstream) of the corresponding projected Ago2 cleavage site, three nucleotides 3' (downstream) of the corresponding projected Ago2 cleavage site, four nucleotides 3' (downstream) of the corresponding projected Ago2 cleavage site, five nucleotides 3' (downstream) of the corresponding projected Ago2 cleavage site, six nucleotides 3' (downstream) of the projected Ago2 cleavage site, seven nucleotides 3' (downstream) of the projected Ago2 cleavage site, eight nucleotides 3' (downstream) of the projected Ago2 cleavage site, or nine nucleotides 3' (downstream) of the projected Ago2 cleavage site.

In DsiRNA agents possessing two mismatch-forming nucleotides of the antisense strand (where mismatch-forming nucleotides are mismatch forming in relation to target (β-catenin RNA sequence), mismatches can occur consecutively (e.g., at consecutive positions along the antisense strand nucleotide sequence). Alternatively, nucleotides of the antisense strand that form mismatched base pairs with the target β-catenin RNA sequence can be interspersed by nucleotides that base pair with the target β-catenin RNA sequence (e.g., for a DsiRNA possessing mismatch-forming nucleotides at positions 17 and 20 (starting from the 5' terminus (position 1) of the antisense strand of the 25/27mer agent shown in FIG. 1), but not at positions 18 and 19, the mismatched residues of sense strand positions 17 and 20 are interspersed by two nucleotides that form matched base pairs with corresponding residues of the target (β-catenin RNA sequence). For example, two residues of the antisense strand (located within the mismatch-tolerant region of the antisense strand) that form mismatched base pairs with the corresponding target β-catenin RNA sequence can occur with zero, one, two, three, four or five matched base pairs (with respect to target (β-catenin RNA sequence) located between these mismatch-forming base pairs.

For certain DsiRNAs possessing three mismatch-forming base pairs (mismatch-forming with respect to target (β-catenin RNA sequence), mismatch-forming nucleotides can occur consecutively (e.g., in a triplet along the antisense strand nucleotide sequence). Alternatively, nucleotides of the antisense strand that form mismatched base pairs with the target β-catenin RNA sequence can be interspersed by nucleotides that form matched base pairs with the target β-catenin RNA sequence (e.g., for a DsiRNA possessing mismatched nucleotides at positions 17, 18 and 22, but not at positions 19, 20 and 21, the mismatch-forming residues of antisense strand positions 17 and 18 are adjacent to one another, while the mismatch-forming residues of antisense strand positions 18 and 22 are interspersed by three nucleotides that form matched base pairs with corresponding residues of the target (3-catenin RNA). For example, three residues of the antisense strand (located within the mismatch-tolerant region of the antisense strand) that form mismatched base pairs with the corresponding target β-catenin RNA sequence can occur with zero, one, two, three or four matched base pairs located between any two of these mismatch-forming base pairs.

For certain DsiRNAs possessing four mismatch-forming base pairs (mismatch-forming with respect to target (β-catenin RNA sequence), mismatch-forming nucleotides can occur consecutively (e.g., in a quadruplet along the sense strand nucleotide sequence). Alternatively, nucleotides of the antisense strand that form mismatched base pairs with the target β-catenin RNA sequence can be interspersed by nucleotides that form matched base pairs with the target β-catenin RNA sequence (e.g., for a DsiRNA possessing mismatch-forming nucleotides at positions 17, 19, 21 and 22, but not at positions 18 and 20, the mismatch-forming residues of antisense strand positions 21 and 22 are adjacent to one another, while the mismatch-forming residues of antisense strand positions 17 and 19 are interspersed by one nucleotide that forms a matched base pair with the corresponding residue of the target β-catenin RNA sequence—similarly, the mismatch-forming residues of antisense strand positions 19 and 21 are also interspersed by one nucleotide that forms a matched base pair with the corresponding residue of the target (β-catenin RNA sequence). For example, four residues of the antisense strand (located within the mismatch-tolerant region of the antisense strand) that form mismatched base pairs with the corresponding target β-catenin RNA sequence can occur with zero, one, two or three matched base pairs located between any two of these mismatch-forming base pairs.

The above DsiRNAmm and other DsiRNA structures are described in order to exemplify certain structures of DsiRNAmm and DsiRNA agents. Design of the above DsiRNAmm and DsiRNA structures can be adapted to generate, e.g., DsiRNAmm forms of other DsiRNA structures shown infra. As exemplified above, DsiRNAs can also be designed that possess single mismatches (or two, three or four mismatches) between the antisense strand of the DsiRNA and a target sequence, yet optionally can retain perfect complementarity between sense and antisense strand sequences of a DsiRNA.

It is further noted that the DsiRNA agents exemplified infra can also possess insertion/deletion (in/del) structures within their double-stranded and/or target β-catenin RNA-aligned structures. Accordingly, the DsiRNAs of the invention can be designed to possess in/del variations in, e.g., antisense strand sequence as compared to target β-catenin RNA sequence and/or antisense strand sequence as compared to sense strand sequence, with preferred location(s) for placement of such in/del nucleotides corresponding to those locations described above for positioning of mismatched and/or mismatch-forming base pairs.

It is also noted that the DsiRNAs of the instant invention can tolerate mismatches within the 3'-terminal region of the sense strand/5'-terminal region of the antisense strand, as this region is modeled to be processed by Dicer and liberated from the guide strand sequence that loads into RISC. Exemplary DsiRNA structures of the invention that harbor such mismatches include the following:

```
Target RNA Sequence:     5'-...XXXXXXXXXXXXXXXXXXXXXXHXXX...-3'
DsiRNA Sense Strand:     5'-XXXXXXXXXXXXXXXXXXXXXXIXDD-3'
DsiRNA Antisense Strand: 3'-XXXXXXXXXXXXXXXXXXXXXXXJXXX-5'

Target RNA Sequence:     5'-...XXXXXXXXXXXXXXXXXXXXXXHXX...-3'
DsiRNA Sense Strand:     5'-XXXXXXXXXXXXXXXXXXXXXXXIDD-3'
DsiRNA Antisense Strand: 3'-XXXXXXXXXXXXXXXXXXXXXXXXJXX-5'

Target RNA Sequence:     5'-...XXXXXXXXXXXXXXXXXXXXXXXHX...-3'
DsiRNA Sense Strand:     5'-XXXXXXXXXXXXXXXXXXXXXXXXID-3'
DsiRNA Antisense Strand: 3'-XXXXXXXXXXXXXXXXXXXXXXXXXJX-5'

Target RNA Sequence:     5'-...XXXXXXXXXXXXXXXXXXXXXXXXH...-3'
DsiRNA Sense Strand:     5'-XXXXXXXXXXXXXXXXXXXXXXXXXDI-3'
DsiRNA Antisense Strand: 3'-XXXXXXXXXXXXXXXXXXXXXXXXXXJ-5'
``` wherein "X"=RNA, "D"=DNA and "I" and "J"=Nucleic acid residues (RNA, DNA or non-natural or modified nucleic acids) that do not base pair (hydrogen bond) with one another, yet optionally "J" is complementary to target RNA sequence nucleotide "H". Any of the residues of such agents can optionally be 2'-O-methyl RNA monomers—alternating positioning of 2'-O-methyl RNA monomers that commences from the 3'-terminal residue of the bottom (second) strand, as shown above—or any of the above-described methylation patterns—can also be used in the above DsiRNA agents. The above mismatches can also be combined within the DsiRNAs of the instant invention.

In the below structures, such mismatches are introduced within the asymmetric βc-1569 DsiRNA (newly-introduced mismatch residues are italicized): βc-1569 25/27mer DsiRNA, mismatch position=22 of sense strand (from 5'-terminus)

```
5'-ACCUCACUUGCAAUAAUUAUA^Gaa-3'      (SEQ ID NO: 7775)
3'-AUUGGAGUGAACGUUAUUAAUAU_UCUU-5'   (SEQ ID NO: 1287)
```

Optionally, the mismatched "C" residue of position 22 of the sense strand is alternatively "U" or "G".

βc-1569 25/27mer DsiRNA, mismatch position=23 of sense strand

```
5'-ACCUCACUUGCAAUAAUUAUAA^Uaa-3'     (SEQ ID NO: 7776)
3'-AUUGGAGUGAACGUUAUUAAUAUU_CUU-5'   (SEQ ID NO: 1287)
```

Optionally, the mismatched "U" residue of position 23 of the sense strand is alternatively "A" or "C".

βc-1569 25/27mer DsiRNA, mismatch position=24 of sense strand

```
5'-ACCUCACUUGCAAUAAUUAUAAG^ca-3'     (SEQ ID NO: 7777)
3'-AUUGGAGUGAACGUUAUUAAUAUUC_UU-5'   (SEQ ID NO: 1287)
```

Optionally, the mismatched "c" residue of position 24 of the sense strand is alternatively "t" or "g".

βc-1569 25/27mer DsiRNA, mismatch position=25 of sense strand

```
5'-ACCUCACUUGCAAUAAUUAUAAGa^c-3'     (SEQ ID NO: 7778)
3'-AUUGGAGUGAACGUUAUUAAUAUUCU_U-5'   (SEQ ID NO: 1287)
```

Optionally, the mismatched "c" residue of position 25 of the sense strand is alternatively "t" or "g".

βc-1569 25/27mer DsiRNA, mismatch position=1 of antisense strand

```
5'-ACCUCACUUGCAAUAAUUAUAAGa^a-3'     (SEQ ID NO: 178)
3'-AUUGGAGUGAACGUUAUUAAUAUUCU_G-5'   (SEQ ID NO: 7779)
```

Optionally, the mismatched "G" residue of position 1 of the antisense strand is alternatively "A" or "C".

βc-1569 25/27mer DsiRNA, mismatch position=2 of antisense strand

```
5'-ACCUCACUUGCAAUAAUUAUAAG^aa-3'     (SEQ ID NO: 178)
3'-AUUGGAGUGAACGUUAUUAAUAUUC_GU-5'   (SEQ ID NO: 7780)
```

Optionally, the mismatched "G" residue of position 2 of the antisense strand is alternatively "A" or "C".

βc-1569 25/27mer DsiRNA, mismatch position=3 of antisense strand

```
5'-ACCUCACUUGCAAUAAUUAUAA^Gaa3'    (SEQ ID NO: 178)
3'-AUUGGAGUGAACGUUAUUAAUAUU_AUU-5' (SEQ ID NO: 7781)
```

Optionally, the mismatched "A" residue of position 3 of the antisense strand is alternatively "U" or "G".

βc-1569 25/27mer DsiRNA, mismatch position=4 of antisense strand

```
5'-ACCUCACUUGCAAUAAUUAUA^Gaa-3'    (SEQ ID NO: 178)
3'-AUUGGAGUGAACGUUAUUAAUAU_GCUU-5' (SEQ ID NO: 7782)
```

Optionally, the mismatched "G" residue of position 4 of the antisense strand is alternatively "A" or "C".

As an additional example, such mismatches are introduced within the asymmetric βc-3393 DsiRNA (newly-introduced mismatch residues are italicized): βc-3393 25/27mer DsiRNA, mismatch position=22 of sense strand (from 5'-terminus)

```
5'-UGGUGUAGAACACUAAUUCAU^CAtc-3'   (SEQ ID NO: 7787)
3'-UUACCACAUCUUGUGAUUAAGUA_UUAG-5' (SEQ ID NO: 1506)
```

Optionally, the mismatched "C" residue of position 22 of the sense strand is alternatively "U" or "G".

βc-3393 25/27mer DsiRNA, mismatch position=23 of sense strand

```
5'-UGGUGUAGAACACUAAUUCAUA^Ctc-3'   (SEQ ID NO: 7788)
3'-UUACCACAUCUUGUGAUUAAGUAU_UAG-5' (SEQ ID NO: 1506)
```

Optionally, the mismatched "C" residue of position 23 of the sense strand is alternatively "G" or "U".

βc-3393 25/27mer DsiRNA, mismatch position=24 of sense strand

```
5'-UGGUGUAGAACACUAAUUCAUAA^Cc-3'   (SEQ ID NO: 7789)
3'-UUACCACAUCUUGUGAUUAAGUAUU_AG-5' (SEQ ID NO: 1506)
```

Optionally, the mismatched "c" residue of position 24 of the sense strand is alternatively "a" or "g".

βc-3393 25/27mer DsiRNA, mismatch position=25 of sense strand

```
5'-UGGUGUAGAACACUAAUUCAUAAt^a-3'   (SEQ ID NO: 7790)
3'-UUACCACAUCUUGUGAUUAAGUAUUA_G-5' (SEQ ID NO: 1506)
```

Optionally, the mismatched "a" residue of position 25 of the sense strand is alternatively "t" or "g".

βc-3393 25/27mer DsiRNA, mismatch position=1 of antisense strand

```
5'-UGGUGUAGAACACUAAUUCAUAAt^C-3'   (SEQ ID NO: 397)
3'-UUACCACAUCUUGUGAUUAAGUAUUA_A-5' (SEQ ID NO: 7791)
```

Optionally, the mismatched "A" residue of position 1 of the antisense strand is alternatively "U" or "C".

βc-3393 25/27mer DsiRNA, mismatch position=2 of antisense strand

```
5'-UGGUGUAGAACACUAAUUCAUAA^tc-3'   (SEQ ID NO: 397)
3'-UUACCACAUCUUGUGAUUAAGUAUU_CG-5' (SEQ ID NO: 7792)
```

Optionally, the mismatched "C" residue of position 2 of the antisense strand is alternatively "G" or "U".

βc-3393 25/27mer DsiRNA, mismatch position=3 of antisense strand

```
5'-UGGUGUAGAACACUAAUUCAUA^Atc-3'   (SEQ ID NO: 397)
3'-UUACCACAUCUUGUGAUUAAGUAU_GAG-5' (SEQ ID NO: 7793)
```

Optionally, the mismatched "C" residue of position 3 of the antisense strand is alternatively "U" or "A".

βc-3393 25/27mer DsiRNA, mismatch position=4 of antisense strand

```
5'-UGGUGUAGAACACUAAUUCAU^Atc-3'    (SEQ ID NO: 397)
3'-UUACCACAUCUUGUGAUUAAGUA_CUAG-5' (SEQ ID NO: 7794)
```

Optionally, the mismatched "C" residue of position 4 of the antisense strand is alternatively "U" or "A".

As noted above, introduction of such mismatches can be performed upon any of the DsiRNAs described herein.

The mismatches of such DsiRNA structures can be combined to produce a DsiRNA possessing, e.g., two, three or even four mismatches within the 3'-terminal four nucleotides of the sense strand/5'-terminal four nucleotides of the antisense strand.

Indeed, in view of the flexibility of sequences which can be incorporated into DsiRNAs at the 3'-terminal residues of the sense strand/5'-terminal residues of the antisense strand, in certain embodiments, the sequence requirements of an asymmetric DsiRNA of the instant invention can be represented as the following (minimalist) structure (shown for an exemplary βc-1569 DsiRNA sequence):

```
                                         (SEQ ID NO: 7783)
         5'-ACCUCACUUGCAAUAAUUAUAXXX[X]_n-3'

(SEQ ID NO: 7784)
         3'-AUUGGAGUGAACGUUAUUAAUXXXXX[X]_n-5'
``` where n=1 to 5, 1 to 10, 1 to 20, 1 to 30, 1 to 50, or 1 to 80 or more.

βc-1569 Target:
```
                                         (SEQ ID NO: 7785)
         5'-TAACCTCACTTGCAATAATTAXXXXXXX-3'
```

The β-catenin target site may also be a site which is targeted by one or more of several oligonucleotides whose complementary target sites overlap with a stated target site. For example, for an exemplary βc-288 DsiRNA, it is noted that certain DsiRNAs targeting overlapping and only slightly offset β-catenin sequences can exhibit activity levels similar to that of βc-288 (specifically, see βc-284, βc-285, βc-286, βc-287, βc-289, βc-290 and βc-291 DsiRNAs of Table 14 below). Thus, in certain embodiments, a designated target sequence region can be effectively targeted by a series of DsiRNAs possessing largely overlapping sequences. (E.g., if considering DsiRNAs surrounding the βc-288 site, a more encompassing β-catenin target sequence might be recited as, e.g., 5'-CAGCGTGGACAATGGCTACTCAAGCT-GATTTGAT-3' (SEQ ID NO: 7786), wherein any given DsiRNA (e.g., a DsiRNA selected from βc-284, βc-285, βc-286, βc-287, βc-288, βc-289, β-290 and β-291) only targets a sub-sequence within such a sequence region, yet the entire sequence can be considered a viable target for such a series of DsiRNAs).

Additionally and/or alternatively, mismatches within the 3'-terminal four nucleotides of the sense strand/5'-terminal four nucleotides of the antisense strand can be combined with mismatches positioned at other mismatch-tolerant positions, as described above.

In view of the present identification of the above-described Dicer substrate agents (DsiRNAs) as inhibitors of β-catenin levels via targeting of specific β-catenin sequences, it is also recognized that DsiRNAs having structures similar to those described herein can also be synthesized which target other sequences within the β-catenin sequence of SEQ ID NOs: 1-3 or SEQ ID NOs: 5-6, or within variants thereof (e.g., target sequences possessing 80% identity, 90% identity, 95% identity, 96% identity, 97% identity, 98% identity, 99% or more identity to a sequence of SEQ ID NOs: 1-3 or SEQ ID NOs: 5-6).

Anti-β-Catenin DsiRNA Design/Synthesis

It has been found empirically that longer dsRNA species of from 25 to 35 nucleotides (DsiRNAs) and especially from 25 to 30 nucleotides give unexpectedly effective results in terms of potency and duration of action, as compared to 19-23mer siRNA agents. Without wishing to be bound by the underlying theory of the dsRNA processing mechanism, it is thought that the longer dsRNA species serve as a substrate for the Dicer enzyme in the cytoplasm of a cell. In addition to cleaving the dsRNA of the invention into shorter segments, Dicer is thought to facilitate the incorporation of a single-stranded cleavage product derived from the cleaved dsRNA into the RISC complex that is responsible for the destruction of the cytoplasmic RNA (e.g., β-catenin RNA) of or derived from the target gene, β-catenin (or other gene associated with a (β-catenin-associated disease or disorder). Prior studies (Rossi et al., U.S. Patent Application No. 2007/0265220) have shown that the cleavability of a dsRNA species (specifically, a DsiRNA agent) by Dicer corresponds with increased potency and duration of action of the dsRNA species.

Certain preferred anti-β-catenin DsiRNA agents were selected from a pre-screened population. Design of DsiRNAs can optionally involve use of predictive scoring algorithms that perform in silico assessments of the projected activity/efficacy of a number of possible DsiRNA agents spanning a region of sequence. Information regarding the design of such scoring algorithms can be found, e.g., in Gong et al. (*BMC Bioinformatics* 2006, 7:516), though a more recent "v3" algorithm represents a theoretically improved algorithm relative to siRNA scoring algorithms previously available in the art. (E.g., the "v3" and "v4" scoring algorithms are machine learning algorithms that are not reliant upon any biases in human sequence. In addition, the "v3" and "v4" algorithms derive from data sets that are many-fold larger than that from which an older "v2" algorithm such as that described in Gong et al. derives.)

The first and second oligonucleotides of the DsiRNA agents of the instant invention are not required to be completely complementary. In fact, in one embodiment, the 3'-terminus of the sense strand contains one or more mismatches. In one aspect, two mismatches are incorporated at the 3' terminus of the sense strand. In another embodiment, the DsiRNA of the invention is a double stranded RNA molecule containing two RNA oligonucleotides each of which is 27 nucleotides in length and, when annealed to each other, have blunt ends and a two nucleotide mismatch on the 3'-terminus of the sense strand (the 5'-terminus of the antisense strand). The use of mismatches or decreased thermodynamic stability (specifically at the 3'-sense/5'-antisense position) has been proposed to facilitate or favor entry of the antisense strand into RISC (Schwarz et al., 2003, *Cell* 115: 199-208; Khvorova et al., 2003, *Cell* 115: 209-216), presumably by affecting some rate-limiting unwinding steps that occur with entry of the siRNA into RISC. Thus, terminal base composition has been included in design algorithms for selecting active 21mer siRNA duplexes (Ui-Tei et al., 2004, *Nucleic Acids Res* 32: 936-948; Reynolds et al., 2004, *Nat Biotechnol* 22: 326-330). With Dicer cleavage of the dsRNA of this embodiment, the small end-terminal sequence which contains the mismatches will either be left unpaired with the antisense strand (become part of a 3'-overhang) or be cleaved entirely off the final 21-mer siRNA. These "mismatches", therefore, do not persist as mismatches in the final RNA component of RISC. The finding that base mismatches or destabilization of segments at the 3'-end of the sense strand of Dicer substrate improved the potency of synthetic duplexes in RNAi, presumably by facilitating processing by Dicer, was a surprising finding of past works describing the design and use of 25-30mer dsRNAs (also termed "DsiRNAs" herein; Rossi et al., U.S. Patent Application Nos. 2005/0277610, 2005/0244858 and 2007/0265220).

Modification of Anti-β-Catenin DsiRNAs

One major factor that inhibits the effect of double stranded RNAs ("dsRNAs") is the degradation of dsRNAs (e.g., siRNAs and DsiRNAs) by nucleases. A 3'-exonuclease is the primary nuclease activity present in serum and modification of the 3'-ends of antisense DNA oligonucleotides is crucial to prevent degradation (Eder et al., 1991, *Antisense Res Dev,* 1: 141-151). An RNase-T family nuclease has been identified called ERI-1 which has 3' to 5' exonuclease activity that is involved in regulation and degradation of siRNAs (Kennedy et al., 2004, *Nature* 427: 645-649; Hong et al., 2005, *Biochem J,* 390: 675-679). This gene is also known as Thex1 (NM_02067) in mice or THEX1 (NM_153332) in humans and is involved in degradation of histone mRNA; it also mediates degradation of 3'-overhangs in siRNAs, but does not degrade duplex RNA (Yang et al., 2006, *J Biol Chem,* 281: 30447-30454). It is therefore reasonable to expect that 3'-end-stabilization of dsRNAs, including the DsiRNAs of the instant invention, will improve stability.

XRN1 (NM_019001) is a 5' to 3' exonuclease that resides in P-bodies and has been implicated in degradation of mRNA targeted by miRNA (Rehwinkel et al., 2005, *RNA* 11: 1640-1647) and may also be responsible for completing degradation initiated by internal cleavage as directed by a siRNA. XRN2 (NM_012255) is a distinct 5' to 3' exonuclease that is involved in nuclear RNA processing.

RNase A is a major endonuclease activity in mammals that degrades RNAs. It is specific for ssRNA and cleaves at the 3'-end of pyrimidine bases. SiRNA degradation products consistent with RNase A cleavage can be detected by mass spectrometry after incubation in serum (Turner et al., 2007, *Mol Biosyst* 3: 43-50). The 3'-overhangs enhance the susceptibility of siRNAs to RNase degradation. Depletion of RNase A from serum reduces degradation of siRNAs; this degradation does show some sequence preference and is worse for sequences having poly A/U sequence on the ends (Haupenthal et al., 2006 *Biochem Pharmacol* 71: 702-710). This suggests the possibility that lower stability regions of the duplex may "breathe" and offer transient single-stranded species available for degradation by RNase A. RNase A inhibitors can be added to serum and improve siRNA longevity and potency (Haupenthal et al., 2007, *Int J. Cancer* 121: 206-210).

In 21mers, phosphorothioate or boranophosphate modifications directly stabilize the internucleoside phosphate linkage. Boranophosphate modified RNAs are highly nuclease resistant, potent as silencing agents, and are relatively non-toxic. Boranophosphate modified RNAs cannot be manufactured using standard chemical synthesis methods and instead are made by in vitro transcription (IVT) (Hall et al., 2004, *Nucleic Acids Res* 32: 5991-6000; Hall et al., 2006, *Nucleic Acids Res* 34: 2773-2781). Phosphorothioate (PS) modifications can be easily placed in the RNA duplex at any desired position and can be made using standard chemical synthesis methods. The PS modification shows dose-dependent toxicity, so most investigators have recommended limited incorporation in siRNAs, favoring the 3'-ends where protection from nucleases is most important (Harborth et al., 2003, *Antisense Nucleic Acid Drug Dev* 13: 83-105; Chiu and Rana, 2003, *Mol Cell* 10: 549-561; Braasch et al., 2003, *Biochemistry* 42: 7967-7975; Amarzguioui et al., 2003, *Nucleic Acids Research* 31: 589-595). More extensive PS modification can be compatible with potent RNAi activity; however, use of sugar modifications (such as 2'-O-methyl RNA) may be superior (Choung et al., 2006, *Biochem Biophys Res Commun* 342: 919-927).

A variety of substitutions can be placed at the 2'-position of the ribose which generally increases duplex stability ($T_m$) and can greatly improve nuclease resistance. 2'-O-methyl RNA is a naturally occurring modification found in mammalian ribosomal RNAs and transfer RNAs. 2'-O-methyl modification in siRNAs is known, but the precise position of modified bases within the duplex is important to retain potency and complete substitution of 2'-O-methyl RNA for RNA will inactivate the siRNA. For example, a pattern that employs alternating 2'-O-methyl bases can have potency equivalent to unmodified RNA and is quite stable in serum (Choung et al., 2006, *Biochem Biophys Res Commun* 342: 919-927; Czauderna et al., 2003, *Nucleic Acids Research* 31: 2705-2716).

The 2'-fluoro (2'-F) modification is also compatible with dsRNA (e.g., siRNA and DsiRNA) function; it is most commonly placed at pyrimidine sites (due to reagent cost and availability) and can be combined with 2'-O-methyl modification at purine positions; 2'-F purines are available and can also be used. Heavily modified duplexes of this kind can be potent triggers of RNAi in vitro (Allerson et al., 2005, *J Med Chem* 48: 901-904; Prakash et al., 2005, *J Med Chem* 48: 4247-4253; Kraynack and Baker, 2006, *RNA* 12: 163-176) and can improve performance and extend duration of action when used in vivo (Morrissey et al., 2005, *Hepatology* 41: 1349-1356; Morrissey et al., 2005, *Nat Biotechnol* 23: 1002-1007). A highly potent, nuclease stable, blunt 19mer duplex containing alternative 2'-F and 2'-O-Me bases is taught by Allerson. In this design, alternating 2'-O-Me residues are positioned in an identical pattern to that employed by Czauderna, however the remaining RNA residues are converted to 2'-F modified bases. A highly potent, nuclease resistant siRNA employed by Morrissey employed a highly potent, nuclease resistant siRNA in vivo. In addition to 2'-O-Me RNA and 2'-F RNA, this duplex includes DNA, RNA, inverted abasic residues, and a 3'-terminal PS internucleoside linkage. While extensive modification has certain benefits, more limited modification of the duplex can also improve in vivo performance and is both simpler and less costly to manufacture. Soutschek et al. (2004, *Nature* 432: 173-178) employed a duplex in vivo and was mostly RNA with two 2'-O-Me RNA bases and limited 3'-terminal PS internucleoside linkages.

Locked nucleic acids (LNAs) are a different class of 2'-modification that can be used to stabilize dsRNA (e.g., siRNA and DsiRNA). Patterns of LNA incorporation that retain potency are more restricted than 2'-O-methyl or 2'-F bases, so limited modification is preferred (Braasch et al., 2003, *Biochemistry* 42: 7967-7975; Grunweller et al., 2003, *Nucleic Acids Res* 31: 3185-3193; Elmen et al., 2005, *Nucleic Acids Res* 33: 439-447). Even with limited incorporation, the use of LNA modifications can improve dsRNA performance in vivo and may also alter or improve off target effect profiles (Mook et al., 2007, *Mol Cancer Ther* 6: 833-843).

Synthetic nucleic acids introduced into cells or live animals can be recognized as "foreign" and trigger an immune response Immune stimulation constitutes a major class of off-target effects which can dramatically change experimental results and even lead to cell death. The innate immune system includes a collection of receptor molecules that specifically interact with DNA and RNA that mediate these responses, some of which are located in the cytoplasm and some of which reside in endosomes (Marques and Williams, 2005, *Nat Biotechnol* 23: 1399-1405; Schlee et al., 2006, *Mol Ther* 14: 463-470). Delivery of siRNAs by cationic lipids or liposomes exposes the siRNA to both cytoplasmic and endosomal compartments, maximizing the risk for triggering a type 1 interferon (IFN) response both in vitro and in vivo (Morrissey et al., 2005, *Nat Biotechnol* 23: 1002-1007; Sioud and Sorensen, 2003, *Biochem Biophys Res Commun* 312: 1220-1225; Sioud, 2005, *J Mol Biol* 348: 1079-1090; Ma et al., 2005, *Biochem Biophys Res Commun* 330: 755-759). RNAs transcribed within the cell are less immunogenic (Robbins et al., 2006, *Nat Biotechnol* 24: 566-571) and synthetic RNAs that are immunogenic when delivered using lipid-based methods can evade immune stimulation when introduced unto cells by mechanical means, even in vivo (Heidel et al., 2004, *Nat Biotechnol* 22: 1579-1582). However, lipid based delivery methods are convenient, effective, and widely used. Some general strategy to prevent immune responses is needed, especially for in vivo application where all cell types are present and the risk of generating an immune response is highest. Use of chemically modified RNAs may solve most or even all of these problems.

In certain embodiments, modifications can be included in the anti-β-catenin DsiRNA agents of the present invention so long as the modification does not prevent the DsiRNA agent from possessing β-catenin inhibitory activity. In one embodiment, one or more modifications are made that enhance Dicer processing of the DsiRNA agent (an assay for determining Dicer processing of a DsiRNA is described supra). In a second embodiment, one or more modifications are made that result in more effective β-catenin inhibition (as described herein, β-catenin inhibition/β-catenin inhibitory activity of a DsiRNA can be assayed via art-recognized methods for determining RNA levels, or for determining β-catenin polypeptide levels, should such levels be assessed in lieu of or in addition to assessment of, e.g., (β-catenin mRNA levels). In a third embodiment, one or more modifications are made that support greater β-catenin inhibitory activity (means of determining (β-catenin inhibitory activity are described supra). In a fourth embodiment, one or more modifications are made that result in greater potency of β-catenin inhibitory activity per each DsiRNA agent molecule to be delivered to the cell (potency of (β-catenin inhibitory activity is described supra).

Modifications can be incorporated in the 3'-terminal region, the 5'-terminal region, in both the 3'-terminal and 5'-terminal region or in some instances in various positions within the sequence. With the restrictions noted above in mind, numbers and combinations of modifications can be incorporated into the DsiRNA agent. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003, *Nucleic Acids Research* 31: 589-595). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied. Examples of modifications are also disclosed in U.S. Pat. Nos. 5,684,143, 5,858,988 and 6,291,438 and in U.S. published patent application No. 2004/0203145 A1. Other modifications are disclosed in Herdewijn (2000, *Antisense Nucleic Acid Drug Dev* 10: 297-310), Eckstein (2000, *Antisense Nucleic Acid Drug Dev* 10: 117-21), Rusckowski et al. (2000, *Antisense Nucleic Acid Drug Dev* 10: 333-345), Stein et al. (2001, *Antisense Nucleic Acid Drug Dev* 11: 317-25); Vorobjev et al. (2001, *Antisense Nucleic Acid Drug Dev* 11: 77-85).

One or more modifications contemplated can be incorporated into either strand. The placement of the modifications in the DsiRNA agent can greatly affect the characteristics of the DsiRNA agent, including conferring greater potency and stability, reducing toxicity, enhance Dicer processing, and minimizing an immune response. In one embodiment, the antisense strand or the sense strand or both strands have one or more 2'-O-methyl modified nucleotides. In another embodiment, the antisense strand contains 2'-O-methyl modified nucleotides. In another embodiment, the antisense stand contains a 3' overhang that is comprised of 2'-O-methyl modified nucleotides. The antisense strand could also include additional 2'-O-methyl modified nucleotides.

In certain embodiments of the present invention, the anti-β-catenin DsiRNA agent has one or more of the following properties: (i) the DsiRNA agent is asymmetric, e.g., has a 3' overhang on the antisense strand and (ii) the DsiRNA agent has a modified 3' end on the sense strand to direct orientation of Dicer binding and processing of the dsRNA to an active siRNA. According to this embodiment, the longest strand in the dsRNA comprises 25-35 nucleotides (e.g., 25, 26, 27, 28, 29, 30, 31, 32, 33, 34 or 35 nucleotides). In certain such embodiments, the DsiRNA agent is asymmetric such that the sense strand comprises 25-34 nucleotides and the 3' end of the sense strand forms a blunt end with the 5' end of the antisense strand while the antisense strand comprises 26-35 nucleotides and forms an overhang on the 3' end of the antisense strand. In one embodiment, the DsiRNA agent is asymmetric such that the sense strand comprises 25-28 nucleotides and the antisense strand comprises 25-30 nucleotides. Thus, the resulting dsRNA has an overhang on the 3' end of the antisense strand. The overhang is 1-4 nucleotides, for example 2 nucleotides. The sense strand may also have a 5' phosphate.

In other embodiments, the sense strand of the DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotides modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the DsiRNA agent to direct the orientation of Dicer processing of the antisense strand. In a further embodiment of the present invention, two terminal DNA bases are substituted for two ribonucleotides on the 3'-end of the sense strand forming a blunt end of the duplex on the 3' end of the sense strand and the 5' end of the antisense strand, and a two-nucleotide RNA overhang is located on the 3'-end of the antisense strand. This is an asymmetric composition with DNA on the blunt end and RNA bases on the overhanging end.

The sense and antisense strands of a DsiRNA agent of the instant invention anneal under biological conditions, such as the conditions found in the cytoplasm of a cell. In addition, a region of one of the sequences, particularly of the antisense strand, of the DsiRNA agent has a sequence length of at least 15 (in certain embodiments, 19) nucleotides, wherein these nucleotides are adjacent to the 3' end of antisense strand (e.g., in the 21-nucleotide region adjacent to the 3' end of the antisense strand) and are sufficiently complementary to a nucleotide sequence of the target β-catenin RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

The DsiRNA agent can also have one or more of the following additional properties: (a) the antisense strand has a right shift from the typical 21mer (e.g., the DsiRNA comprises a length of antisense strand nucleotides that extends to the 5' of a projected Dicer cleavage site within the DsiRNA, with such antisense strand nucleotides base paired with corresponding nucleotides of the sense strand extending 3' of a projected Dicer cleavage site in the sense strand), (b) the strands may not be completely complementary, i.e., the strands may contain simple mismatched base pairs (in certain embodiments, the DsiRNAs of the invention possess 1, 2, 3, 4 or even 5 or more mismatched base pairs, provided that β-catenin inhibitory activity of the DsiRNA possessing mismatched base pairs is retained at sufficient levels (e.g., retains at least 50% β-catenin inhibitory activity or more, at least 60% β-catenin inhibitory activity or more, at least 70% β-catenin inhibitory activity or more, at least 80% 3-catenin inhibitory activity or more, at least 90% β-catenin inhibitory activity or more or at least 95% β-catenin inhibitory activity or more as compared to a corresponding DsiRNA not possessing mismatched base pairs. In certain embodiments, mismatched base pairs exist between the antisense and sense strands of a DsiRNA. In some embodiments, mismatched base pairs exist (or are predicted to exist) between the antisense strand and the target RNA. In certain embodiments, the presence of a mismatched base pair(s) between an antisense strand residue and a corresponding residue within the target RNA that is located 3' in the target RNA sequence of a projected Ago2 cleavage site retains and may even enhance β-catenin inhibitory activity of a DsiRNA of the invention) and (c) base modifications such as locked nucleic acid(s) may be included in the 5' end of the sense strand. A "typical" 21mer siRNA is designed using conventional techniques. In one technique, a variety of sites are commonly tested in parallel or pools containing several distinct siRNA duplexes specific to the same target with the hope that one of the reagents will be effective (Ji et al., 2003, *FEBS Lett* 552: 247-252). Other techniques use design rules and algorithms to increase the likelihood of obtaining active RNAi effector molecules (Schwarz et al., 2003, *Cell* 115: 199-208; Khvorova et al., 2003, *Cell* 115: 209-216; Ui-Tei et al., 2004, *Nucleic Acids Res* 32: 936-948; Reynolds et al., 2004, *Nat Biotechnol* 22: 326-330; Krol et al., 2004, *J Biol Chem* 279: 42230-42239; Yuan et al., 2004, *Nucl Acids Res* 32(Webserver issue):W130-134; Boese et al., 2005, *Methods Enzymol* 392: 73-96). High throughput selection of siRNA has also been developed (U.S. published patent application No. 2005/0042641 A1). Potential target sites can also be analyzed by secondary structure predictions (Heale et al., 2005, *Nucleic Acids Res* 33(3): e30). This 21mer is then used to design a right shift to include 3-9 additional nucleotides on the 5' end of the 21mer. The sequence of these additional nucleotides is not restricted. In one embodiment, the added ribonucleotides are based on the sequence of the target gene. Even in this embodiment, full complementarity between the target sequence and the antisense siRNA is not required.

The first and second oligonucleotides of a DsiRNA agent of the instant invention are not required to be completely complementary. They only need to be sufficiently complementary to anneal under biological conditions and to provide a substrate for Dicer that produces a siRNA sufficiently complementary to the target sequence. Locked nucleic acids, or LNA's, are well known to a skilled artisan (Elmen et al., 2005, *Nucleic Acids Res* 33: 439-447; Kurreck et al., 2002, *Nucleic Acids Res* 30: 1911-1918; Crinelli et al., 2002, *Nucleic Acids Res* 30: 2435-2443; Braasch and Corey, 2001, *Chem Biol* 8: 1-7; Bondensgaard et al., 2000, *Chemistry* 6: 2687-2695; Wahlestedt et al., 2000, *Proc Natl Acad Sci USA* 97: 5633-5638). In one embodiment, an LNA is incorporated at the 5' terminus of the sense strand. In another embodiment, an LNA is incorporated at the 5' terminus of the sense strand in duplexes designed to include a 3' overhang on the antisense strand.

In certain embodiments, the DsiRNA agent of the instant invention has an asymmetric structure, with the sense strand having a 25-base pair length, and the antisense strand having a 27-base pair length with a 2 base 3'-overhang. In other embodiments, this DsiRNA agent having an asymmetric structure further contains 2 deoxynucleotides at the 3' end of the sense strand in place of two of the ribonucleotides.

Certain DsiRNA agent compositions containing two separate oligonucleotides can be linked by a third structure. The third structure will not block Dicer activity on the DsiRNA agent and will not interfere with the directed destruction of the RNA transcribed from the target gene. In one embodiment, the third structure may be a chemical linking group. Many suitable chemical linking groups are known in the art and can be used. Alternatively, the third structure may be an oligonucleotide that links the two oligonucleotides of the DsiRNA agent in a manner such that a hairpin structure is produced upon annealing of the two oligonucleotides making up the dsRNA composition. The hairpin structure will not block Dicer activity on the DsiRNA agent and will not interfere with the directed destruction of the β-catenin RNA.

In certain embodiments, the anti-β-catenin DsiRNA agent of the invention has several properties which enhance its processing by Dicer. According to such embodiments, the DsiRNA agent has a length sufficient such that it is processed by Dicer to produce an siRNA and at least one of the following properties: (i) the DsiRNA agent is asymmetric, e.g., has a 3' overhang on the sense strand and (ii) the DsiRNA agent has a modified 3' end on the antisense strand to direct orientation of Dicer binding and processing of the dsRNA to an active siRNA. According to these embodiments, the longest strand in the DsiRNA agent comprises 25-30 nucleotides. In one embodiment, the sense strand comprises 25-30 nucleotides and the antisense strand comprises 25-28 nucleotides. Thus, the resulting dsRNA has an overhang on the 3' end of the sense strand. The overhang is 1-4 nucleotides, such as 2 nucleotides. The antisense strand may also have a 5' phosphate.

In certain embodiments, the sense strand of a DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the sense strand in place of two ribonucleotides forming a blunt end of the duplex on the 5' end of the antisense strand and the 3' end of the sense strand, and a two-nucleotide RNA overhang is located on the 3'-end of the antisense strand. This is an asymmetric composition with DNA on the blunt end and RNA bases on the overhanging end.

In certain other embodiments, the antisense strand of a DsiRNA agent is modified for Dicer processing by suitable modifiers located at the 3' end of the antisense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is also an asymmetric composition with DNA on the blunt end and RNA bases on the overhanging end.

The sense and antisense strands anneal under biological conditions, such as the conditions found in the cytoplasm of a cell. In addition, a region of one of the sequences, particularly of the antisense strand, of the dsRNA has a sequence length of at least 19 nucleotides, wherein these nucleotides are adjacent to the 3' end of antisense strand and are sufficiently complementary to a nucleotide sequence of the target β-catenin RNA.

Additionally, the DsiRNA agent structure contains two portions based on Dicer cleavage, a first portion which survives the Dicer-cleavage process and proceeds to actively engage the target RNA as part of the RISC complex and a second portion which is not active in RISC. The first portion will contain the sequence known to be most effective at RNA interference at the target RNA/RISC level, whereas the second portion may or may not be complementary to the target sequence. For example, in one embodiment of the invention, a 27-bp oligonucleotide of the DsiRNA agent structure is synthesized wherein the anticipated 21 to 22-bp segment that forms a hybrid with the target nucleic acid and thereby inhibits gene expression is located on the 3'-end of the antisense strand. The remaining bases located on the 5'-end of the antisense strand will be cleaved by Dicer and thus will not be a contiguous part of the Dicer-cleaved RNAi molecule. This second portion can be homologous (i.e., based on the sequence of the target sequence) or non-homologous and added to extend the nucleic acid strand.

US 2007/0265220 discloses that 27mer DsiRNAs show improved stability in serum over comparable 21mer siRNA compositions, even absent chemical modification. Modifications of DsiRNA agents, such as inclusion of 2'-O-methyl RNA in the antisense strand, in patterns such as detailed above, when coupled with addition of a 5' Phosphate, can improve stability of DsiRNA agents. Addition of 5'-phosphate to all strands in synthetic RNA duplexes may be an inexpensive and physiological method to confer some limited degree of nuclease stability.

The chemical modification patterns of the dsRNA agents of the instant invention are designed to enhance the efficacy of such agents. Accordingly, such modifications are designed to avoid reducing potency of dsRNA agents; to avoid interfering with Dicer processing of DsiRNA agents; to improve stability in biological fluids (reduce nuclease sensitivity) of dsRNA agents; or to block or evade detection by the innate immune system. Such modifications are also designed to avoid being toxic and to avoid increasing the cost or impact the ease of manufacturing the instant dsRNA agents of the invention.

β-Catenin Biology and Biochemistry

Known human and mouse β-catenin cDNA and polypeptide sequences include the following:

```
Human Wild-type β-catenin (cadherin-associated
protein) sequence, transcript variant 1
(SEQ ID NO: 1; Homo sapiens CTNNB1, transcript
variant 1; GenBank Accession No. NM_001904.3):
AGGATACAGCGGCTTCTGCGCGACTTATAAGAGCTCCTTGTGCGGCGCCA

TTTTAAGCCTCTCGGTCTGTGGCAGCAGCGTTGGCCCGGCCCCGGGAGCG

GAGAGCGAGGGGAGGCGGAGACGGAGGAAGGTCTGAGGAGCAGCTTCAGT

CCCCGCCGAGCCGCCACCGCAGGTCGAGGACGGTCGGACTCCCGCGGCGG

GAGGAGCCTGTTCCCCTGAGGGTATTTGAAGTATACCATACAACTGTTTT

GAAAATCCAGCGTGGACAATGGCTACTCAAGCTGATTTGATGGAGTTGGA

CATGGCCATGGAACCAGACAGAAAAGCGGCTGTTAGTCACTGGCAGCAAC

AGTCTTACCTGGACTCTGGAATCCATTCTGGTGCCACTACCACAGCTCCT

TCTCTGAGTGGTAAAGGCAATCCTGAGGAAGAGGATGTGGATACCTCCCA

AGTCCTGTATGAGTGGGAACAGGGATTTTCTCAGTCCTTCACTCAAGAAC

AAGTAGCTGATATTGATGGACAGTATGCAATGACTCGAGCTCAGAGGGTA

CGAGCTGCTATGTTCCCTGAGACATTAGATGAGGGCATGCAGATCCCATC

TACACAGTTTGATGCTGCTCATCCCACTAATGTCCAGCGTTTGGCTGAAC

CATCACAGATGCTGAAACATGCAGTTGTAAACTTGATTAACTATCAAGAT

GATGCAGAACTTGCCACACGTGCAATCCCTGAACTGACAAAACTGCTAAA

TGACGAGGACCAGGTGGTGGTTAATAAGGCTGCAGTTATGGTCCATCAGC

TTTCTAAAAAGGAAGCTTCCAGACACGCTATCATGCGTTCTCCTCAGATG

GTGTCTGCTATTGTACGTACCATGCAGAATACAAATGATGTAGAAACAGC

TCGTTGTACCGCTGGGACCTTGCATAACCTTTCCCATCATCGTGAGGGCT

TACTGGCCATCTTTAAGTCTGGAGGCATTCCTGCCCTGGTGAAAATGCTT

GGTTCACCAGTGGATTCTGTGTTGTTTTATGCCATTACAACTCTCCACAA

CCTTTTATTACATCAAGAAGGAGCTAAAATGGCAGTGCGTTTAGCTGGTG

GGCTGCAGAAAATGGTTGCCTTGCTCAACAAAACAAATGTTAAATTCTTG

GCTATTACGACAGACTGCCTTCAAATTTTAGCTTATGGCAACCAAGAAAG

CAAGCTCATCATACTGGCTAGTGGTGGACCCCAAGCTTTAGTAAATATAA

TGAGGACCTATACTTACGAAAAACTACTGTGGACCACAAGCAGAGTGCTG

AAGGTGCTATCTGTCTGCTCTAGTAATAAGCCGGCTATTGTAGAAGCTGG
```

-continued

TGGAATGCAAGCTTTAGGACTTCACCTGACAGATCCAAGTCAACGTCTTG

TTCAGAACTGTCTTTGGACTCTCAGGAATCTTTCAGATGCTGCAACTAAA

CAGGAAGGGATGGAAGGTCTCCTTGGGACTCTTGTTCAGCTTCTGGGTTC

AGATGATATAAATGTGGTCACCTGTGCAGCTGGAATTCTTTCTAACCTCA

CTTGCAATAATTATAAGAACAAGATGATGGTCTGCCAAGTGGGTGGTATA

GAGGCTCTTGTGCGTACTGTCCTTCGGGCTGGTGACAGGGAAGACATCAC

TGAGCCTGCCATCTGTGCTCTTCGTCATCTGACCAGCCGACACCAAGAAG

CAGAGATGGCCCAGAATGCAGTTCGCCTTCACTATGGACTACCAGTTGTG

GTTAAGCTCTTACACCCACCATCCCACTGGCCTCTGATAAAGGCTACTGT

TGGATTGATTCGAAATCTTGCCCTTTGTCCCGCAAATCATGCACCTTTGC

GTGAGCAGGGTGCCATTCCACGACTAGTTCAGTTGCTTGTTCGTGCACAT

CAGGATACCCAGCGCCGTACGTCCATGGGTGGGACACAGCAGCAATTTGT

GGAGGGGGTCCGCATGGAAGAAATAGTTGAAGGTTGTACCGGAGCCCTTC

ACATCCTAGCTCGGGATGTTCACAACCGAATTGTTATCAGAGGACTAAAT

ACCATTCCATTGTTTGTGCAGCTGCTTTATTCTCCCATTGAAAACATCCA

AAGAGTAGCTGCAGGGGTCCTCTGTGAACTTGCTCAGGACAAGGAAGCTG

CAGAAGCTATTGAAGCTGAGGGAGCCACAGCTCCTCTGACAGAGTTACTT

CACTCTAGGAATGAAGGTGTGGCGACATATGCAGCTGCTGTTTTGTTCCG

AATGTCTGAGGACAAGCCACAAGATTACAAGAAACGGCTTTCAGTTGAGC

TGACCAGCTCTCTCTTCAGAACAGAGCCAATGGCTTGGAATGAGACTGCT

GATCTTGGACTTGATATTGGTGCCCAGGGAGAACCCCTTGGATATCGCCA

GGATGATCCTAGCTATCGTTCTTTTCACTCTGGTGGATATGGCCAGGATG

CCTTGGGTATGGACCCCATGATGGAACATGAGATGGGTGGCCACCACCCT

GGTGCTGACTATCCAGTTGATGGGCTGCCAGATCTGGGGCATGCCCAGGA

CCTCATGGATGGGCTGCCTCCAGGTGACAGCAATCAGCTGGCCTGGTTTG

ATACTGACCTGTAAATCATCCTTTAGGTAAGAAGTTTTAAAAAGCCAGTT

TGGGTAAAATACTTTTACTCTGCCTACAGAACTTCAGAAAGACTTGGTTG

GTAGGGTGGGAGTGGTTTAGGCTATTTGTAAATCTGCCACAAAAACAGGT

ATATACTTTGAAAGGAGATGTCTTGGAACATTGGAATGTTCTCAGATTTC

TGGTTGTTATGTGATCATGTGTGGAAGTTATTAACTTTAATGTTTTTGC

CACAGCTTTTGCAACTTAATACTCAAATGAGTAACATTTGCTGTTTTAAA

CATTAATAGCAGCCTTTCTCTCTTTATACAGCTGTATTGTCTGAACTTGC

ATTGTGATTGGCCTGTAGAGTTGCTGAGAGGGCTCGAGGGGTGGGCTGGT

ATCTCAGAAAGTGCCTGACACACTAACCAAGCTGAGTTTCCTATGGGAAC

AATTGAAGTAAACTTTTTGTTCTGGTCCTTTTGGTCGAGGAGTAACAAT

ACAAATGGATTTTGGGAGTGACTCAAGAAGTGAAGAATGCACAAGAATGG

ATCACAAGATGGAATTTATCAAACCCTAGCCTTGCTTGTTAAATTTTTTT

TTTTTTTTTTTAAGAATATCTGTAATGGTACTGACTTTGCTTGCTTTGA

AGTAGCTCTTTTTTTTTTTTTTTTTTTTGCAGTAACTGTTTTTTA

AGTCTCTCGTAGTGTTAAGTTATAGTGAATACTGCTACAGCAATTTCTAA

TTTTTAAGAATTGAGTAATGGTGTAGAACACTAATTCATAATCACTCTAA

-continued

TTAATTGTAATCTGAATAAAGTGTAACAATTGTGTAGCCTTTTTGTATAA

AATAGACAAATAGAAAATGGTCCAATTAGTTTCCTTTTTAATATGCTTAA

AATAAGCAGGTGGATCTATTTCATGTTTTTGATCAAAAACTATTTGGGAT

ATGTATGGGTAGGGTAAATCAGTAAGAGGGTGTTATTTGGAACCTTGTTTT

GGACAGTTTACCAGTTGCCTTTTATCCCAAAGTTGTTGTAACCTGCTGTG

ATACGATGCTTCAAGAGAAAATGCGGTTATAAAAAATGGTTCAGAATTAA

ACTTTTAATTCATTCGATTG

Human Wild-type β-catenin (cadherin-associated
protein) sequence, transcript variant 2
(SEQ ID NO: 2; Homo sapiens CTNNB1, transcript
variant 2; GenBank Accession No. NM_001098209.1):
AGGATACAGCGGCTTCTGCGCGACTTATAAGAGCTCCTTGTGCGGCGCCA

TTTTAAGCCTCTCGGTCTGTGGCAGCAGCGTTGGCCCGGCCCCGGGAGCG

GAGAGCGAGGGGAGGCGGAGACGGAGGAAGGTCTGAGGAGCAGCTTCAGT

CCCCGCCGAGCCGCCACCGCAGGTCGAGGACGGTCGGACTCCCGCGGCGG

GAGGAGCCTGTTCCCCTGAGGGTATTTGAAGTATACCATACAACTGTTTT

GAAAATCCAGCGTGGACAATGGCTACTCAAGCTGATTTGATGGAGTTGGA

CATGGCCATGGAACCAGACAGAAAAGCGGCTGTTAGTCACTGGCAGCAAC

AGTCTTACCTGGACTCTGGAATCCATTCTGGTGCCACTACCACAGCTCCT

TCTCTGAGTGGTAAAGGCAATCCTGAGGAAGAGGATGTGGATACCTCCCA

AGTCCTGTATGAGTGGGAACAGGGATTTTCTCAGTCCTTCACTCAAGAAC

AAGTAGCTGATATTGATGGACAGTATGCAATGACTCGAGCTCAGAGGGTA

CGAGCTGCTATGTTCCCTGAGACATTAGATGAGGGCATGCAGATCCCATC

TACACAGTTTGATGCTGCTCATCCCACTAATGTCCAGCGTTTGGCTGAAC

CATCACAGATGCTGAAACATGCAGTTGTAAACTTGATTAACTATCAAGAT

GATGCAGAACTTGCCACACGTGCAATCCCTGAACTGACAAAACTGCTAAA

TGACGAGGACCAGGTGGTGGTTAATAAGGCTGCAGTTATGGTCCATCAGC

TTTCTAAAAAGGAAGCTTCCAGACACGCTATCATGCGTTCTCCTCAGATG

GTGTCTGCTATTGTACGTACCATGCAGAATACAAATGATGTAGAAACAGC

TCGTTGTACCGCTGGGACCTTGCATAACCTTTCCCATCATCGTGAGGGCT

TACTGGCCATCTTTAAGTCTGGAGGCATTCCTGCCCTGGTGAAAATGCTT

GGTTCACCAGTGGATTCTGTGTTGTTTTATGCCATTACAACTCTCCACAA

CCTTTTATTACATCAAGAAGGAGCTAAAATGGCAGTGCGTTTAGCTGGTG

GGCTGCAGAAAATGGTTGCCTTGCTCAACAAAACAAATGTTAAATTCTTG

GCTATTACGACAGACTGCCTTCAAATTTTAGCTTATGGCAACCAAGAAAG

CAAGCTCATCATACTGGCTAGTGGTGGACCCCAAGCTTTAGTAAATATAA

TGAGGACCTATACTTACGAAAAACTACTGTGGACCACAAGCAGAGTGCTG

AAGGTGCTATCTGTCTGCTCTAGTAATAAGCCGGCTATTGTAGAAGCTGG

TGGAATGCAAGCTTTAGGACTTCACCTGACAGATCCAAGTCAACGTCTTG

TTCAGAACTGTCTTTGGACTCTCAGGAATCTTTCAGATGCTGCAACTAAA

CAGGAAGGGATGGAAGGTCTCCTTGGGACTCTTGTTCAGCTTCTGGGTTC

AGATGATATAAATGTGGTCACCTGTGCAGCTGGAATTCTTTCTAACCTCA

CTTGCAATAATTATAAGAACAAGATGATGGTCTGCCAAGTGGGTGGTATA

GAGGCTCTTGTGCGTACTGTCCTTCGGGCTGGTGACAGGGAAGACATCAC
TGAGCCTGCCATCTGTGCTCTTCGTCATCTGACCAGCCGACACCAAGAAG
CAGAGATGGCCCAGAATGCAGTTCGCCTTCACTATGGACTACCAGTTGTG
GTTAAGCTCTTACACCCACCATCCCACTGGCCTCTGATAAAGGCTACTGT
TGGATTGATTCGAAATCTTGCCCTTTGTCCCGCAAATCATGCACCTTTGC
GTGAGCAGGGTGCCATTCCACGACTAGTTCAGTTGCTTGTTCGTGCACAT
CAGGATACCCAGCGCCGTACGTCCATGGGTGGGACACAGCAGCAATTTGT
GGAGGGGGTCCGCATGGAAGAAATAGTTGAAGGTTGTACCGGAGCCCTTC
ACATCCTAGCTCGGGATGTTCACAACCGAATTGTTATCAGAGGACTAAAT
ACCATTCCATTGTTTGTGCAGCTGCTTTATTCTCCCATTGAAAACATCCA
AAGAGTAGCTGCAGGGGTCCTCTGTGAACTTGCTCAGGACAAGGAAGCTG
CAGAAGCTATTGAAGCTGAGGGAGCCACAGCTCCTCTGACAGAGTTACTT
CACTCTAGGAATGAAGGTGTGGCGACATATGCAGCTGCTGTTTTGTTCCG
AATGTCTGAGGACAAGCCACAAGATTACAAGAAACGGCTTTCAGTTGAGC
TGACCAGCTCTCTCTTCAGAACAGAGCCAATGGCTTGGAATGAGACTGCT
GATCTTGGACTTGATATTGGTGCCCAGGGAGAACCCCTTGGATATCGCCA
GGATGATCCTAGCTATCGTTCTTTTCACTCTGGTGGATATGGCCAGGATG
CCTTGGGTATGGACCCCATGATGGAACATGAGATGGGTGGCCACCACCCT
GGTGCTGACTATCCAGTTGATGGGCTGCCAGATCTGGGGCATGCCCAGGA
CCTCATGGATGGGCTGCCTCCAGGTGACAGCAATCAGCTGGCCTGGTTTG
ATACTGACCTGTAAATCATCCTTTAGCTGTATTGTCTGAACTTGCATTGT
GATTGGCCTGTAGAGTTGCTGAGAGGGCTCGAGGGGTGGGCTGGTATCTC
AGAAAGTGCCTGACACACTAACCAAGCTGAGTTTCCTATGGGAACAATTG
AAGTAAACTTTTTGTTCTGGTCCTTTTTGGTCGAGGAGTAACAATACAAA
TGGATTTTGGGAGTGACTCAAGAAGTGAAGAATGCACAAGAATGGATCAC
AAGATGGAATTTATCAAACCCTAGCCTTGCTTGTTAAATTTTTTTTTTT
TTTTTTTAAGAATATCTGTAATGGTACTGACTTTGCTTGCTTTGAAGTAG
CTCTTTTTTTTTTTTTTTTTTTTGCAGTAACTGTTTTTTAAGTCT
CTCGTAGTGTTAAGTTATAGTGAATACTGCTACAGCAATTTCTAATTTTT
AAGAATTGAGTAATGGTGTAGAACACTAATTCATAATCACTCTAATTAAT
TGTAATCTGAATAAAGTGTAACAATTGTGTAGCCTTTTTGTATAAAATAG
ACAAATAGAAAATGGTCCAATTAGTTTCCTTTTTAATATGCTTAAAATAA
GCAGGTGGATCTATTTCATGTTTTTGATCAAAAACTATTTGGGATATGTA
TGGGTAGGGTAAATCAGTAAGAGGTGTTATTTGGAACCTTGTTTTGGACA
GTTTACCAGTTGCCTTTTATCCCAAAGTTGTTGTAACCTGCTGTGATACG
ATGCTTCAAGAGAAAATGCGGTTATAAAAAATGGTTCAGAATTAAACTTT
TAATTCATTCGATTG

Human Wild-type β-catenin (cadherin-associated
protein) sequence, transcript variant 3
(SEQ ID NO: 3; Homo sapiens CTNNB1, transcript
variant 3; GenBank Accession No. NM_001098210.1):
AGGATACAGCGGCTTCTGCGCGACTTATAAGAGCTCCTTGTGCGGCGCCA

TTTTAAGCCTCTCGGTCTGTGGCAGCAGCGTTGGCCCGGCCCCGGGAGCG

GAGAGCGAGGGGAGGCGGAGACGGAGGAAGGTCTGAGGAGCAGCTTCAGT
CCCCGCCGAGCCGCCACCGCAGGTCGAGGACGGTCGGACTCCCGCGGCGG
GAGGAGCCTGTTCCCCTGAGGGTATTTGAAGTATACCATACAACTGTTTT
GAAAATCCAGCGTGGACAATGGCTACTCAAGCTGATTTGATGGAGTTGGA
CATGGCCATGGAACCAGACAGAAAAGCGGCTGTTAGTCACTGGCAGCAAC
AGTCTTACCTGGACTCTGGAATCCATTCTGGTGCCACTACCACAGCTCCT
TCTCTGAGTGGTAAAGGCAATCCTGAGGAAGAGGATGTGGATACCTCCCA
AGTCCTGTATGAGTGGGAACAGGGATTTTCTCAGTCCTTCACTCAAGAAC
AAGTAGCTGATATTGATGGACAGTATGCAATGACTCGAGCTCAGAGGGTA
CGAGCTGCTATGTTCCCTGAGACATTAGATGAGGGCATGCAGATCCCATC
TACACAGTTTGATGCTGCTCATCCCACTAATGTCCAGCGTTTGGCTGAAC
CATCACAGATGCTGAAACATGCAGTTGTAAACTTGATTAACTATCAAGAT
GATGCAGAACTTGCCACACGTGCAATCCCTGAACTGACAAAACTGCTAAA
TGACGAGGACCAGGTGGTGGTTAATAAGGCTGCAGTTATGGTCCATCAGC
TTTCTAAAAAGGAAGCTTCCAGACACGCTATCATGCGTTCTCCTCAGATG
GTGTCTGCTATTGTACGTACCATGCAGAATACAAATGATGTAGAAACAGC
TCGTTGTACCGCTGGGACCTTGCATAACCTTTCCCATCATCGTGAGGGCT
TACTGGCCATCTTTAAGTCTGGAGGCATTCCTGCCCTGGTGAAAATGCTT
GGTTCACCAGTGGATTCTGTGTTGTTTTATGCCATTACAACTCTCCACAA
CCTTTTATTACATCAAGAAGGAGCTAAAATGGCAGTGCGTTTAGCTGGTG
GGCTGCAGAAAATGGTTGCCTTGCTCAACAAAACAAATGTTAAATTCTTG
GCTATTACGACAGACTGCCTTCAAATTTTAGCTTATGGCAACCAAGAAAG
CAAGCTCATCATACTGGCTAGTGGTGGACCCAAGCTTTAGTAAATATAA
TGAGGACCTATACTTACGAAAAACTACTGTGGACCACAAGCAGAGTGCTG
AAGGTGCTATCTGTCTGCTCTAGTAATAAGCCGGCTATTGTAGAAGCTGG
TGGAATGCAAGCTTTAGGACTTCACCTGACAGATCCAAGTCAACGTCTTG
TTCAGAACTGTCTTTGGACTCTCAGGAATCTTTCAGATGCTGCAACTAAA
CAGGAAGGGATGGAAGGTCTCCTTGGGACTCTTGTTCAGCTTCTGGGTTC
AGATGATATAAATGTGGTCACCTGTGCAGCTGGAATTCTTTCTAACCTCA
CTTGCAATAATTATAAGAACAAGATGATGGTCTGCCAAGTGGGTGGTATA
GAGGCTCTTGTGCGTACTGTCCTTCGGGCTGGTGACAGGGAAGACATCAC
TGAGCCTGCCATCTGTGCTCTTCGTCATCTGACCAGCCGACACCAAGAAG
CAGAGATGGCCCAGAATGCAGTTCGCCTTCACTATGGACTACCAGTTGTG
GTTAAGCTCTTACACCCACCATCCCACTGGCCTCTGATAAAGGCTACTGT
TGGATTGATTCGAAATCTTGCCCTTTGTCCCGCAAATCATGCACCTTTGC
GTGAGCAGGGTGCCATTCCACGACTAGTTCAGTTGCTTGTTCGTGCACAT
CAGGATACCCAGCGCCGTACGTCCATGGGTGGGACACAGCAGCAATTTGT
GGAGGGGGTCCGCATGGAAGAAATAGTTGAAGGTTGTACCGGAGCCCTTC
ACATCCTAGCTCGGGATGTTCACAACCGAATTGTTATCAGAGGACTAAAT
ACCATTCCATTGTTTGTGCAGCTGCTTTATTCTCCCATTGAAAACATCCA
AAGAGTAGCTGCAGGGGTCCTCTGTGAACTTGCTCAGGACAAGGAAGCTG

-continued
```
CAGAAGCTATTGAAGCTGAGGGAGCCACAGCTCCTCTGACAGAGTTACTT
CACTCTAGGAATGAAGGTGTGGCGACATATGCAGCTGCTGTTTTGTTCCG
AATGTCTGAGGACAAGCCACAAGATTACAAGAAACGGCTTTCAGTTGAGC
TGACCAGCTCTCTCTTCAGAACAGAGCCAATGGCTTGGAATGAGACTGCT
GATCTTGGACTTGATATTGGTGCCCAGGGAGAACCCCTTGGATATCGCCA
GGATGATCCTAGCTATCGTTCTTTTCACTCTGGTGGATATGGCCAGGATG
CCTTGGGTATGGACCCCATGATGGAACATGAGATGGGTGGCCACCACCCT
GGTGCTGACTATCCAGTTGATGGGCTGCCAGATCTGGGGCATGCCCAGGA
CCTCATGGATGGGCTGCCTCCAGGTGACAGCAATCAGCTGGCCTGGTTTG
ATACTGACCTGTAAATCATCCTTTAGGAGTAACAATACAAATGGATTTTG
GGAGTGACTCAAGAAGTGAAGAATGCACAAGAATGGATCACAAGATGGAA
TTTATCAAACCCTAGCCTTGCTTGTTAAATTTTTTTTTTTTTTTTTAA
GAATATCTGTAATGGTACTGACTTTGCTTGCTTTGAAGTAGCTCTTTTTT
TTTTTTTTTTTTTTTTGCAGTAACTGTTTTTTAAGTCTCTCGTAGTG
TTAAGTTATAGTGAATACTGCTACAGCAATTTCTAATTTTTAAGAATTGA
GTAATGGTGTAGAACACTAATTCATAATCACTCTAATTAATTGTAATCTG
AATAAAGTGTAACAATTGTGTAGCCTTTTTGTATAAAATAGACAAATAGA
AAATGGTCCAATTAGTTTCCTTTTTAATATGCTTAAAATAAGCAGGTGGA
TCTATTTCATGTTTTTGATCAAAAACTATTTGGGATATGTATGGGTAGGG
TAAATCAGTAAGAGGTGTTATTTGGAACCTTGTTTTGGACAGTTTACCAG
TTGCCTTTTATCCCAAAGTTGTTGTAACCTGCTGTGATACGATGCTTCAA
GAGAAAATGCGGTTATAAAAAATGGTTCAGAATTAAACTTTTAATTCATT
CGATTG
```

Human Wild-type β-catenin sequence, amino acid
Sequence NP_001895.1 (SEQ ID NO: 4; translation
of NM_001904.3, NM_001098209.1 or NM_001098210.1):
```
MATQADLMELDMAMEPDRKAAVSHWQQQSYLDSGIHSGATTTAPSLSGKG
NPEEEDVDTSQVLYEWEQGFSQSFTQEQVADIDGQYAMTRAQRVRAAMFP
ETLDEGMQIPSTQFDAAHPTNVQRLAEPSQMLKHAVVNLINYQDDAELAT
RAIPELTKLLNDEDQVVVNKAAVMVHQLSKKEASRHAIMRSPQMVSAIVR
TMQNTNDVETARCTAGTLHNLSHHREGLLAIFKSGGIPALVKMLGSPVDS
VLFYAITTLHNLLLHQEGAKMAVRLAGGLQKMVALLNKTNVKFLAITTDC
LQILAYGNQESKLIILASGGPQALVNIMRTYTYEKLLWTTSRVLKVLSVC
SSNKPAIVEAGGMQALGLHLTDPSQRLVQNCLWTLRNLSDAATKQEGMEG
LLGTLVQLLGSDDINVVTCAAGILSNLTCNNYKNKMMVCQVGGIEALVRT
VLRAGDREDITEPAICALRHLTSRHQEAEMAQNAVRLHYGLPVVVKLLHP
PSHWPLIKATVGLIRNLALCPANHAPLREQGAIPRLVQLLVRAHQDTQRR
TSMGGTQQQFVEGVRMEEIVEGCTGALHILARDVHNRIVIRGLNTIPLFV
QLLYSPIENIQRVAAGVLCELAQDKEAAEAIEAEGATAPLTELLHSRNEG
VATYAAAVLFRMSEDKPQDYKKRLSVELTSSLFRTEPMAWNETADLGLDI
GAQGEPLGYRQDDPSYRSFHSGGYGQDALGMDPMMEHEMGGHHPGADYPV
DGLPDLGHAQDLMDGLPPGDSNQLAWFDTDL
```

Mouse Wild-type β-catenin sequence (SEQ ID NO: 5;
Mus musculus catenin (cadherin associated
protein), beta 1(Ctnnb1), transcript
variant 1 in C57BL/6; GenBank Accession No.
NM_007614.3; Note: mouse DsiRNA target sequence
positions correspond to NM_007614.2 below):
```
GCGCGGCGGAACGCTCCGCGCGGAGCGGCAGCGGCAGGATACACGGTGCC
GCGCCGCTTATAAATCGCTCCTTGTGCGGCGCCATCTTAAGCCCTCGCTC
GGTGGCGGCCGCGTCAGCTCGTGTCCTGTGAAGCCCGCGGCCCGGGGAGG
CGGAGACGGAGCACGGTGGGCGCCGAGCCGTCAGTGCAGGAGGCCGAGGC
CGAGCGGGCGGCCGCGAGTGAGCAGCGCGCGGGCCTGAGGGTACCTGAAG
CTCAGCGCACAGCTGCTGTGACACCGCTGCGTGGACAATGGCTACTCAAG
CTGACCTGATGGAGTTGGACATGGCCATGGAGCCGGACAGAAAAGCTGCT
GTCAGCCACTGGCAGCAGCAGTCTTACTTGGATTCTGGAATCCATTCTGG
TGCCACCACCACAGCTCCTTCCCTGAGTGGCAAGGGCAACCCTGAGGAAG
AAGATGTTGACACCTCCCAAGTCCTTTATGAATGGGAGCAAGGCTTTTCC
CAGTCCTTCACGCAAGAGCAAGTAGCTGATATTGACGGGCAGTATGCAAT
GACTAGGGCTCAGAGGGTCCGAGCTGCCATGTTCCCTGAGACGCTAGATG
AGGGCATGCAGATCCCATCCACGCAGTTTGACGCTGCTCATCCCACTAAT
GTCCAGCGCTTGGCTGAACCATCACAGATGTTGAAACATGCAGTTGTCAA
TTTGATTAACTATCAGGATGACGCGGAACTTGCCACACGTGCAATTCCTG
AGCTGACAAAACTGCTAAACGATGAGGACCAGGTGGTAGTTAATAAAGCT
GCTGTTATGGTCCATCAGCTTTCCAAAAAGGAAGCTTCCAGACATGCCAT
CATGCGCTCCCCTCAGATGGTGTCTGCCATTGTACGCACCATGCAGAATA
CAAATGATGTAGAGACAGCTCGTTGTACTGCTGGGACTCTGCACAACCTT
TCTCACCACCGCGAGGGCTTGCTGGCCATCTTTAAGTCTGGTGGCATCCC
AGCGCTGGTGAAAATGCTTGGGTCACCAGTGGATTCTGTACTGTTCTACG
CCATCACGACACTGCATAATCTCCTGCTCCATCAGGAAGGAGCTAAAATG
GCAGTGCGCCTAGCTGGTGGACTGCAGAAAATGGTTGCTTTGCTCAACAA
AACAAACGTGAAATTCTTGGCTATTACAACAGACTGCCTTCAGATCTTAG
CTTATGGCAATCAAGAGAGCAAGCTCATCATTCTGGCCAGTGGTGGACCC
CAAGCCTTAGTAAACATAATGAGGACCTACACTTATGAGAAGCTTCTGTG
GACCACAAGCAGAGTGCTGAAGGTGCTGTCTGTCTGCTCTAGCAACAAGC
CGGCCATTGTAGAAGCTGGTGGGATGCAGGCACTGGGGCTTCATCTGACA
GACCCAAGTCAGCGACTTGTTCAAAACTGTCTTTGGACTCTCAGAAACCT
TTCAGATGCAGCGACTAAGCAGGAAGGGATGGAAGGCCTCCTTGGGACTC
TAGTGCAGCTTCTGGGTTCCGATGATATAAATGTGGTCACCTGTGCAGCT
GGAATTCTCTCTAACCTCACTTGCAATAATTACAAAAACAAGATGATGGT
GTGCCAAGTGGGTGGCATAGAGGCTCTTGTACGCACCGTCCTTCGTGCTG
GTGACAGGGAAGACATCACTGAGCCTGCCATCTGTGCTCTTCGTCATCTG
ACCAGCCGGCATCAGGAAGCCGAGATGGCCCAGAATGCCGTTCGCCTTCA
TTATGGACTGCCTGTTGTGGTTAAACTCCTGCACCCACCATCCCACTGGC
CTCTGATAAAGGCAACTGTTGGATTGATTCGAAACCTTGCCCTTTGCCCA
GCAAATCATGCGCCTTTGCGGGAACAGGGTGCTATTCCACGACTAGTTCA
```

```
GCTGCTTGTACGAGCACATCAGGACACCCAACGGCGCACCTCCATGGGTG

GAACGCAGCAGCAGTTTGTGGAGGGCGTGCGCATGGAGGAGATAGTAGAA

GGGTGTACTGGAGCTCTCCACATCCTTGCTCGGGACGTTCACAACCGGAT

TGTAATCCGAGGACTCAATACCATTCCATTGTTTGTGCAGTTGCTTTATT

CTCCCATTGAAAATATCCAAAGAGTAGCTGCAGGGGTCCTCTGTGAACTT

GCTCAGGACAAGGAGGCTGCAGAGGCCATTGAAGCTGAGGGAGCCACAGC

TCCCCTGACAGAGTTACTCCACTCCAGGAATGAAGGCGTGGCAACATACG

CAGCTGCTGTCCTATTCCGAATGTCTGAGGACAAGCCACAGGATTACAAG

AAGCGGCTTTCAGTCGAGCTGACCAGTTCCCTCTTCAGGACAGAGCCAAT

GGCTTGGAATGAGACTGCAGATCTTGGACTGGACATTGGTGCCCAGGGAG

AAGCCCTTGGATATCGCCAGGATGATCCCAGCTACCGTTCTTTTCACTCT

GGTGGATACGGCCAGGATGCCTTGGGGATGGACCCTATGATGGAGCATGA

GATGGGTGGCCACCACCCTGGTGCTGACTATCCAGTTGATGGGCTGCCTG

ATCTGGGACACGCCCAGGACCTCATGGATGGGCTGCCCCCAGGTGATAGC

AATCAGCTGGCCTGGTTTGATACTGACCTGTAAATCGTCCTTTAGGTAAG

AAAGCTTATAAAAGCCAGTGTGGGTGAATACTTTACTCTGCCTGCAGAAC

TCCAGAAAGACTTGGTAGGGTGGGAATGGTTTTAGGCCTGTTTGTAAATC

TGCCACCAAACAGATACATACCTTGGAAGGAGATGTTCATGTGTGGAAGT

TTCTCACGTTGATGTTTTGCCACAGCTTTTGCAGCGTTATACTCAGATG

AGTAACATTTGCTGTTTTCAACATTAATAGCAGCCTTTCTCTCTATACAG

CTGTAGTGTCTGAACGTGCATTGTGATTGGCCTGTAGAGTTGCTGAGAGG

GCTCGAGGGGTGGGCTGGTATCTCAGAAAGTGCCTGACACACTAACCAAG

CTGAGTTTCCTATGGGAACAGTCGAAGTACGCTTTTTGTTCTGGTCCTTT

TTGGTCGAGGAGTAACAATACAAATGGATTTGGGGAGTGACTCACGCAGT

GAAGAATGCACACGAATGGATCACAAGATGGCGTTATCAAACCCTAGCCT

TGCTTGTTCTTTGTTTTAATATCTGTAGTGGTGCTGACTTTGCTTGCTTT

TATTTTTTGCAGTAACTGTTAGTTTTTAAGTAGTGTTATGTTCTAGTGAA

CCTGCTACAGCAATTTCTGATTTCTAAGAACCGAGTAATGGTGTAGAACA

CTAATTCATAATCACGCTAATTGTAATCTGGAGACGTGTAACATTGTGTA

GCCTTTTGTATAAATAGACAGATAGAAATGGTCCGATTAGTTTCCTTTTT

AATATGCTTAAAATAAGCAGGTGGATCTATTTCATGTTTTTGAACAAAAA

CTTTATCGGGGATACGTGCGGTAGGGTAAATCAGTAAGAGGTGTTATTTG

AGCCTTGTTTTGGACAGTATACCAGTTGCCTTTTATCCCAAAGTTGTTGT

AACCTGCTGTGATACAATGCTTCAACAGATGCGGTTATAGAAATGGTTCA

GAATTAAACTTTTAATTCATTCAAAAAAAAAAAAAAAAA

Mouse Wild-type β-catenin sequence (SEQ ID NO: 6;
Mus musculus catenin (cadherin associated
protein), beta 1 (Ctnnb1) in C57BL/6; GenBank
Accession No. NM_007614.2; mouse DsiRNA target
sequence positions correspond to NM_007614.2):
GCGGCGCCATCTTAAGCCCTCGCTCGGTGGCGGCCGCGTCAGCTCGTGTC

CTGTGAAGCCCGCGGCCCGGGGAGGCGGAGACGGAGCACGGTGGGCGCCG

AGCCGTCAGTGCAGGAGGCCGAGGCCGAGCGGGCGGCCGCGAGTGAGCAG

CGCGCGGGCCTGAGGGTACCTGAAGCTCAGCGCACAGCTGCTGTGACACC

GCTGCGTGGACAATGGCTACTCAAGCTGACCTGATGGAGTTGGACATGGC

CATGGAGCCGGACAGAAAAGCTGCTGTCAGCCACTGGCAGCAGCAGTCTT

ACTTGGATTCTGGAATCCATTCTGGTGCCACCACCACAGCTCCTTCCCTG

AGTGGCAAGGGCAACCCTGAGGAAGAAGATGTTGACACCTCCCAAGTCCT

TTATGAATGGGAGCAAGGCTTTTCCCAGTCCTTCACGCAAGAGCAAGTAG

CTGATATTGACGGGCAGTATGCAATGACTAGGGCTCAGAGGGTCCGAGCT

GCCATGTTCCCTGAGACGCTAGATGAGGGCATGCAGATCCCATCCACGCA

GTTTGACGCTGCTCATCCCACTAATGTCCAGCGCTTGGCTGAACCATCAC

AGATGTTGAAACATGCAGTTGTCAATTTGATTAACTATCAGGATGACGCG

GAACTTGCCACACGTGCAATTCCTGAGCTGACAAAACTGCTAAACGATGA

GGACCAGGTGGTAGTTAATAAAGCTGCTGTTATGGTCCATCAGCTTTCCA

AAAAGGAAGCTTCCAGACATGCCATCATGCGCTCCCCTCAGATGGTGTCT

GCCATTGTACGCACCATGCAGAATACAAATGATGTAGAGACAGCTCGTTG

TACTGCTGGGACTCTGCACAACCTTTCTCACCACCGCGAGGGCTTGCTGG

CCATCTTTAAGTCTGGTGGCATCCCAGCGCTGGTGAAAATGCTTGGGTCA

CCAGTGGATTCTGTACTGTTCTACGCCATCACGACACTGCATAATCTCCT

GCTCCATCAGGAAGGAGCTAAAATGGCAGTGCGCCTAGCTGGTGGACTGC

AGAAAATGGTTGCTTTGCTCAACAAAACAAACGTGAAATTCTTGGCTATT

ACAACAGACTGCCTTCAGATCTTAGCTTATGGCAATCAAGAGAGCAAGCT

CATCATTCTGGCCAGTGGTGGACCCCAAGCCTTAGTAAACATAATGAGGA

CCTACACTTATGAGAAGCTTCTGTGGACCACAAGCAGAGTGCTGAAGGTG

CTGTCTGTCTGCTCTAGCAACAAGCCGGCCATTGTAGAAGCTGGTGGGAT

GCAGGCACTGGGGCTTCATCTGACAGACCCAAGTCAGCGACTTGTCAAA

ACTGTCTTTGGACTCTCAGAAACCTTTCAGATGCAGCGACTAAGCAGGAA

GGGATGGAAGGCCTCCTTGGGACTCTAGTGCAGCTTCTGGGTTCCGATGA

TATAAATGTGGTCACCTGTGCAGCTGGAATTCTCTCTAACCTCACTTGCA

ATAATTACAAAAACAAGATGATGGTGTGCCAAGTGGGTGGCATAGAGGCT

CTTGTACGCACCGTCCTTCGTGCTGGTGACAGGGAAGACATCACTGAGCC

TGCCATCTGTGCTCTTCGTCATCTGACCAGCCGGCATCAGGAAGCCGAGA

TGGCCCAGAATGCCGTTCGCCTTCATTATGGACTGCCTGTTGTGGTTAAA

CTCCTGCACCCACCATCCCACTGGCCTCTGATAAAGGCAACTGTTGGATT

GATTCGAAACCTTGCCCTTTGCCCAGCAAATCATGCGCCTTTGCGGGAAC

AGGGTGCTATTCCACGACTAGTTCAGCTGCTTGTACGAGCACATCAGGAC

ACCCAACGGCGCACCTCCATGGGTGGAACGCAGCAGCAGTTTGTGGAGGG

CGTGCGCATGGAGGAGATAGTAGAAGGGTGTACTGGAGCTCTCCACATCC

TTGCTCGGGACGTTCACAACCGGATTGTAATCCGAGGACTCAATACCATT

CCATTGTTTGTGCAGTTGCTTTATTCTCCCATTGAAAATATCCAAAGAGT

AGCTGCAGGGGTCCTCTGTGAACTTGCTCAGGACAAGGAGGCTGCAGAGG

CCATTGAAGCTGAGGGAGCCACAGCTCCCCTGACAGAGTTACTCCACTCC

AGGAATGAAGGCGTGGCAACATACGCAGCTGCTGTCCTATTCCGAATGTC
```

-continued

```
TGAGGACAAGCCACAGGATTACAAGAAGCGGCTTTCAGTCGAGCTGACCA

GTTCCCTCTTCAGGACAGAGCCAATGGCTTGGAATGAGACTGCAGATCTT

GGACTGGACATTGGTGCCCAGGGAGAAGCCCTTGGATATCGCCAGGATGA

TCCCAGCTACCGTTCTTTTCACTCTGGTGGATACGGCCAGGATGCCTTGG

GGATGGACCCTATGATGGAGCATGAGATGGGTGGCCACCACCCTGGTGCT

GACTATCCAGTTGATGGGCTGCCTGATCTGGGACACGCCCAGGACCTCAT

GGATGGGCTGCCCCCAGGTGATAGCAATCAGCTGGCCTGGTTTGATACTG

ACCTGTAAATCGTCCTTTAGGTAAGAAAGCTTATAAAAGCCAGTGTGGGT

GAATACTTTACTCTGCCTGCAGAACTCCAGAAAGACTTGGTAGGGTGGGA

ATGGTTTTAGGCCTGTTTGTAAATCTGCCACCAAACAGATACATACCTTG

GAAGGAGATGTTCATGTGTGGAAGTTTCTCACGTTGATGTTTTTGCCACA

GCTTTTGCAGCGTTATACTCAGATGAGTAACATTTGCTGTTTTCAACATT

AATAGCAGCCTTTCTCTCTATACAGCTGTAGTGTCTGAACGTGCATTGTG

ATTGGCCTGTAGAGTTGCTGAGAGGGCTCGAGGGGTGGGCTGGTATCTCA

GAAAGTGCCTGACACACTAACCAAGCTGAGTTTCCTATGGGAACAGTCGA

AGTACGCTTTTGTTCTGGTCCTTTTTGGTCGAGGAGTAACAATACAAAT

GGATTTGGGGAGTGACTCACGCAGTGAAGAATGCACACGAATGGATCACA

AGATGGCGTTATCAAACCCTAGCCTTGCTTGTTCTTTGTTTTAATATCTG

TAGTGGTGCTGACTTTGCTTGCTTTTATTTTTGCAGTAACTGTTAGTTT

TTAAGTAGTGTTATGTTCTAGTGAACCTGCTACAGCAATTTCTGATTTCT

AAGAACCGAGTAATGGTGTAGAACACTAATTCATAATCACGCTAATTGTA

ATCTGGAGACGTGTAACATTGTGTAGCCTTTTGTATAAATAGACAGATAG

AAATGGTCCGATTAGTTTCCTTTTTAATATGCTTAAAATAAGCAGGTGGA

TCTATTTCATGTTTTTGAACAAAAACTTTATCGGGGATACGTGCGGTAGG

GTAAATCAGTAAGAGGTGTTATTTGAGCCTTGTTTTGGACAGTATACCAG

TTGCCTTTTATCCCAAAGTTGTTGTAACCTGCTGTGATACAATGCTTCAA

CAGATGCGGTTATAGAAATGGTTCAGAATTAAACTTTTAATTCATTCAAA

AAAAAAAAAAAAAA

Mouse Wild-type β-catenin Amino Acid Sequence
NP_031640.1 (SEQ ID NO: 7; translation of
NM_007614.2 or NM_007614.3):
MATQADLMELDMAMEPDRKAAVSHWQQQSYLDSGIHSGATTTAPSLSGKG

NPEEEDVDTSQVLYEWEQGFSQSFTQEQVADIDGQYAMTRAQRVRAAMFP

ETLDEGMQIPSTQFDAAHPTNVQRLAEPSQMLKHAVVNLINYQDDAELAT

RAIPELTKLLNDEDQVVVNKAAVMVHQLSKKEASRHAIMRSPQMVSAIVR

TMQNTNDVETARCTAGTLHNLSHHREGLLAIFKSGGIPALVKMLGSPVDS

VLFYAITTLHNLLLHQEGAKMAVRLAGGLQKMVALLNKTNVKFLAITTDC

LQILAYGNQESKLIILASGGPQALVNIMRTYTYEKLLWTTSRVLKVLSVC

SSNKPAIVEAGGMQALGLHLTDPSQRLVQNCLWTLRNLSDAATKQEGMEG

LLGTLVQLLGSDDINVVTCAAGILSNLTCNNYKNKMMVCQVGGIEALVRT

VLRAGDREDITEPAICALRHLTSRHQEAEMAQNAVRLHYGLPVVVKLLHP

PSHWPLIKATVGLIRNLALCPANHAPLREQGAIPRLVQLLVRAHQDTQRR

TSMGGTQQQFVEGVRMEEIVEGCTGALHILARDVHNRIVIRGLNTIPLFV

QLLYSPIENIQRVAAGVLCELAQDKEAAEAIEAEGATAPLTELLHSRNEG

VATYAAAVLFRMSEDKPQDYKKRLSVELTSSLFRTEPMAWNETADLGLDI

GAQGEALGYRQDDPSYRSFHSGGYGQDALGMDPMMEHEMGGHHPGADYPV

DGLPDLGHAQDLMDGLPPGDSNQLAWFDTDL
```

β-catenin is a protein that in humans is encoded by the CTNNB1 gene (Kraus et al. Genomics 23: 272-4)—accordingly, reference herein to the human "β-catenin gene" specifically refers to the CTNNB1 gene. β-catenin is a subunit of the cadherin protein complex and has been demonstrated to be an integral component in the Wnt signaling pathway. *Drosophila armadillo* is a β-catenin homolog, rendering β-catenin a member of the armadillo family.

As a member of the armadillo family, the β-catenin protein contains multiple copies of the so-called armadillo repeat domain, which is a domain specialized for protein-protein binding. When β-catenin is not associated with cadherins and alpha-catenin, it can interact with other proteins such as ICAT and APC.

Functionally, cadherin complexes constitute adherens junctions (Ajs), which are required for creation and maintenance of epithelial cell layers via regulation of cell growth and adhesion between neighboring cells. β-catenin also anchors the actin cytoskeleton and is modeled to be responsible for transmitting contact inhibition signals that cause cells to stop dividing once an epithelial sheet is complete (EntrezGene: catenin). β-catenin has been shown to play a significant role in liver biology, e.g., liver development (both embryonic and postnatal), liver regeneration following partial hepatectomy, HGF-induced hepatomegaly, liver zonation, and pathogenesis of liver cancer (Thompson and Monga. *Hepatology* 45: 1298-1305).

Without being bound by theory, β-catenin is modeled to function in the Wnt signaling pathway in the following manner. When Wnt is not present, GSK-3 (a kinase) constitutively phosphorylates the β-catenin protein. β-catenin is associated with axin (scaffolding protein) complexed with GSK3 and APC (adenomatosis polyposis coli). The creation of this complex acts to substantially increase the phosphorylation of β-catenin by facilitating the action of GSK3. When β-catenin is phosphorylated, it is degraded and, thus, β-catenin does not build up in the cell to a significant level. When Wnt binds to frizzled (Fz), its receptor, dishevelled (Dsh), is recruited to the membrane. GSK3 is inhibited by the activation of Dsh by Fz. Because of this, β-catenin is permitted to build up in the cytosol and can be subsequently translocated into the nucleus, where it performs a variety of functions. β-catenin can act in conjunction with TCF and LEF to activate specific target genes involved in different processes.

β-catenin is an oncogene. An increase in β-catenin production has been noted in subjects with basal cell carcinoma, and such increase leads to the increase in proliferation of related tumors (Saldanha et al. *Br. J. Dermatol.* 151: 157-64). Mutations in β-catenin are a cause of colorectal cancer (CRC), pilomatrixoma (PTR), medulloblastoma (MDB), and ovarian cancer. β-catenin also binds to the product of the APC gene, which is mutated in adenomatous polyposis of the colon.

The ability of β-catenin to bind to other proteins is regulated by tyrosine kinases (Lilien and Balsamo *Curr. Opin. Cell Biol.* 17: 459-65) and serine kinases such as GSK-3 (Castellone et al. *Science* 310: 1504-10). When β-catenin is not assembled in complexes with cadherins, it can form a complex with axin. While bound to axin, β-catenin can be phosphorylated by GSK-3, which creates a signal for the rapid ubiquitin-dependent degradation of β-catenin by proteosomes. Various signals such as the Wnt signalling pathway can inhibit GSK-3-mediated phosphorylation of β-catenin (Liu et al. *Curr. Biol.* 15: 1989-97), allowing β-catenin to go to the cell nucleus, interact with transcription factors, and regulate gene transcription.

β-catenin can be phosphorylated by other kinases such as protein kinase A (PKA). Phosphorylation of β-catenin by PKA has been associated with reduced degradation of β-catenin, increased levels of β-catenin in the nucleus and interaction of β-catenin with TCF family transcription factors to regulate gene expression (Hino et al. *Mol. Cell. Biol.* 25: 9063-72).

β-catenin has also been shown to interact with the following proteins: Androgen receptor, APC, AXIN1, CBY1, CDH1, CDH2, CDH3, CDK5R1, CHUK, CTNNA1, CTNND1, EGFR, FHL2, GSK3B, HER2/neu, HNF4A, IKK2, LEF1, MAGI1, MUC1, NR5A1, PCAF, PHF17, Plakoglobin, PTPN14, PTPRF, PRPRK, PSEN1, RuvB-like 1, SMAD7, SLC9A3R1, SMARCA4, USP9X and VE-cadherin (http://en.wikipedia.org/wiki/Beta-catenin).

In Vitro Assay to Assess DsiRNA β-Catenin Inhibitory Activity

An in vitro assay that recapitulates RNAi in a cell-free system can be used to evaluate DsiRNA constructs targeting β-catenin RNA sequence(s), and thus to assess β-catenin-specific gene inhibitory activity (also referred to herein as (β-catenin inhibitory activity) of a DsiRNA. The assay comprises the system described by Tuschl et al., 1999, Genes and Development, 13, 3191-3197 and Zamore et al., 2000, Cell, 101, 25-33 adapted for use with DsiRNA agents directed against β-catenin RNA. A *Drosophila* extract derived from syncytial blastoderm is used to reconstitute RNAi activity in vitro. Target RNA is generated via in vitro transcription from a selected 3-catenin expressing plasmid using T7 RNA polymerase or via chemical synthesis. Sense and antisense DsiRNA strands (for example 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing DsiRNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25× Passive Lysis Buffer (Promega). Target RNA cleavage is assayed by RT-PCR analysis or other methods known in the art and are compared to control reactions in which DsiRNA is omitted from the reaction.

Alternately, internally-labeled target RNA for the assay is prepared by in vitro transcription in the presence of [alpha-$^{32}$P] CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without DsiRNA and the cleavage products generated by the assay.

In one embodiment, this assay is used to determine target sites in the β-catenin RNA target for DsiRNA mediated RNAi cleavage, wherein a plurality of DsiRNA constructs are screened for RNAi mediated cleavage of the β-catenin RNA target, for example, by analyzing the assay reaction by electrophoresis of labeled target RNA, or by northern blotting, as well as by other methodology well known in the art.

In certain embodiments, a DsiRNA of the invention is deemed to possess 3-catenin inhibitory activity if, e.g., a 50% reduction in β-catenin RNA levels is observed in a system, cell, tissue or organism, relative to a suitable control. Additional metes and bounds for determination of β-catenin inhibitory activity of a DsiRNA of the invention are described supra.

Conjugation and Delivery of Anti-β-Catenin DsiRNA Agents

In certain embodiments the present invention relates to a method for treating a subject having a β-catenin-associated disease or disorder, or at risk of developing a β-catenin-associated disease or disorder. In such embodiments, the DsiRNA can act as novel therapeutic agents for controlling the β-catenin-associated disease or disorder. The method comprises administering a pharmaceutical composition of the invention to the patient (e.g., human), such that the expression, level and/or activity of a β-catenin RNA is reduced. The expression, level and/or activity of a polypeptide encoded by a β-catenin RNA might also be reduced by a DsiRNA of the instant invention, even where said DsiRNA is directed against a non-coding region of the β-catenin transcript (e.g., a targeted 5' UTR or 3' UTR sequence). Because of their high specificity, the DsiRNAs of the present invention can specifically target (3-catenin sequences of cells and tissues, optionally in an allele-specific manner where polymorphic alleles exist within an individual and/or population.

In the treatment of a β-catenin-associated disease or disorder, the DsiRNA can be brought into contact with the cells or tissue of a subject, e.g., the cells or tissue of a subject exhibiting disregulation of β-catenin and/or otherwise targeted for reduction of β-catenin levels. For example, DsiRNA substantially identical to all or part of a (3-catenin RNA sequence, may be brought into contact with or introduced into such a cell, either in vivo or in vitro. Similarly, DsiRNA substantially identical to all or part of a β-catenin RNA sequence may administered directly to a subject having or at risk of developing a β-catenin-associated disease or disorder.

Therapeutic use of the DsiRNA agents of the instant invention can involve use of formulations of DsiRNA agents comprising multiple different DsiRNA agent sequences. For example, two or more, three or more, four or more, five or more, etc. of the presently described agents can be combined to produce a formulation that, e.g., targets multiple different regions of the β-catenin RNA, or that not only target β-catenin RNA but also target, e.g., cellular target genes associated with a β-catenin-associated disease or disorder. A DsiRNA agent of the instant invention may also be constructed such that either strand of the DsiRNA agent independently targets two or more regions of β-catenin RNA, or such that one of the strands of the DsiRNA agent targets a cellular target gene of β-catenin known in the art.

Use of multifunctional DsiRNA molecules that target more then one region of a target nucleic acid molecule can also provide potent inhibition of β-catenin RNA levels and expression. For example, a single multifunctional DsiRNA construct of the invention can target both the βc-1569 and βc-1683 sites simultaneously; additionally and/or alternatively, single or multifunctional agents of the invention can be designed to selectively target one splice variant of β-catenin over another.

Thus, the DsiRNA agents of the instant invention, individually, or in combination or in conjunction with other drugs, can be used to treat, inhibit, reduce, or prevent a β-catenin-associated disease or disorder. For example, the DsiRNA molecules can be administered to a subject or can be administered to other appropriate cells evident to those skilled in the art, individually or in combination with one or more drugs under conditions suitable for the treatment.

The DsiRNA molecules also can be used in combination with other known treatments to treat, inhibit, reduce, or prevent a β-catenin-associated disease or disorder in a subject or organism. For example, the described molecules could be used in combination with one or more known compounds, treatments, or procedures to treat, inhibit, reduce, or prevent a β-catenin-associated disease or disorder in a subject or organism as are known in the art.

A DsiRNA agent of the invention can be conjugated (e.g., at its 5' or 3' terminus of its sense or antisense strand) or unconjugated to another moiety (e.g. a non-nucleic acid moiety such as a peptide), an organic compound (e.g., a dye, cholesterol, or the like). Modifying DsiRNA agents in this way may improve cellular uptake or enhance cellular targeting activities of the resulting DsiRNA agent derivative as compared to the corresponding unconjugated DsiRNA agent, are useful for tracing the DsiRNA agent derivative in the cell, or improve the stability of the DsiRNA agent derivative compared to the corresponding unconjugated DsiRNA agent.

Methods of Introducing Nucleic Acids, Vectors, and Host Cells

DsiRNA agents of the invention may be directly introduced into a cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The DsiRNA agents of the invention can be introduced using nucleic acid delivery methods known in art including injection of a solution containing the nucleic acid, bombardment by particles covered by the nucleic acid, soaking the cell or organism in a solution of the nucleic acid, or electroporation of cell membranes in the presence of the nucleic acid. Other methods known in the art for introducing nucleic acids to cells may be used, such as lipid-mediated carrier transport, chemical-mediated transport, and cationic liposome transfection such as calcium phosphate, and the like. The nucleic acid may be introduced along with other components that perform one or more of the following activities: enhance nucleic acid uptake by the cell or other-wise increase inhibition of the target β-catenin RNA.

A cell having a target β-catenin RNA may be from the germ line or somatic, totipotent or pluripotent, dividing or non-dividing, parenchyma or epithelium, immortalized or transformed, or the like. The cell may be a stem cell or a differentiated cell. Cell types that are differentiated include adipocytes, fibroblasts, myocytes, cardiomyocytes, endothelium, neurons, glia, blood cells, megakaryocytes, lymphocytes, macrophages, neutrophils, eosinophils, basophils, mast cells, leukocytes, granulocytes, keratinocytes, chondrocytes, osteoblasts, osteoclasts, hepatocytes, and cells of the endocrine or exocrine glands.

Depending on the particular target β-catenin RNA sequence and the dose of DsiRNA agent material delivered, this process may provide partial or complete loss of function for the β-catenin RNA. A reduction or loss of RNA levels or expression (either β-catenin RNA expression or encoded polypeptide expression) in at least 50%, 60%, 70%, 80%, 90%, 95% or 99% or more of targeted cells is exemplary Inhibition of β-catenin RNA levels or expression refers to the absence (or observable decrease) in the level of β-catenin RNA or β-catenin RNA-encoded protein. Specificity refers to the ability to inhibit the β-catenin RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS). Inhibition of target β-catenin RNA sequence(s) by the DsiRNA agents of the invention also can be measured based upon the effect of administration of such DsiRNA agents upon development/progression of a β-catenin-associated disease or disorder, e.g., tumor formation, growth, metastasis, etc., either in vivo or in vitro. Treatment and/or reductions in tumor or cancer cell levels can include halting or reduction of growth of tumor or cancer cell levels or reductions of, e.g., 10%, 20%, 30%, 40%, 50%, 60%, 70%, 80%, 90%, 95% or 99% or more, and can also be measured in logarithmic terms, e.g., 10-fold, 100-fold, 1000-fold, $10^5$-fold, $10^6$-fold, $10^7$-fold reduction in cancer cell levels could be achieved via administration of the DsiRNA agents of the invention to cells, a tissue, or a subject.

For RNA-mediated inhibition in a cell line or whole organism, expression a reporter or drug resistance gene whose protein product is easily assayed can be measured. Such reporter genes include acetohydroxyacid synthase (AHAS), alkaline phosphatase (AP), β galactosidase (LacZ), β glucoronidase (GUS), chloramphenicol acetyltransferase (CAT), green fluorescent protein (GFP), horseradish peroxidase (HRP), luciferase (Luc), nopaline synthase (NOS), octopine synthase (OCS), and derivatives thereof. Multiple selectable markers are available that confer resistance to ampicillin, bleomycin, chloramphenicol, gentarnycin, hygromycin, kanamycin, lincomycin, methotrexate, phosphinothricin, puromycin, and tetracyclin. Depending on the assay, quantitation of the amount of gene expression allows one to determine a degree of inhibition which is greater than 10%, 33%, 50%, 90%, 95% or 99% as compared to a cell not treated according to the present invention.

Lower doses of injected material and longer times after administration of RNA silencing agent may result in inhibition in a smaller fraction of cells (e.g., at least 10%, 20%, 50%, 75%, 90%, or 95% of targeted cells). Quantitation of gene expression in a cell may show similar amounts of inhibition at the level of accumulation of target β-catenin RNA or translation of target protein. As an example, the efficiency of inhibition may be determined by assessing the amount of gene product in the cell; RNA may be detected with a hybridization probe having a nucleotide sequence outside the region used for the inhibitory DsiRNA, or translated polypeptide may be detected with an antibody raised against the polypeptide sequence of that region.

The DsiRNA agent may be introduced in an amount which allows delivery of at least one copy per cell. Higher doses (e.g., at least 5, 10, 100, 500 or 1000 copies per cell) of material may yield more effective inhibition; lower doses may also be useful for specific applications.

Pharmaceutical Compositions

In certain embodiments, the present invention provides for a pharmaceutical composition comprising the DsiRNA agent of the present invention. The DsiRNA agent sample can be suitably formulated and introduced into the environment of the cell by any means that allows for a sufficient portion of the sample to enter the cell to induce gene silencing, if it is to occur. Many formulations for dsRNA are known in the art and can be used so long as the dsRNA gains entry to the target cells so that it can act. See, e.g., U.S. published patent application Nos. 2004/0203145 A1 and 2005/0054598 A1. For example, the DsiRNA agent of the instant invention can be formulated in buffer solutions such as phosphate buffered saline solutions, liposomes, micellar structures, and capsids. Formulations of DsiRNA agent with cationic lipids can be used to facilitate transfection of the DsiRNA agent into cells. For example, cationic lipids, such as lipofectin (U.S. Pat. No. 5,705,188), cationic glycerol derivatives, and polycationic molecules, such as polylysine (published PCT International Application WO 97/30731), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Such compositions typically include the nucleic acid molecule and a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; cHeLating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in a selected solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Such methods include those described in U.S. Pat. No. 6,468,798.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

The compounds can also be administered by transfection or infection using methods known in the art, including but not limited to the methods described in McCaffrey et al. (2002), Nature, 418(6893), 38-9 (hydrodynamic transfection); Xia et al. (2002), Nature Biotechnol., 20(10), 1006-10 (viral-mediated delivery); or Putnam (1996), Am. J. Health Syst. Pharm. 53(2), 151-160, erratum at Am. J. Health Syst. Pharm. 53(3), 325 (1996).

The compounds can also be administered by a method suitable for administration of nucleic acid agents, such as a DNA vaccine. These methods include gene guns, bio injectors, and skin patches as well as needle-free methods such as the micro-particle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of a nucleic acid molecule (i.e., an effective dosage) depends on the nucleic acid selected. For instance, if a plasmid encoding a DsiRNA agent is selected, single dose amounts in the range of approximately 1 pg to 1000 mg may be administered; in some embodiments, 10, 30, 100, or 1000 pg, or 10, 30, 100, or 1000 ng, or 10, 30, 100, or 1000 µg, or 10, 30, 100, or 1000 mg may be administered. In some embodiments, 1-5 g of the compositions can be administered. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a protein, polypeptide, or antibody can include a single treatment or, preferably, can include a series of treatments.

The nucleic acid molecules of the invention can be inserted into expression constructs, e.g., viral vectors, retroviral vectors, expression cassettes, or plasmid viral vectors, e.g., using methods known in the art, including but not limited to those described in Xia et al., (2002), supra. Expression constructs can be delivered to a subject by, for example, inhalation, orally, intravenous injection, local administration (see U.S. Pat. No. 5,328,470) or by stereotactic injection (see e.g., Chen et al. (1994), Proc. Natl. Acad. Sci. USA, 91, 3054-3057). The pharmaceutical preparation of the delivery vector can include the vector in an acceptable diluent, or can comprise a slow release matrix in which the delivery vehicle is imbedded. Alternatively, where the complete delivery vector can be produced intact from recombinant cells, e.g., retroviral vectors, the pharmaceutical preparation can include one or more cells which produce the gene delivery system.

The expression constructs may be constructs suitable for use in the appropriate expression system and include, but are not limited to retroviral vectors, linear expression cassettes, plasmids and viral or virally-derived vectors, as known in the art. Such expression constructs may include one or more inducible promoters, RNA Pol III promoter systems such as U6 snRNA promoters or H1 RNA polymerase III promoters, or other promoters known in the art. The constructs can include one or both strands of the siRNA. Expression constructs expressing both strands can also include loop structures linking both strands, or each strand can be separately transcribed from separate promoters within the same construct. Each strand can also be transcribed from a separate expression construct, e.g., Tuschl (2002, *Nature Biotechnol* 20: 500-505).

It can be appreciated that the method of introducing DsiRNA agents into the environment of the cell will depend on the type of cell and the make up of its environment. For example, when the cells are found within a liquid, one preferable formulation is with a lipid formulation such as in lipofectamine and the DsiRNA agents can be added directly to the liquid environment of the cells. Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate DsiRNA agents in a buffer or saline solution and directly inject the formulated DsiRNA agents into cells, as in studies with oocytes. The direct injection of DsiRNA agents duplexes may also be done. For suitable methods of introducing dsRNA (e.g., DsiRNA agents), see U.S. published patent application No. 2004/0203145 A1.

Suitable amounts of a DsiRNA agent must be introduced and these amounts can be empirically determined using standard methods. Typically, effective concentrations of individual DsiRNA agent species in the environment of a cell will be 50 nanomolar or less, 10 nanomolar or less, or compositions in which concentrations of 1 nanomolar or less can be used. In another embodiment, methods utilizing a concentration of 200 picomolar or less, 100 picomolar or less, 50 picomolar or less, 20 picomolar or less, and even a concentration of 10 picomolar or less, 5 picomolar or less, 2 picomolar or less or 1 picomolar or less can be used in many circumstances.

The method can be carried out by addition of the DsiRNA agent compositions to an extracellular matrix in which cells can live provided that the DsiRNA agent composition is formulated so that a sufficient amount of the DsiRNA agent can enter the cell to exert its effect. For example, the method is amenable for use with cells present in a liquid such as a liquid culture or cell growth media, in tissue explants, or in whole organisms, including animals, such as mammals and especially humans.

The level or activity of a β-catenin RNA can be determined by a suitable method now known in the art or that is later developed. It can be appreciated that the method used to measure a target RNA and/or the "expression" of a target gene can depend upon the nature of the target gene and its encoded RNA. For example, where the target β-catenin RNA sequence encodes a protein, the term "expression" can refer to a protein or the β-catenin RNA/transcript derived from the β-catenin gene (either genomic or of exogenous origin). In such instances the expression of the target 3-catenin RNA can be determined by measuring the amount of β-catenin RNA/transcript directly or by measuring the amount of β-catenin protein. Protein can be measured in protein assays such as by staining or immunoblotting or, if the protein catalyzes a reaction that can be measured, by measuring reaction rates. All such methods are known in the art and can be used. Where target β-catenin RNA levels are to be measured, art-recognized methods for detecting RNA levels can be used (e.g., RT-PCR, Northern Blotting, etc.). In targeting β-catenin RNAs with the DsiRNA agents of the instant invention, it is also anticipated that measurement of the efficacy of a DsiRNA agent in reducing levels of β-catenin RNA or protein in a subject, tissue, in cells, either in vitro or in vivo, or in cell extracts can also be used to determine the extent of reduction of β-catenin-associated phenotypes (e.g., disease or disorders, e.g., cancer or tumor formation, growth, metastasis, spread, etc.). The above measurements can be made on cells, cell extracts, tissues, tissue extracts or other suitable source material.

The determination of whether the expression of a β-catenin RNA has been "reduced" can be by a suitable method that can reliably detect changes in RNA levels. Typically, the determination is made by introducing into the environment of a cell undigested DsiRNA such that at least a portion of that DsiRNA agent enters the cytoplasm, and then measuring the level of the target RNA. The same measurement is made on identical untreated cells and the results obtained from each measurement are compared.

The DsiRNA agent can be formulated as a pharmaceutical composition which comprises a pharmacologically effective amount of a DsiRNA agent and pharmaceutically acceptable carrier. A pharmacologically or therapeutically effective amount refers to that amount of a DsiRNA agent effective to produce the intended pharmacological, therapeutic or preventive result. The phrases "pharmacologically effective amount" and "therapeutically effective amount" or simply "effective amount" refer to that amount of an RNA effective to produce the intended pharmacological, therapeutic or preventive result. For example, if a given clinical treatment is considered effective when there is at least a 20% reduction in a measurable parameter associated with a disease or disorder, a therapeutically effective amount of a drug for the treatment of that disease or disorder is the amount necessary to effect at least a 20% reduction in that parameter.

Suitably formulated pharmaceutical compositions of this invention can be administered by means known in the art such as by parenteral routes, including intravenous, intramuscular, intraperitoneal, subcutaneous, transdermal, airway (aerosol), rectal, vaginal and topical (including buccal and sublingual) administration. In some embodiments, the pharmaceutical compositions are administered by intravenous or intraparenteral infusion or injection.

In general, a suitable dosage unit of dsRNA will be in the range of 0.001 to 0.25 milligrams per kilogram body weight of the recipient per day, or in the range of 0.01 to 20 micrograms per kilogram body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. Pharmaceutical composition comprising the dsRNA can be administered once daily. However, the therapeutic agent may also be dosed in dosage units containing two, three, four, five, six or more sub-doses administered at appropriate intervals throughout the day. In that case, the dsRNA contained in each sub-dose must be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. In this embodiment, the dosage unit contains a corresponding multiple of the daily dose. Regardless of the formulation, the pharmaceutical composition must contain dsRNA in a quantity sufficient to inhibit expression of the target gene in the animal or human being treated. The composition can be compounded in such a way that the sum of the multiple units of dsRNA together contain a sufficient dose.

Data can be obtained from cell culture assays and animal studies to formulate a suitable dosage range for humans. The dosage of compositions of the invention lies within a range of circulating concentrations that include the $ED_{50}$ (as determined by known methods) with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range of the compound that includes the $IC_{50}$ (i.e., the concentration of the test compound which achieves a half-maximal inhibition of symptoms) as determined in cell culture. Such information can be used to more accurately determine useful doses in humans. Levels of dsRNA in plasma may be measured by standard methods, for example, by high performance liquid chromatography.

The pharmaceutical compositions can be included in a kit, container, pack, or dispenser together with instructions for administration.

Methods of Treatment

The present invention provides for both prophylactic and therapeutic methods of treating a subject at risk of (or susceptible to) a disease or disorder caused, in whole or in part, by β-catenin (e.g., misregulation and/or elevation of β-catenin transcript and/or (β-catenin protein levels), or treatable via selective targeting of β-catenin.

"Treatment", or "treating" as used herein, is defined as the application or administration of a therapeutic agent (e.g., a DsiRNA agent or vector or transgene encoding same) to a patient, or application or administration of a therapeutic agent to an isolated tissue or cell line from a patient, who has the disease or disorder, a symptom of disease or disorder or a predisposition toward a disease or disorder, with the purpose to cure, heal, alleviate, relieve, alter, remedy, ameliorate, improve or affect the disease or disorder, the symptoms of the disease or disorder, or the predisposition toward disease.

In one aspect, the invention provides a method for preventing in a subject, a disease or disorder as described above (including, e.g., prevention of the commencement of transforming events within a subject via inhibition of β-catenin expression), by administering to the subject a therapeutic agent (e.g., a DsiRNA agent or vector or transgene encoding same). Subjects at risk for the disease can be identified by, for example, one or a combination of diagnostic or prognostic assays as described herein. Administration of a prophylactic agent can occur prior to the detection of, e.g., cancer in a subject, or the manifestation of symptoms characteristic of the disease or disorder, such that the disease or disorder is prevented or, alternatively, delayed in its progression.

Another aspect of the invention pertains to methods of treating subjects therapeutically, i.e., altering the onset of symptoms of the disease or disorder. These methods can be performed in vitro (e.g., by culturing the cell with the DsiRNA agent) or, alternatively, in vivo (e.g., by administering the DsiRNA agent to a subject).

With regards to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the target β-catenin RNA molecules of the present invention or target β-catenin RNA modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

Therapeutic agents can be tested in a selected animal model. For example, a DsiRNA agent (or expression vector or transgene encoding same) as described herein can be used in an animal model to determine the efficacy, toxicity, or side effects of treatment with said agent. Alternatively, an agent (e.g., a therapeutic agent) can be used in an animal model to determine the mechanism of action of such an agent.

Models Useful to Evaluate the Down-Regulation of β-Catenin mRNA Levels and Expression Cell Culture The DsiRNA agents of the invention can be tested for cleavage activity in vivo, for example, using the following procedure. The nucleotide sequences within the β-catenin cDNA targeted by the DsiRNA agents of the invention are shown in the above β-catenin sequences.

The DsiRNA reagents of the invention can be tested in cell culture using HeLa or other mammalian cells to determine the extent of β-catenin RNA and β-catenin protein inhibition. DsiRNA reagents (e.g., see FIG. 1, and above-recited structures) are selected against the β-catenin target as described herein. β-catenin RNA inhibition is measured after delivery of these reagents by a suitable transfection agent to, for example, cultured HeLa cells or other transformed or non-transformed mammalian cells in culture. Relative amounts of target β-catenin RNA are measured versus actin or other appropriate control using real-time PCR monitoring of amplification (e.g., ABI 7700 TAQMAN®). A comparison is made to a mixture of oligonucleotide sequences made to unrelated targets or to a randomized DsiRNA control with the same overall length and chemistry, but randomly substituted at each position, or simply to appropriate vehicle-treated or untreated controls. Primary and secondary lead reagents are chosen for the target and optimization performed. After an optimal transfection agent concentration is chosen, a RNA time-course of inhibition is performed with the lead DsiRNA molecule.

TAQMAN® (Real-Time PCR Monitoring of Amplification) and Lightcycler Quantification of mRNA Total RNA is prepared from cells following DsiRNA delivery, for example, using Ambion Rnaqueous 4-PCR purification kit for large scale extractions, or Promega SV96 for 96-well assays. For Taqman analysis, dual-labeled probes are synthesized with, for example, the reporter dyes FAM or VIC covalently linked at the 5'-end and the quencher dye TAMARA conjugated to the 3'-end. PCR amplifications are performed on, for example, an ABI PRISM 7700 Sequence detector using 50 uL reactions consisting of 10 uL total RNA, 100 nM forward primer, 100 mM reverse primer, 100 nM probe, 1×TaqMan PCR reaction buffer (PE-Applied Biosystems), 5.5 mM MgCl2, 100 uM each dATP, dCTP, dGTP and dTTP, 0.2 U RNase Inhibitor (Promega), 0.025 U AmpliTaq Gold (PE-Applied Biosystems) and 0.2 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target β-catenin mRNA level is determined relative to standards generated from serially diluted total cellular RNA (300, 100, 30, 10 ng/rxn) and normalizing to, for example, 36B4 mRNA in either parallel or same tube TaqMan reactions.

Western Blotting

Cellular protein extracts can be prepared using a standard micro preparation technique (for example using RIPA buffer). Cellular protein extracts are run on 4-12% Tris-Glycine polyacrylamide gel and transferred onto membranes. Non-specific binding can be blocked by incubation, for example, with 5% non-fat milk for 1 hour followed by primary antibody for 16 hours at 4° C. Following washes, the secondary antibody is applied, for example (1:10,000 dilution) for 1 hour at room temperature and the signal detected on a Versa-Doc imaging system In several cell culture systems, cationic lipids have been shown to enhance the bioavailability of oligonucleotides to cells in culture (Bennet, et al., 1992, Mol. Pharmacology, 41, 1023-1033). In one embodiment, DsiRNA molecules of the invention are complexed with cationic lipids for cell culture experiments. DsiRNA and cationic lipid mixtures are prepared in serum-free OptimMEM (InVitrogen) immediately prior to addition to the cells. OptiMEM is warmed to room temperature (about 20-25° C.) and cationic lipid is added to the final desired concentration. DsiRNA molecules are added to OptiMEM to the desired concentration and the solution is added to the diluted DsiRNA and incubated for 15 minutes at room temperature. In dose response experiments, the RNA complex is serially diluted into OptiMEM prior to addition of the cationic lipid.

Animal Models

Evaluating the efficacy of anti-β-catenin DsiRNA agents in animal models is performed as follows. Animal models of cancer and/or proliferative diseases, conditions, or disorders as are known in the art can be used for evaluation of the efficacy, potency, toxicity, etc. of anti-β-catenin DsiRNAs. Suitable animal models of proliferative disease include, e.g., transgenic rodents (e.g., mice, rats) bearing gain of function proto-oncogenes (e.g., Myc, Src) and/or loss of function of tumour suppressor proteins (e.g., p53, Rb) or rodents that have been exposed to radiation or chemical mutagens that induce DNA changes that facilitate neoplastic transformation. Many such animal models are commercially available, for example, from The Jackson Laboratory, Bar Harbor, Me., USA. These animal models may be used as a source cells or tissue for assays of the compositions of the invention. Such models can also be used or adapted for use for pre-clinical evaluation of the efficacy of DsiRNA compositions of the invention in modulating β-catenin gene expression toward therapeutic use.

As in cell culture models, the most β-catenin relevant mouse tumor xenografts are those derived from cancer cells that express β-catenin proteins, such as SW480 or HCT116 colon cancer cells. Xenograft models of colon cancer relevant to study of the anti-tumor effect of modulating β-catenin have been described by various groups. A xenograft animal model useful according to the invention is described in Verma et al. 2003, *Clinical Cancer Research* 9: 1291-1300. Use of these models has demonstrated that inhibition of β-catenin expression by anti-β-catenin agents causes inhibition of tumor growth in animals.

Such models can be used in evaluating the efficacy of DsiRNA molecules of the invention to inhibit β-catenin levels, expression, tumor/cancer formation, growth, spread, development of other β-catenin-associated phenotypes, diseases or disorders, etc. These models and others can similarly be used to evaluate the safety/toxicity and efficacy of DsiRNA molecules of the invention in a pre-clinical setting.

Examples of animal model systems useful for evaluation of the β-catenin-targeting DsiRNAs of the invention include wild-type mice, and orthotopic or subcutaneous SW480 or HCT116 xenograft tumor model mice. In an exemplary in vivo experiment, DsiRNAs of the invention are tail vein injected into such mouse models at doses ranging from 1 to 10 mg/kg or, alternatively, repeated doses are administered at single-dose $IC_{50}$ levels, and organs (e.g., prostate, liver, kidney, lung, pancreas, colon, skin, spleen, bone marrow, lymph nodes, mammary fat pad, etc.) are harvested 24 hours after administration of the final dose. Such organs are then evaluated for mouse and/or human β-catenin levels, depending upon the model used. Duration of action can also be examined at, e.g., 1, 4, 7, 14, 21 or more days after final DsiRNA administration.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (Danio rerio), (4th Ed., Univ. of Oregon Press, Eugene, 2000).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

The present invention is described by reference to the following Examples, which are offered by way of illustration and are not intended to limit the invention in any manner. Standard techniques well known in the art or the techniques specifically described below were utilized.

Anti-β-Catenin DsiRNAs

Anti-β-catenin DsiRNA agents were provided as follows.

Example 1

Preparation and Assessment of Double-Stranded RNA Oligonucleotides

Oligonucleotide Synthesis and Purification

DsiRNA molecules according to the invention target sites on human β-catenin sequences or mouse β-catenin sequences (such DsiRNAs are termed "common" DsiRNAs). The sequence of one strand of each DsiRNA molecule was complementary to the target β-catenin site sequences described above. The DsiRNA molecules were chemically synthesized using methods described herein. Generally, DsiRNA constructs were synthesized using solid phase oligonucleotide synthesis methods as described for 19-23mer siRNAs (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 6,111,086; 6,008,400; 6,111,086).

Individual RNA strands were synthesized and HPLC purified according to standard methods (Integrated DNA Technologies, Coralville, Iowa). For example, RNA oligonucleotides were synthesized using solid phase phosphoramidite chemistry, deprotected and desalted on NAP-5 columns (Amersham Pharmacia Biotech, Piscataway, N.J.) using standard techniques (Damha and Olgivie, 1993, *Methods Mol Biol* 20: 81-114; Wincott et al., 1995, *Nucleic Acids Res* 23: 2677-84). The oligomers were purified using ion-exchange high performance liquid chromatography (IE-HPLC) on an Amersham Source 15Q column (1.0 cm×25 cm; Amersham Pharmacia Biotech, Piscataway, N.J.) using a 15 mM step-linear gradient. The gradient varies from 90:10 Buffers A:B to 52:48 Buffers A:B, where Buffer A is 100 mM Tris pH 8.5 and Buffer B is 100 mM Tris pH 8.5, 1 M NaCl. Samples were monitored at 260 nm and peaks corresponding to the full-length oligonucleotide species are collected, pooled, desalted on NAP-5 columns, and lyophilized.

The purity of each oligomer was determined by capillary electrophoresis (CE) on a Beckman PACE 5000 (Beckman Coulter, Inc., Fullerton, Calif.). The CE capillaries had a 100 μm inner diameter and contains ssDNA 100R Gel (Beckman-Coulter). Typically, about 0.6 nmole of oligonucleotide was injected into a capillary, run in an electric field of 444 V/cm and detected by UV absorbance at 260 nm Denaturing Tris-Borate-7 M-urea running buffer was purchased from Beckman-Coulter. Oligoribonucleotides were obtained that are at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems, Foster City, Calif.) following the manufacturer's recommended protocol. Relative molecular masses of all oligomers were obtained, often within 0.2% of expected molecular mass.

Preparation of Duplexes

Single-stranded RNA (ssRNA) oligomers were resuspended, e.g., at 100 μM concentration in duplex buffer consisting of 100 mM potassium acetate, 30 mM HEPES, pH 7.5. Complementary sense and antisense strands were mixed in equal molar amounts to yield a final solution of, e.g., 50 μM duplex. Samples were heated to 100° C. for 5' in RNA buffer (IDT) and allowed to cool to room temperature before use. Double-stranded RNA (dsRNA) oligomers were stored at −20° C. Single-stranded RNA oligomers were stored lyophilized or in nuclease-free water at −80° C.

Nomenclature

For consistency, the following nomenclature has been employed in the instant specification. Names given to duplexes indicate the length of the oligomers and the presence or absence of overhangs. A "25/27" is an asymmetric duplex having a 25 base sense strand and a 27 base antisense strand with a 2-base 3'-overhang. A "27/25" is an asymmetric duplex having a 27 base sense strand and a 25 base antisense strand.

Cell Culture and RNA Transfection

HeLa cells were obtained from ATCC and maintained in DMEM (HyClone) supplemented with 10% fetal bovine serum (HyClone) at 37° C. under 5% $CO_2$. Hepa 1-6 cells were obtained from ATCC and maintained in DMEM (HyClone) supplemented with 10% fetal bovine serum (HyClone) at 37° C. under 5% $CO_2$. For RNA transfections, cells were transfected with DsiRNAs as indicated at a final concentration of 1 nM or 0.1 nM using Lipofectamine™ RNAiMAX (Invitrogen) and following manufacturer's instructions. Briefly, an aliquot of stock solution of each DsiRNA was mixed with Opti-MEM I (Invitrogen) to reach a volume of 87.5 uL; Lipofectamine™ RNAiMAX was diluted in OptiMEM to 87.5 uL. The resulting 150 μL mix was added at 50 uL per well into triplicate individual wells of 96 well plates and incubated for 20 min at RT to allow DsiRNA:Lipofectamine™ RNAiMAX complexes to form. Meanwhile, HeLa cells were trypsinized and resuspended in medium. Finally, 100 uL of the cell suspension were added to each well (final volume 150 uL) and plates were placed into the incubator for 24 hours.

Assessment of Fi-Catenin Inhibition

β-catenin target gene knockdown was determined by qRT-PCR, with values normalized to HPRT and SFRS9 housekeeping genes, and to transfections with control DsiRNAs.

RNA Isolation and Analysis

Media was aspirated, and total RNA was extracted using the SV96 kit (Promega). Approximately 100 ng of total RNA was reverse-transcribed using SuperscriptII, Oligo dT, and random hexamers following manufacturer's instructions. Typically, one-sixth of the resulting cDNA was analyzed by qPCR using primers and probes specific for both the β-catenin gene and for the human genes HPRT-1 and SFRS9. An ABI 7700 was used for the amplification reactions. Each sample was tested in triplicate. Relative β-catenin RNA levels were normalized to HPRT1 and SFRS9 RNA levels and compared with RNA levels obtained in control samples treated with the control DsiRNAs.

Example 2

DsiRNA Inhibition of β-Catenin—Primary Screen

DsiRNA molecules targeting β-catenin were designed and synthesized as described above and tested in HeLa cells for inhibition. For transfection, annealed DsiRNAs were mixed with the transfection reagent (Lipofectamine™ RNAiMAX, Invitrogen) in a volume of 50 μl/well and incubated for 20 minutes at room temperature. The HeLa (human) or Hepa 1-6 (mouse) cells were trypsinized, resuspended in media, and added to wells (100 uL per well) to give a final DsiRNA concentration of 1 nM in a volume of 150 μl. Each DsiRNA transfection mixture was added to 3 wells for triplicate DsiRNA treatments. Cells were incubated at 37° C. for 24 hours in the continued presence of the DsiRNA transfection mixture. At 24 hours, RNA was prepared from each well of treated cells. The supernatants with the transfection mixtures were first removed and discarded, then the cells were lysed and RNA prepared from each well. Target β-catenin RNA levels following treatment were evaluated by qRT-PCR for the β-catenin target gene, with values normalized to those obtained for controls. Triplicate data was averaged and the % error determined for each treatment. Normalized data were graphed and the reduction of target mRNA by active DsiRNAs in comparison to controls was determined.

β-catenin targeting DsiRNAs of Tables 2-4 above were examined for β-catenin inhibitory efficacy.

488 asymmetric DsiRNAs (tested DsiRNAs possessed a 25/27mer structure) were prepared and tested for β-catenin inhibitory efficacy in human HeLa and mouse Hepa 1-6 cells incubated in the presence of such DsiRNAs at a concentration of 1 nM. Sequences and structures of all 488 tested asymmetric DsiRNAs are shown above in Tables 2-4, with underlined nucleotide residues indicating 2'-O-methyl modified residues; ribonucleotide residues are shown as UPPER CASE, while deoxyribonucleotide residues are shown as lower case.

Assay of these 488 β-catenin targeting DsiRNAs in human HeLa and mouse Hepa 1-6 cells at 1 nM revealed the following β-catenin inhibitory efficacies, presented in Tables 14-17. β-catenin levels were determined using qPCR assays positioned at locations within the β-catenin transcript (for human HeLa cell experiments, paired qPCR assays were performed for the human β-catenin 1297-1397 amplicon (Yakima Yellow) and the human β-catenin 3506-3659 amplicon (FAM); for mouse Hepa 1-6 cell experiments, paired qPCR assays were performed for the mouse β-catenin 1232-1394 amplicon (FAM) and mouse (β-catenin 2848-2930 amplicon (MAX); values presented in Tables 14-17 below are averaged values of these paired qPCR assays).

TABLE 14

β-Catenin Inhibitory Efficacy of DsiRNAs Assayed at 1 nM in Human HeLa Cells

| Tested DsiRNA (Target Location in human β-catenin transcript variant 1) | Mouse β-catenin Target Location (in NM_007614.2) | % Remaining β-catenin mRNA ± % Error |
|---|---|---|
| βc-240 | | 5 ± 21.1 |
| βc-244 | | 3.8 ± 2.8 |
| βc-253 | | 5.5 ± 1.7 |
| βc-259 | | 3.6 ± 11.3 |
| βc-264 | | 4.1 ± 9.5 |
| βc-496 | | 3.9 ± 5.3 |
| βc-516 | | 4.4 ± 6.5 |
| βc-522 | | 8.6 ± 11.7 |
| βc-524 | | 6.7 ± 10.9 |
| βc-540 | | 5.3 ± 4.7 |
| βc-582 | | 3.8 ± 6.8 |
| βc-686 | | 2.1 ± 2.8 |
| βc-692 | | 2.2 ± 4.9 |
| βc-697 | | 3.9 ± 4.4 |
| βc-707 | | 4.3 ± 6.9 |
| βc-753 | | 5.2 ± 6.1 |
| βc-870 | | 3 ± 7.7 |
| βc-889 | | 2.9 ± 4.9 |
| βc-1060 | | 4 ± 3.6 |
| βc-1065 | | 7.7 ± 4.6 |
| βc-1070 | | 4.6 ± 2.1 |
| βc-1076 | | 7.1 ± 5.1 |
| βc-1154 | | 3.2 ± 10.7 |
| βc-1180 | | 4.8 ± 4 |
| βc-1185 | | 7.6 ± 9 |
| βc-1260 | | 8.7 ± 5.5 |
| βc-1294 | | 16.7 ± 6.2 |
| βc-1412 | | 6.4 ± 12.1 |
| βc-1418 | | 6.1 ± 10.4 |
| βc-1423 | | 153.2 ± 5.2 |
| βc-1520 | | 8.5 ± 10.4 |
| βc-1561 | | 7.5 ± 5.8 |
| βc-1571 | | 5 ± 3.4 |
| βc-1579 | | 5.9 ± 4.4 |
| βc-1620 | | 3.7 ± 4.1 |
| βc-1816 | | 4.9 ± 3.4 |
| βc-1987 | | 8.2 ± 3.1 |
| βc-1989 | | 10.6 ± 4.9 |
| βc-2111 | | 12.1 ± 2.2 |
| βc-2282 | | 6.2 ± 5.6 |
| βc-2624 | | 12 ± 46.4 |
| βc-2647 | | 103.1 ± 4.4 |
| βc-2770 | | 121.5 ± 5.1 |
| βc-2848 | | 107.6 ± 4.3 |

TABLE 14-continued

β-Catenin Inhibitory Efficacy of DsiRNAs Assayed at 1 nM in Human HeLa Cells

| Tested DsiRNA (Target Location in human β-catenin transcript variant 1) | Mouse β-catenin Target Location (in NM_007614.2) | % Remaining β-catenin mRNA ± % Error |
|---|---|---|
| βc-2874 | | 44.2 ± 3.3 |
| βc-2909 | | 100.8 ± 4.9 |
| βc-3074 | | 81.1 ± 5.5 |
| βc-3197 | | 8.4 ± 11.8 |
| βc-3203 | | 5.1 ± 8.3 |
| βc-3273 | | 67.6 ± 5.1 |
| βc-3333 | | 5.5 ± 8.4 |
| βc-3349 | | 6.5 ± 9.7 |
| βc-3354 | | 5.6 ± 11.1 |
| βc-3371 | | 15.5 ± 16.8 |
| βc-3376 | | 21.5 ± 9.1 |
| βc-3411 | | 8.7 ± 7.5 |
| βc-3426 | | 5.9 ± N/A |
| βc-3431 | | 3.4 ± 7 |
| βc-3437 | | 6.5 ± 5 |
| βc-3458 | | 9.2 ± 2.3 |
| βc-3468 | | 7.1 ± 4.5 |
| βc-3488 | | 7.5 ± 4.3 |
| βc-3496 | | 9.2 ± 5.1 |
| βc-3552 | | 25.9 ± 4 |
| βc-3600 | | 8.2 ± 7.4 |
| βc-3605 | | 6.2 ± 5.8 |
| βc-3615 | | 5.4 ± 3.9 |
| βc-3674 | | 5.8 ± 4.1 |
| βc-3686 | | 6.4 ± 4 |
| βc-3691 | | 4.6 ± 3 |
| βc-3700 | | 8.7 ± 4 |
| βc-3707 | | 7.2 ± 4.6 |
| βc-284 | 228 | 4.9 ± 14.1 |
| βc-285 | 229 | 6.7 ± 3.2 |
| βc-286 | 230 | 6.7 ± 6.3 |
| βc-287 | 231 | 7.8 ± 7.4 |
| βc-288 | 232 | 5.3 ± 4 |
| βc-289 | 233 | 5.9 ± 13.9 |
| βc-290 | 234 | 6.7 ± 3.2 |
| βc-291 | 235 | 6.1 ± 6.2 |
| βc-312 | 256 | 13.1 ± 3.1 |
| βc-313 | 257 | 14 ± 5.3 |
| βc-314 | 258 | 17.7 ± 8.9 |
| βc-315 | 259 | 40.2 ± 5 |
| βc-316 | 260 | 23.2 ± 3.6 |
| βc-317 | 261 | 12.4 ± 2.7 |
| βc-318 | 262 | 18 ± 4.7 |
| βc-389 | 333 | 51.5 ± 3.8 |
| βc-390 | 334 | 10.9 ± 4.8 |
| βc-391 | 335 | 7.6 ± 9.4 |
| βc-392 | 336 | 15.7 ± 3.9 |
| βc-393 | 337 | 7.8 ± 2.5 |
| βc-600 | 544 | 63.1 ± 4.6 |
| βc-601 | 545 | 59.2 ± 3.7 |
| βc-602 | 546 | 31.8 ± 2.5 |
| βc-603 | 547 | 14.9 ± 9 |
| βc-604 | 548 | 21.9 ± 4 |
| βc-605 | 549 | 10.1 ± 1.4 |
| βc-638 | 582 | 9.9 ± 2.7 |
| βc-639 | 583 | 4.6 ± 7.8 |
| βc-640 | 584 | 100.3 ± 11.7 |
| βc-641 | 585 | 10.4 ± 2.3 |
| βc-642 | 586 | 13.5 ± 4.2 |
| βc-643 | 587 | 41.8 ± 5.2 |
| βc-644 | 588 | 32.5 ± N/A |
| βc-645 | 589 | 10.5 ± 2.5 |
| βc-665 | 609 | 8.8 ± 5.6 |
| βc-666 | 610 | 6.7 ± 2 |
| βc-667 | 611 | 8.9 ± 3.2 |
| βc-731 | 675 | 7.3 ± 6.9 |
| βc-732 | 676 | 53.9 ± 6.1 |
| βc-809 | 753 | 8.6 ± 1.7 |
| βc-810 | 754 | 12.2 ± 8.3 |
| βc-830 | 774 | 5.8 ± 3 |
| βc-831 | 775 | 10.5 ± 2.6 |
| βc-893 | 837 | 3.6 ± 6.2 |
| βc-894 | 838 | 3.5 ± 2 |

TABLE 14-continued

β-Catenin Inhibitory Efficacy of DsiRNAs Assayed at 1 nM in Human HeLa Cells

| Tested DsiRNA (Target Location in human β-catenin transcript variant 1) | Mouse β-catenin Target Location (in NM_007614.2) | % Remaining β-catenin mRNA ± % Error |
|---|---|---|
| βc-895 | 839 | 3.6 ± 2.1 |
| βc-896 | 840 | 4.3 ± 10.3 |
| βc-897 | 841 | 4.9 ± 8.8 |
| βc-898 | 842 | 7.9 ± 9.3 |
| βc-899 | 843 | 6.8 ± 6.3 |
| βc-900 | 844 | 3.9 ± 2.8 |
| βc-977 | 921 | 10.4 ± 5 |
| βc-978 | 922 | 28.1 ± 2.4 |
| βc-1091 | 1035 | 8.8 ± 7.7 |
| βc-1092 | 1036 | 25.4 ± 3.2 |
| βc-1093 | 1037 | 11.9 ± 1.6 |
| βc-1094 | 1038 | 10.1 ± 3.4 |
| βc-1095 | 1039 | 7.9 ± 4.5 |
| βc-1301 | 1245 | 12.4 ± 5.2 |
| βc-1302 | 1246 | 14.2 ± 5.8 |
| βc-1303 | 1247 | 10 ± 4.8 |
| βc-1304 | 1248 | 8.4 ± 3.8 |
| βc-1305 | 1249 | 6.8 ± 8 |
| βc-1306 | 1250 | 6.1 ± 9.5 |
| βc-1307 | 1251 | 5.7 ± 3.6 |
| βc-1308 | 1252 | 5.7 ± 5.1 |
| βc-1309 | 1253 | 6.9 ± 3.7 |
| βc-1310 | 1254 | 4.5 ± 3.2 |
| βc-1311 | 1255 | 5.3 ± 4.5 |
| βc-1312 | 1256 | 9.8 ± 1.2 |
| βc-1313 | 1257 | 5.7 ± 6.3 |
| βc-1314 | 1258 | 5.2 ± 5.9 |
| βc-1430 | 1374 | 20.6 ± 7.8 |
| βc-1431 | 1375 | 17.5 ± 4 |
| βc-1526 | 1470 | 35.8 ± 4.5 |
| βc-1527 | 1471 | 40.7 ± 10.2 |
| βc-1528 | 1472 | 22.8 ± 4.2 |
| βc-1529 | 1473 | 21.8 ± 7.6 |
| βc-1530 | 1474 | 17.3 ± 11.4 |
| βc-1531 | 1475 | 62.1 ± 8.3 |
| βc-1532 | 1476 | 37.8 ± 19.1 |
| βc-1533 | 1477 | 16.3 ± 6.2 |
| βc-1534 | 1478 | 80.7 ± 17 |
| βc-1535 | 1479 | 27.1 ± 6.7 |
| βc-1536 | 1480 | 13.3 ± 4.3 |
| βc-1537 | 1481 | 12.9 ± 4.1 |
| βc-1538 | 1482 | 11.9 ± 3 |
| βc-1539 | 1483 | 10.9 ± 8.9 |
| βc-1540 | 1484 | 5 ± 6.1 |
| βc-1541 | 1485 | 4.2 ± 9.8 |
| βc-1542 | 1486 | 9.8 ± 2.1 |
| βc-1543 | 1487 | 5.7 ± 6.4 |
| βc-1544 | 1488 | 4.8 ± 5.8 |
| βc-1545 | 1489 | 4 ± 5.5 |
| βc-1565 | 1509 | 6.5 ± 8.5 |
| βc-1566 | 1510 | 3.6 ± 6.6 |
| βc-1567 | 1511 | 3.5 ± 17.3 |
| βc-1568 | 1512 | 3.2 ± 8.4 |
| βc-1569 | 1513 | 2.7 ± 13 |
| βc-1652 | 1596 | 5.1 ± 14.3 |
| βc-1653 | 1597 | 5.8 ± 13.2 |
| βc-1654 | 1598 | 26.4 ± 2.6 |
| βc-1655 | 1599 | 17.8 ± 3.9 |
| βc-1656 | 1600 | 18.7 ± 7.4 |
| βc-1657 | 1601 | 35.4 ± 7.7 |
| βc-1658 | 1602 | 10 ± 4.4 |
| βc-1659 | 1603 | 10.2 ± 10.5 |
| βc-1660 | 1604 | 31.5 ± 2.4 |
| βc-1661 | 1605 | 14.3 ± 5 |
| βc-1662 | 1606 | 5 ± 4.4 |
| βc-1663 | 1607 | 21.7 ± 4.7 |
| βc-1664 | 1608 | 67 ± 8.6 |
| βc-1665 | 1609 | 16.6 ± 14.3 |
| βc-1666 | 1610 | 11.3 ± 6.3 |
| βc-1667 | 1611 | 6.2 ± 19.5 |
| βc-1668 | 1612 | 33.5 ± 6.3 |
| βc-1669 | 1613 | 26.1 ± 3 |
| βc-1670 | 1614 | 27.7 ± 3.8 |
| βc-1671 | 1615 | 9.3 ± 2.2 |
| βc-1672 | 1616 | 23.4 ± 5.4 |
| βc-1673 | 1617 | 21.7 ± 9.1 |
| βc-1674 | 1618 | 15.1 ± 4 |
| βc-1675 | 1619 | 31 ± 5.9 |
| βc-1676 | 1620 | 12.1 ± 10.6 |
| βc-1677 | 1621 | 23.2 ± 15.4 |
| βc-1678 | 1622 | 6.9 ± 10.8 |
| βc-1679 | 1623 | 13 ± 9.6 |
| βc-1680 | 1624 | 5 ± 10.6 |
| βc-1681 | 1625 | 4 ± 6.5 |
| βc-1682 | 1626 | 2.8 ± 6.2 |
| βc-1683 | 1627 | 2.8 ± 5.7 |
| βc-1684 | 1628 | 7.4 ± 2.7 |
| βc-1685 | 1629 | 11.3 ± 6.3 |
| βc-1686 | 1630 | 15.6 ± 4.3 |
| βc-1687 | 1631 | 7.6 ± 4.4 |
| βc-1688 | 1632 | 17.8 ± 5 |
| βc-1689 | 1633 | 23.7 ± 7.5 |
| βc-1690 | 1634 | 8.1 ± 3 |
| βc-1691 | 1635 | 8.5 ± 4.6 |
| βc-1692 | 1636 | 33.9 ± 28.1 |
| βc-1693 | 1637 | 45.6 ± 4.8 |
| βc-1694 | 1638 | 12.7 ± 3.4 |
| βc-1695 | 1639 | 9.4 ± 5.6 |
| βc-1787 | 1731 | 46.4 ± 6.2 |
| βc-1788 | 1732 | 28 ± 3.8 |
| βc-1789 | 1733 | 28.6 ± 6.5 |
| βc-1790 | 1734 | 65.2 ± 5.1 |
| βc-1791 | 1735 | 13.6 ± 4 |
| βc-1792 | 1736 | 10.2 ± 16.3 |
| βc-1793 | 1737 | 18.7 ± 7.7 |
| βc-1794 | 1738 | 36.7 ± 5 |
| βc-1795 | 1739 | 31.2 ± 9.1 |
| βc-1796 | 1740 | 8.5 ± 5 |
| βc-1797 | 1741 | 23.8 ± 4.1 |
| βc-1798 | 1742 | 49.2 ± 3.1 |
| βc-1799 | 1743 | 58 ± 3 |
| βc-1800 | 1744 | 26.3 ± 5.7 |
| βc-1820 | 1764 | 3.8 ± 7.8 |
| βc-1821 | 1765 | 4.8 ± 13.4 |
| βc-2072 | 2016 | 7.6 ± 14 |
| βc-2073 | 2017 | 12.4 ± 8.5 |
| βc-2074 | 2018 | 10.8 ± 6.2 |
| βc-2075 | 2019 | 7.6 ± 1.9 |
| βc-2076 | 2020 | 13.5 ± 6.5 |
| βc-2077 | 2021 | 12.1 ± 7 |
| βc-2097 | 2041 | 3.9 ± 2.7 |
| βc-2098 | 2042 | 6.2 ± 3.6 |
| βc-2099 | 2043 | 6 ± 3.8 |
| βc-2100 | 2044 | 11.4 ± 8.6 |
| βc-2141 | 2085 | 8.3 ± 8.7 |
| βc-2142 | 2086 | 17.9 ± 2.4 |
| βc-2143 | 2087 | 6.2 ± 11.2 |
| βc-2144 | 2088 | 4.4 ± 16.1 |
| βc-2145 | 2089 | 8.8 ± 12.2 |
| βc-2146 | 2090 | 9.4 ± 9.6 |
| βc-2147 | 2091 | 10.5 ± 12.2 |
| βc-2148 | 2092 | 6.5 ± 2.7 |
| βc-2149 | 2093 | 16.3 ± 5.8 |
| βc-2150 | 2094 | 10.7 ± 5.2 |
| βc-2151 | 2095 | 5.7 ± 3.2 |
| βc-2183 | 2127 | 38.1 ± 2.9 |
| βc-2184 | 2128 | 41.5 ± 4.3 |
| βc-2185 | 2129 | 83.7 ± 2.3 |
| βc-2270 | 2214 | 23.8 ± 12.6 |
| βc-2271 | 2215 | 18.8 ± 9.6 |
| βc-2272 | 2216 | 6.7 ± 3.5 |
| βc-2273 | 2217 | 8.4 ± 5.5 |
| βc-2274 | 2218 | 6.2 ± 4.4 |
| βc-2275 | 2219 | 7.2 ± 5.8 |
| βc-2276 | 2220 | 7.1 ± 2.4 |
| βc-2277 | 2221 | 4.8 ± 2.8 |

TABLE 14-continued

β-Catenin Inhibitory Efficacy of DsiRNAs Assayed at 1 nM in Human HeLa Cells

| Tested DsiRNA (Target Location in human β-catenin transcript variant 1) | Mouse β-catenin Target Location (in NM_007614.2) | % Remaining β-catenin mRNA ± % Error |
|---|---|---|
| βc-2345 | 2289 | 8.5 ± 2.5 |
| βc-2346 | 2290 | 7 ± 4.5 |
| βc-2347 | 2291 | 6.8 ± 5.9 |
| βc-2348 | 2292 | 12.3 ± 14.8 |
| βc-2349 | 2293 | 6.2 ± 12.8 |
| βc-2350 | 2294 | 4.1 ± 11.7 |
| βc-2351 | 2295 | 6.9 ± 9.1 |
| βc-2352 | 2296 | 11.5 ± 13 |
| βc-2353 | 2297 | 19.1 ± 4.7 |
| βc-2354 | 2298 | 17.1 ± 3.6 |
| βc-2355 | 2299 | 8.1 ± 6.5 |
| βc-2411 | 2355 | 6.6 ± 2.1 |
| βc-2412 | 2356 | 8.1 ± 3.9 |
| βc-2413 | 2357 | 10.1 ± 3.5 |
| βc-2414 | 2358 | 9.8 ± 1 |
| βc-2415 | 2359 | 10.9 ± 4.3 |
| βc-2441 | 2385 | 9.5 ± 3 |
| βc-2442 | 2386 | 5.2 ± 5 |
| βc-2443 | 2387 | 8.8 ± 11.9 |
| βc-2444 | 2388 | 10.2 ± 4 |
| βc-2445 | 2389 | 5.3 ± 6.4 |
| βc-2501 | 2445 | 74.5 ± 3.1 |
| βc-2502 | 2446 | 95.4 ± 4.2 |
| βc-2503 | 2447 | 116.5 ± 5 |
| βc-2504 | 2448 | 108.9 ± 5.3 |
| βc-2505 | 2449 | 98.7 ± 5 |
| βc-2506 | 2450 | 43.5 ± 2.7 |
| βc-2507 | 2451 | 89.5 ± 1.9 |
| βc-2508 | 2452 | 54.6 ± 7 |
| βc-2509 | 2453 | 19.4 ± 10.5 |
| βc-2510 | 2454 | 47.1 ± 3.5 |
| βc-2511 | 2455 | 60.7 ± 4.9 |
| βc-2512 | 2456 | 53.7 ± 9.7 |
| βc-2513 | 2457 | 18 ± N/A |
| βc-2514 | 2458 | 6.5 ± 4.9 |
| βc-2515 | 2459 | 13.5 ± 3.7 |
| βc-2516 | 2460 | 11.3 ± 3 |
| βc-2517 | 2461 | 6.2 ± 3.5 |
| βc-2518 | 2462 | 6.9 ± 4.8 |
| βc-2519 | 2463 | 9.1 ± 2.8 |
| βc-2520 | 2464 | 6.6 ± 4 |
| βc-2521 | 2465 | 6.4 ± 3.9 |
| βc-2522 | 2466 | 7.6 ± 5.6 |
| βc-2523 | 2467 | 6.1 ± 7.6 |
| βc-2524 | 2468 | 5.5 ± 3 |
| βc-2525 | 2469 | 3.6 ± 1.3 |
| βc-2526 | 2470 | 4.9 ± 2.8 |
| βc-2527 | 2471 | 58 ± 9.2 |
| βc-2528 | 2472 | 22.5 ± 5.3 |
| βc-2529 | 2473 | 24.5 ± 9.5 |
| βc-2530 | 2474 | 53.5 ± 1.3 |
| βc-2531 | 2475 | 19.3 ± 9.1 |
| βc-2532 | 2476 | 17.2 ± 11.5 |
| βc-2533 | 2477 | 21.5 ± 9.8 |
| βc-2534 | 2478 | 77.4 ± 2.4 |
| βc-2535 | 2479 | 55.4 ± 4.3 |
| βc-2567 | 2511 | 77.9 ± 4.1 |
| βc-2568 | 2512 | 51.2 ± 9.2 |
| βc-2569 | 2513 | 38.2 ± 2.8 |
| βc-2603 | 2547 | 11 ± 7.7 |
| βc-2604 | 2548 | 9.7 ± 5.6 |
| βc-2605 | 2549 | 29.1 ± 4.2 |
| βc-2606 | 2550 | 23.4 ± 4.4 |
| βc-2607 | 2551 | 10.6 ± 2.6 |
| βc-2608 | 2552 | 16 ± 6.4 |
| βc-2609 | 2553 | 23.3 ± 15.2 |
| βc-2610 | 2554 | 16.2 ± 5.1 |
| βc-2611 | 2555 | 3.8 ± 1.4 |
| βc-2612 | 2556 | 2.2 ± 4.6 |
| βc-2613 | 2557 | 8.4 ± 2.3 |
| βc-2614 | 2558 | 4.9 ± 3.4 |
| βc-2615 | 2559 | 6.7 ± 6.4 |
| βc-2616 | 2560 | 8.4 ± 7.7 |
| βc-2617 | 2561 | 6.2 ± 6.3 |
| βc-2618 | 2562 | 6.6 ± 6.2 |
| βc-2619 | 2563 | 6 ± 4.1 |
| βc-2620 | 2564 | 5.9 ± 11.4 |
| βc-2621 | 2565 | 9.5 ± 13.2 |
| βc-2622 | 2566 | 7.3 ± 10 |
| βc-2623 | 2567 | 7.2 ± 9.8 |
| βc-2869 | 2765 | 86.5 ± 9.1 |
| βc-2902 | 2798 | 67.7 ± 3.1 |
| βc-2923 | 2819 | 76.5 ± 3.1 |
| βc-2925 | 2821 | 88.6 ± 5.6 |
| βc-2927 | 2823 | 79.9 ± 6.5 |
| βc-2929 | 2825 | 71.1 ± 1.2 |
| βc-2973 | 2867 | 49.8 ± 6.9 |
| βc-2975 | 2869 | 46.3 ± 5.6 |
| βc-2977 | 2871 | 43.2 ± 1.4 |
| βc-2979 | 2873 | 59.3 ± 4.3 |
| βc-2981 | 2875 | 47 ± 5.2 |
| βc-2983 | 2877 | 59.8 ± 1.9 |
| βc-2985 | 2879 | 50.9 ± 3.1 |
| βc-2987 | 2881 | 54.5 ± 2.8 |
| βc-2989 | 2883 | 50.7 ± 2.4 |
| βc-3015 | 2909 | 72.2 ± 2.5 |
| βc-3017 | 2911 | 56.9 ± 3.9 |
| βc-3019 | 2913 | 62.5 ± 4.1 |
| βc-3021 | 2915 | 59.5 ± 3.2 |
| βc-3046 | 2940 | 77.4 ± 19.4 |
| βc-3048 | 2942 | 45.3 ± 15.3 |
| βc-3050 | 2944 | 60.2 ± 10.5 |
| βc-3052 | 2946 | 58.5 ± 5.3 |
| βc-3054 | 2948 | 84.7 ± 5.1 |
| βc-3056 | 2950 | 64.8 ± 7.4 |
| βc-3087 | 2981 | 58.7 ± 6.6 |
| βc-3089 | 2983 | 47.4 ± 6 |
| βc-3091 | 2985 | 52.6 ± 6 |
| βc-3093 | 2987 | 45.7 ± 14.5 |
| βc-3095 | 2989 | 49.7 ± 3.8 |
| βc-3097 | 2991 | 72.3 ± 13.4 |
| βc-3099 | 2993 | 39.7 ± 3.4 |
| βc-3101 | 2995 | 31.4 ± 13.3 |
| βc-3103 | 2997 | 35.6 ± 9 |
| βc-3105 | 2999 | 16 ± 7.7 |
| βc-3107 | 3001 | 41.3 ± 33.6 |
| βc-3109 | 3003 | 5.3 ± 35.8 |
| βc-3111 | 3005 | 4.5 ± 7.6 |
| βc-3113 | 3007 | 7.5 ± 9.8 |
| βc-3115 | 3009 | 5.1 ± 15.4 |
| βc-3191 | 3084 | 10.2 ± 9.9 |
| βc-3193 | 3086 | 9.3 ± 5.5 |
| βc-3195 | 3088 | 4.4 ± 3.1 |
| βc-3387 | 3232 | 4.8 ± 7.8 |
| βc-3389 | 3234 | 3.6 ± 6 |
| βc-3391 | 3236 | 4.7 ± 7.2 |
| βc-3393 | 3238 | 2.7 ± 7.1 |
| βc-3395 | 3240 | 4.9 ± 3.7 |
| βc-3397 | 3242 | 4.8 ± 3.1 |
| βc-3399 | 3244 | 3.9 ± 9.3 |
| βc-3401 | 3246 | 4.8 ± 9.8 |
| βc-3500 | 3336 | 5.7 ± 3.4 |
| βc-3502 | 3338 | 8.3 ± 3.9 |
| βc-3504 | 3340 | 7 ± 6.2 |
| βc-3506 | 3342 | 9.7 ± 2.3 |
| βc-3508 | 3344 | 9.2 ± 2.9 |
| βc-3509 | 3345 | 13.8 ± 4.2 |
| βc-3510 | 3346 | 56.3 ± 5 |
| βc-3512 | 3348 | 20.8 ± 4.6 |
| βc-3514 | 3350 | 9.7 ± 3.3 |
| βc-3516 | 3352 | 12.7 ± 7.4 |
| βc-3518 | 3354 | 7.5 ± 5.7 |
| βc-3520 | 3356 | 6.6 ± 2.6 |
| βc-3522 | 3358 | 7.5 ± 7.1 |
| βc-3524 | 3360 | 10.5 ± 4.4 |
| βc-3526 | 3362 | 9.4 ± N/A |

TABLE 14-continued

β-Catenin Inhibitory Efficacy of DsiRNAs Assayed at 1 nM in Human HeLa Cells

| Tested DsiRNA (Target Location in human β-catenin transcript variant 1) | Mouse β-catenin Target Location (in NM_007614.2) | % Remaining β-catenin mRNA ± % Error |
|---|---|---|
| βc-3528 | 3364 | 8.2 ± 8.9 |
| βc-3530 | 3366 | 8.2 ± 9 |
| βc-3532 | 3368 | 7.5 ± 5.4 |
| βc-3534 | 3370 | 5.6 ± 11.9 |
| βc-3536 | 3372 | 5.7 ± 2.8 |
| βc-3538 | 3374 | 7.5 ± 2.8 |
| βc-3583 | 3420 | 10 ± 5.2 |
| βc-3585 | 3422 | 9.4 ± 7.8 |
| βc-3587 | 3424 | 7 ± 5 |
| βc-3589 | 3426 | 6.5 ± 5.6 |
| βc-3591 | 3428 | 5.4 ± 6.6 |
| βc-3593 | 3430 | 11.5 ± 5.7 |
| βc-3633 | 3469 | 14.6 ± 3.9 |
| βc-3635 | 3471 | 9.5 ± 3.6 |
| βc-3637 | 3473 | 11.6 ± 5 |
| βc-3639 | 3475 | 18.9 ± 10.1 |
| βc-3641 | 3477 | 8.4 ± 5.4 |
| βc-3643 | 3479 | 10.8 ± 5.6 |
| βc-3645 | 3481 | 12.6 ± 3.2 |
| βc-3647 | 3483 | 15.1 ± 2.7 |
| βc-3649 | 3485 | 14.4 ± 3.1 |
| βc-3651 | 3487 | 7.2 ± 11.1 |
| βc-3653 | 3489 | 6.3 ± 5.7 |
| βc-3655 | 3491 | 10.9 ± 7.7 |
| βc-3657 | 3493 | 7 ± 3.5 |
| βc-3659 | 3495 | 5.4 ± 8.4 |
| βc-3708 | 3540 | 6.3 ± 11.3 |
| βc-3710 | 3542 | 5.5 ± 11.8 |
| βc-3712 | 3544 | 4.8 ± 8.1 |
| βc-3714 | 3546 | 7.4 ± 3.6 |
| βc-3716 | 3548 | 20.2 ± 11.6 |

Figure 2:
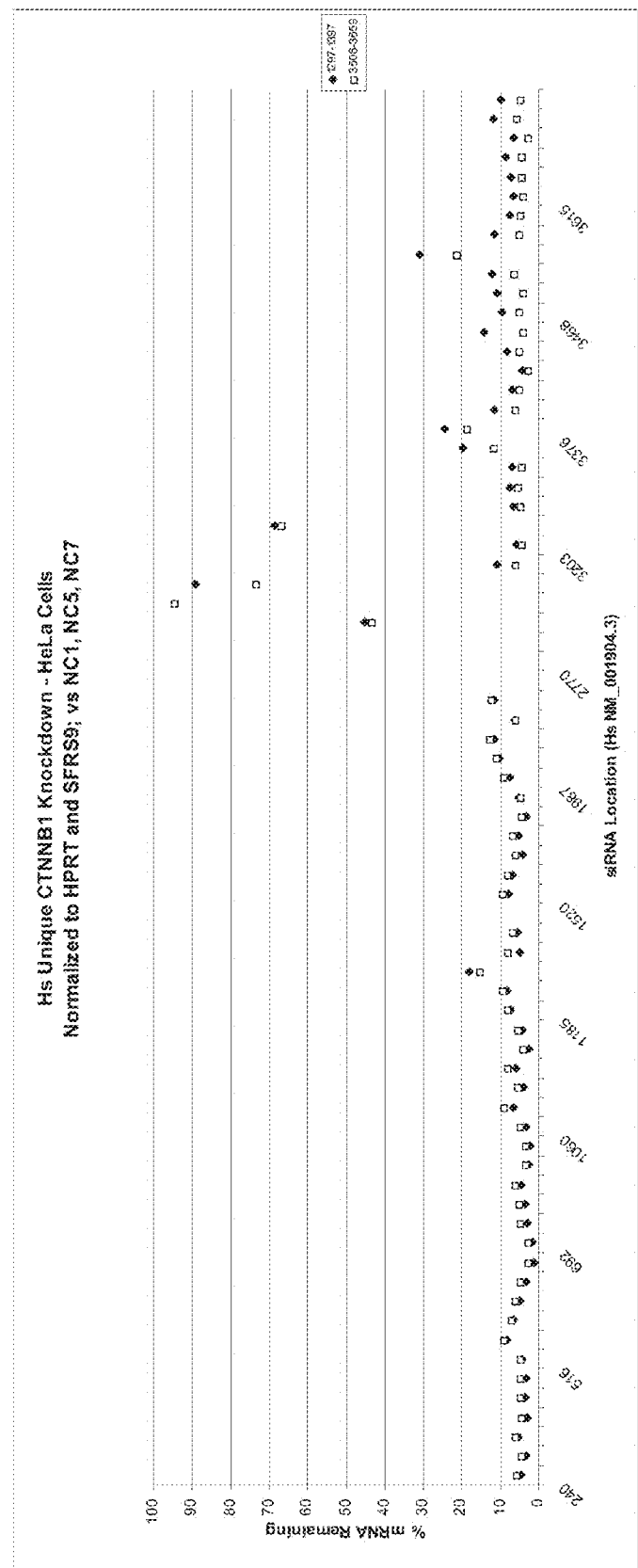
FIGS. 2 and 3 show plots of human β-catenin inhibitory efficacies observed at 1 nM in the environment of HeLa cells for DsiRNAs targeting sites progressing from 5' to 3' across the human β-catenin transcript. Human β-catenin levels were normalized to HPRT and SFRS9 levels.
Figure 3:
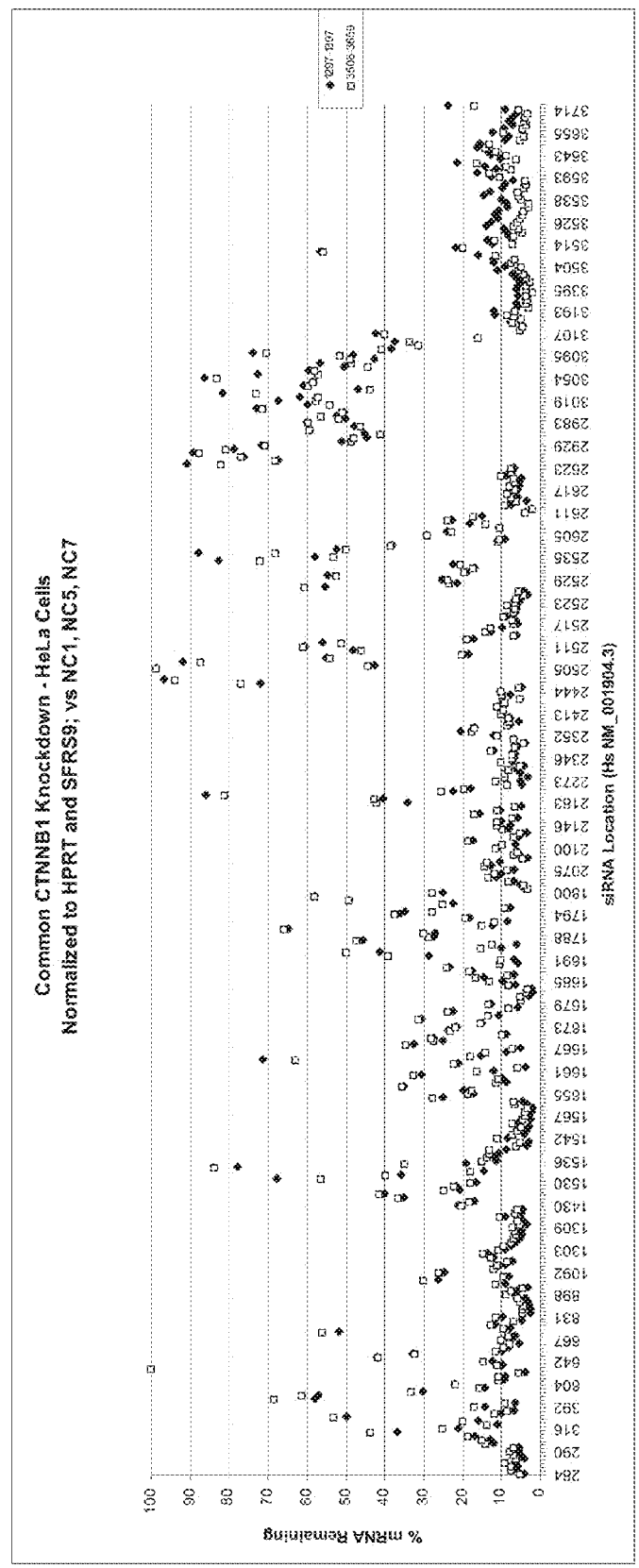

The data shown in above Table 14 were also plotted graphically (see FIGS. 2 and 3).

TABLE 15

100 Human β-Catenin-Targeting DsiRNAs (Rank Ordered by Inhibition)

| Tested DsiRNA (Target Location in human β-catenin transcript variant 1) | Mouse β-catenin Target Location (in NM_007614.2) | % Remaining β-catenin mRNA ± % Error |
|---|---|---|
| βc-686 |  | 2.1 ± 2.8 |
| βc-692 |  | 2.2 ± 4.9 |
| βc-2612 | 2556 | 2.2 ± 4.6 |
| βc-1569 | 1513 | 2.7 ± 13 |
| βc-3393 | 3238 | 2.7 ± 7.1 |
| βc-1682 | 1626 | 2.8 ± 6.2 |
| βc-1683 | 1627 | 2.8 ± 5.7 |
| βc-889 |  | 2.9 ± 4.9 |
| βc-870 |  | 3 ± 7.7 |
| βc-1154 |  | 3.2 ± 10.7 |
| βc-1568 | 1512 | 3.2 ± 8.4 |
| βc-3431 |  | 3.4 ± 7 |
| βc-894 | 838 | 3.5 ± 2 |
| βc-1567 | 1511 | 3.5 ± 17.3 |
| βc-259 |  | 3.6 ± 11.3 |
| βc-893 | 837 | 3.6 ± 6.2 |
| βc-895 | 839 | 3.6 ± 2.1 |
| βc-1566 | 1510 | 3.6 ± 6.6 |
| βc-2525 | 2469 | 3.6 ± 1.3 |
| βc-3389 | 3234 | 3.6 ± 6 |
| βc-1620 |  | 3.7 ± 4.1 |
| βc-244 |  | 3.8 ± 2.8 |
| βc-582 |  | 3.8 ± 6.8 |
| βc-1820 | 1764 | 3.8 ± 7.8 |
| βc-2611 | 2555 | 3.8 ± 1.4 |
| βc-496 |  | 3.9 ± 5.3 |
| βc-697 |  | 3.9 ± 4.4 |
| βc-900 | 844 | 3.9 ± 2.8 |
| βc-2097 | 2041 | 3.9 ± 2.7 |
| βc-3399 | 3244 | 3.9 ± 9.3 |
| βc-1060 |  | 4 ± 3.6 |
| βc-1545 | 1489 | 4 ± 5.5 |
| βc-1681 | 1625 | 4 ± 6.5 |
| βc-264 |  | 4.1 ± 9.5 |
| βc-2350 | 2294 | 4.1 ± 11.7 |
| βc-1541 | 1485 | 4.2 ± 9.8 |
| βc-707 |  | 4.3 ± 6.9 |
| βc-896 | 840 | 4.3 ± 10.3 |
| βc-516 |  | 4.4 ± 6.5 |
| βc-2144 | 2088 | 4.4 ± 16.1 |
| βc-3195 | 3088 | 4.4 ± 3.1 |
| βc-1310 | 1254 | 4.5 ± 3.2 |
| βc-3111 | 3005 | 4.5 ± 7.6 |
| βc-1070 |  | 4.6 ± 2.1 |
| βc-3691 |  | 4.6 ± 3 |
| βc-639 | 583 | 4.6 ± 7.8 |
| βc-3391 | 3236 | 4.7 ± 7.2 |
| βc-1180 |  | 4.8 ± 4 |
| βc-1544 | 1488 | 4.8 ± 5.8 |
| βc-1821 | 1765 | 4.8 ± 13.4 |
| βc-2277 | 2221 | 4.8 ± 2.8 |
| βc-3387 | 3232 | 4.8 ± 7.8 |
| βc-3397 | 3242 | 4.8 ± 3.1 |
| βc-3401 | 3246 | 4.8 ± 9.8 |
| βc-3712 | 3544 | 4.8 ± 8.1 |
| βc-1816 |  | 4.9 ± 3.4 |
| βc-284 | 228 | 4.9 ± 14.1 |
| βc-897 | 841 | 4.9 ± 8.8 |
| βc-2526 | 2470 | 4.9 ± 2.8 |
| βc-2614 | 2558 | 4.9 ± 3.4 |
| βc-3395 | 3240 | 4.9 ± 3.7 |
| βc-240 |  | 5 ± 21.1 |
| βc-1571 |  | 5 ± 3.4 |
| βc-1540 | 1484 | 5 ± 6.1 |
| βc-1662 | 1606 | 5 ± 4.4 |
| βc-1680 | 1624 | 5 ± 10.6 |
| βc-3203 |  | 5.1 ± 8.3 |
| βc-1652 | 1596 | 5.1 ± 14.3 |
| βc-3115 | 3009 | 5.1 ± 15.4 |
| βc-753 |  | 5.2 ± 6.1 |
| βc-1314 | 1258 | 5.2 ± 5.9 |
| βc-2442 | 2386 | 5.2 ± 5 |
| βc-540 |  | 5.3 ± 4.7 |
| βc-288 | 232 | 5.3 ± 4 |
| βc-1311 | 1255 | 5.3 ± 4.5 |
| βc-2445 | 2389 | 5.3 ± 6.4 |
| βc-3109 | 3003 | 5.3 ± 35.8 |
| βc-3615 |  | 5.4 ± 3.9 |
| βc-3591 | 3428 | 5.4 ± 6.6 |
| βc-3659 | 3495 | 5.4 ± 8.4 |
| βc-253 |  | 5.5 ± 1.7 |
| βc-3333 |  | 5.5 ± 8.4 |
| βc-2524 | 2468 | 5.5 ± 3 |
| βc-3710 | 3542 | 5.5 ± 11.8 |
| βc-3354 |  | 5.6 ± 11.1 |
| βc-3534 | 3370 | 5.6 ± 11.9 |
| βc-1307 | 1251 | 5.7 ± 3.6 |
| βc-1308 | 1252 | 5.7 ± 5.1 |
| βc-1313 | 1257 | 5.7 ± 6.3 |
| βc-1543 | 1487 | 5.7 ± 6.4 |
| βc-2151 | 2095 | 5.7 ± 3.2 |
| βc-3500 | 3336 | 5.7 ± 3.4 |
| βc-3536 | 3372 | 5.7 ± 2.8 |
| βc-3674 |  | 5.8 ± 4.1 |
| βc-830 | 774 | 5.8 ± 3 |
| βc-1653 | 1597 | 5.8 ± 13.2 |
| βc-1579 |  | 5.9 ± 4.4 |
| βc-3426 |  | 5.9 ± N/A |

TABLE 15-continued

100 Human β-Catenin-Targeting DsiRNAs (Rank Ordered by Inhibition)

| Tested DsiRNA (Target Location in human β-catenin transcript variant 1) | Mouse β-catenin Target Location (in NM_007614.2) | % Remaining β-catenin mRNA ± % Error |
|---|---|---|
| βc-289 | 233 | 5.9 ± 13.9 |
| βc-2620 | 2564 | 5.9 ± 11.4 |

TABLE 16

β-Catenin Inhibitory Efficacy of DsiRNAs at 1 nM in Mouse Hepa 1-6 Cells

| Tested DsiRNA/Mouse β-catenin Target Location (in NM_007614.2) | Tested DsiRNA/Human β-catenin transcript variant 1 Target Location | % Remaining β-catenin mRNA ± % Error |
|---|---|---|
| 228 | βc-284 | 32 ± 23 |
| 229 | βc-285 | 27.2 ± 10.7 |
| 230 | βc-286 | 24.5 ± 14.5 |
| 231 | βc-287 | 35.9 ± 19.7 |
| 232 | βc-288 | 43.1 ± 12 |
| 233 | βc-289 | 34.8 ± 7 |
| 234 | βc-290 | 41.6 ± 15.9 |
| 235 | βc-291 | 48.4 ± 25.1 |
| 256 | βc-312 | 109.7 ± N/A |
| 257 | βc-313 | 68.5 ± 6.7 |
| 258 | βc-314 | 93.4 ± 8.6 |
| 259 | βc-315 | 69.4 ± 3.4 |
| 260 | βc-316 | 101 ± 3.4 |
| 261 | βc-317 | 67.6 ± 10.5 |
| 262 | βc-318 | 88 ± 11 |
| 333 | βc-389 | 107.4 ± 6.7 |
| 334 | βc-390 | 99.2 ± 14.4 |
| 335 | βc-391 | 68.5 ± 7.4 |
| 336 | βc-392 | 77.4 ± 5.5 |
| 337 | βc-393 | 53.8 ± 6.8 |
| 544 | βc-600 | 65.9 ± 7.7 |
| 545 | βc-601 | 54.1 ± 6.3 |
| 546 | βc-602 | 44.1 ± 12.9 |
| 547 | βc-603 | 37.3 ± 7.3 |
| 548 | βc-604 | 83 ± 14.5 |
| 549 | βc-605 | 44.6 ± 9.2 |
| 582 | βc-638 | 22.6 ± 5.9 |
| 583 | βc-639 | 12.2 ± 15.4 |
| 584 | βc-640 | 102.1 ± 8.4 |
| 585 | βc-641 | 24.4 ± 9 |
| 586 | βc-642 | 32.3 ± 29.7 |
| 587 | βc-643 | 62.1 ± 10.6 |
| 588 | βc-644 | 56.1 ± 6.8 |
| 589 | βc-645 | 18.4 ± 6.2 |
| 609 | βc-665 | 23.7 ± 7 |
| 610 | βc-666 | 23.3 ± 7.2 |
| 611 | βc-667 | 18.5 ± 6.1 |
| 675 | βc-731 | 34.4 ± 13.7 |
| 676 | βc-732 | 127.2 ± 3.4 |
| 753 | βc-809 | 56 ± 7.6 |
| 754 | βc-810 | 82.4 ± 5.4 |
| 774 | βc-830 | 26.5 ± 6.2 |
| 775 | βc-831 | 16.1 ± 7.3 |
| 837 | βc-893 | 9.2 ± 9.5 |
| 838 | βc-894 | 10.5 ± 9.4 |
| 839 | βc-895 | 12.5 ± 16.7 |
| 840 | βc-896 | 14.1 ± 19.2 |
| 841 | βc-897 | 25.7 ± 10 |
| 842 | βc-898 | 20.1 ± 19.7 |
| 843 | βc-899 | 21.5 ± 13.6 |
| 844 | βc-900 | 13.8 ± 9.7 |
| 921 | βc-977 | 44.1 ± 12 |
| 922 | βc-978 | 58.4 ± 43 |
| 1035 | βc-1091 | 97.2 ± 10.9 |
| 1036 | βc-1092 | 111.4 ± 10.5 |
| 1037 | βc-1093 | 122 ± 13.4 |
| 1038 | βc-1094 | 54.1 ± 3.6 |
| 1039 | βc-1095 | 53.2 ± 6.9 |
| 1245 | βc-1301 | 25.5 ± 3.9 |
| 1246 | βc-1302 | 28.7 ± 5.2 |
| 1247 | βc-1303 | 33.5 ± 3.2 |
| 1248 | βc-1304 | 31.2 ± 11.2 |
| 1249 | βc-1305 | 22.1 ± 17.3 |
| 1250 | βc-1306 | 23.5 ± 15.8 |
| 1251 | βc-1307 | 15.7 ± 13.3 |
| 1252 | βc-1308 | 16.4 ± 13.6 |
| 1253 | βc-1309 | 13.5 ± 4.8 |
| 1254 | βc-1310 | 14.9 ± 8.1 |
| 1255 | βc-1311 | 17.6 ± 12.9 |
| 1256 | βc-1312 | 33.4 ± 6.4 |
| 1257 | βc-1313 | 16.8 ± 11.1 |
| 1258 | βc-1314 | 18.4 ± 4.8 |
| 1374 | βc-1430 | 57.1 ± 4.4 |
| 1375 | βc-1431 | 42.3 ± 7.5 |
| 1470 | βc-1526 | 64.7 ± 8.8 |
| 1471 | βc-1527 | 36.8 ± 12.4 |
| 1472 | βc-1528 | 31.6 ± 18.8 |
| 1473 | βc-1529 | 25.7 ± 13.3 |
| 1474 | βc-1530 | 30.3 ± 13.7 |
| 1475 | βc-1531 | 56.3 ± 2.2 |
| 1476 | βc-1532 | 31.5 ± 5 |
| 1477 | βc-1533 | 21.2 ± 2.6 |
| 1478 | βc-1534 | 77.6 ± 5.7 |
| 1479 | βc-1535 | 34.3 ± 8.3 |
| 1480 | βc-1536 | 14.7 ± 3.6 |
| 1481 | βc-1537 | 14.1 ± 9 |
| 1482 | βc-1538 | 21.1 ± 4 |
| 1483 | βc-1539 | 19.5 ± 8.4 |
| 1484 | βc-1540 | 11.7 ± N/A |
| 1485 | βc-1541 | 7.3 ± 7.1 |
| 1486 | βc-1542 | 14.7 ± 7.8 |
| 1487 | βc-1543 | 11.7 ± 5.9 |
| 1488 | βc-1544 | 8.2 ± 8.2 |
| 1489 | βc-1545 | 7.4 ± 10.1 |
| 1509 | βc-1565 | 21.2 ± 9.1 |
| 1510 | βc-1566 | 9 ± 18.1 |
| 1511 | βc-1567 | 10.7 ± 16.4 |
| 1512 | βc-1568 | 8.3 ± 14.9 |
| 1513 | βc-1569 | 7 ± 12.8 |
| 1596 | βc-1652 | 10.1 ± 13.9 |
| 1597 | βc-1653 | 23.4 ± 32.9 |
| 1598 | βc-1654 | 67.3 ± 27.6 |
| 1599 | βc-1655 | 38.5 ± 12.3 |
| 1600 | βc-1656 | 26.3 ± 14.2 |
| 1601 | βc-1657 | 38 ± 8.9 |
| 1602 | βc-1658 | 12.7 ± 6.8 |
| 1603 | βc-1659 | 25.9 ± 7.6 |
| 1604 | βc-1660 | 56.5 ± 12.8 |
| 1605 | βc-1661 | 27.3 ± 13.4 |
| 1606 | βc-1662 | 12.3 ± 18.1 |
| 1607 | βc-1663 | 46.1 ± 27.2 |
| 1608 | βc-1664 | 71.2 ± 17.1 |
| 1609 | βc-1665 | 25.8 ± 11.4 |
| 1610 | βc-1666 | 15.7 ± 4.7 |
| 1611 | βc-1667 | 20.8 ± 4 |
| 1612 | βc-1668 | 61 ± 29.3 |
| 1613 | βc-1669 | 46.7 ± 11.4 |
| 1614 | βc-1670 | 44.9 ± 1.6 |
| 1615 | βc-1671 | 30.7 ± 20.8 |
| 1616 | βc-1672 | 52.8 ± 12.9 |
| 1617 | βc-1673 | 56.7 ± 11.2 |
| 1618 | βc-1674 | 28 ± 7 |
| 1619 | βc-1675 | 37.5 ± 11.1 |
| 1620 | βc-1676 | 16 ± 7.2 |
| 1621 | βc-1677 | 40.8 ± 3.1 |
| 1622 | βc-1678 | 14.1 ± 10.8 |
| 1623 | βc-1679 | 26.7 ± 14.4 |
| 1624 | βc-1680 | 14.8 ± 7.4 |
| 1625 | βc-1681 | 10.7 ± 5 |
| 1626 | βc-1682 | 10.9 ± 21.3 |
| 1627 | βc-1683 | 7.3 ± 11 |

TABLE 16-continued

β-Catenin Inhibitory Efficacy of DsiRNAs at 1 nM in Mouse Hepa 1-6 Cells

| Tested DsiRNA/Mouse β-catenin Target Location (in NM_007614.2) | Tested DsiRNA/Human β-catenin transcript variant 1 Target Location | % Remaining β-catenin mRNA ± % Error |
|---|---|---|
| 1628 | βc-1684 | 11.1 ± 3.3 |
| 1629 | βc-1685 | 21.5 ± 18 |
| 1630 | βc-1686 | 23.4 ± 4.7 |
| 1631 | βc-1687 | 15.2 ± 16.6 |
| 1632 | βc-1688 | 21.6 ± 4.9 |
| 1633 | βc-1689 | 33.6 ± 34.5 |
| 1634 | βc-1690 | 24.1 ± 10.9 |
| 1635 | βc-1691 | 33.7 ± 10.9 |
| 1636 | βc-1692 | 42.5 ± 3.9 |
| 1637 | βc-1693 | 83.4 ± 14 |
| 1638 | βc-1694 | 19.8 ± 2.6 |
| 1639 | βc-1695 | 15.9 ± 10.9 |
| 1731 | βc-1787 | 65.2 ± 8.7 |
| 1732 | βc-1788 | 33.4 ± 25.5 |
| 1733 | βc-1789 | 35.4 ± 16.3 |
| 1734 | βc-1790 | 46.6 ± 16.4 |
| 1735 | βc-1791 | 15 ± 9.5 |
| 1736 | βc-1792 | 12.8 ± 4.4 |
| 1737 | βc-1793 | 15.8 ± 8.3 |
| 1738 | βc-1794 | 28.4 ± 7.1 |
| 1739 | βc-1795 | 23.5 ± 17.2 |
| 1740 | βc-1796 | 9 ± 14.1 |
| 1741 | βc-1797 | 26.1 ± 6.6 |
| 1742 | βc-1798 | 50.2 ± 10.2 |
| 1743 | βc-1799 | 55.9 ± 2.7 |
| 1744 | βc-1800 | 36.3 ± 6.5 |
| 1764 | βc-1820 | 7.3 ± 37.9 |
| 1765 | βc-1821 | 5.6 ± 13.9 |
| 2016 | βc-2072 | 12.3 ± 15 |
| 2017 | βc-2073 | 12.4 ± 10.3 |
| 2018 | βc-2074 | 16.3 ± 14.8 |
| 2019 | βc-2075 | 8.2 ± 15.3 |
| 2020 | βc-2076 | 9.8 ± 7.1 |
| 2021 | βc-2077 | 16.9 ± 42 |
| 2041 | βc-2097 | 5.6 ± 10.2 |
| 2042 | βc-2098 | 7.4 ± 6 |
| 2043 | βc-2099 | 12.6 ± 21.8 |
| 2044 | βc-2100 | 28.7 ± 7.6 |
| 2085 | βc-2141 | 29.7 ± 14.1 |
| 2086 | βc-2142 | 46.2 ± 4.4 |
| 2087 | βc-2143 | 16 ± 10.8 |
| 2088 | βc-2144 | 13.8 ± 18.6 |
| 2089 | βc-2145 | 29.6 ± 10.3 |
| 2090 | βc-2146 | 40.5 ± 5.3 |
| 2091 | βc-2147 | 27.9 ± 11.4 |
| 2092 | βc-2148 | 21.8 ± 2.2 |
| 2093 | βc-2149 | 60.3 ± 4.4 |
| 2094 | βc-2150 | 42.8 ± 3.9 |
| 2095 | βc-2151 | 29 ± 2.4 |
| 2127 | βc-2183 | 75 ± 4.7 |
| 2128 | βc-2184 | 76.5 ± 4.7 |
| 2129 | βc-2185 | 129.6 ± 16.4 |
| 2214 | βc-2270 | 65.8 ± 4.7 |
| 2215 | βc-2271 | 40.8 ± N/A |
| 2216 | βc-2272 | 13.5 ± 8.5 |
| 2217 | βc-2273 | 21.5 ± 3 |
| 2218 | βc-2274 | 17.6 ± 6.2 |
| 2219 | βc-2275 | 28.9 ± 6.2 |
| 2220 | βc-2276 | 21.2 ± 5.4 |
| 2221 | βc-2277 | 26.9 ± 2.8 |
| 2289 | βc-2345 | 20.8 ± 8.7 |
| 2290 | βc-2346 | 13.6 ± 7.2 |
| 2291 | βc-2347 | 17 ± 12.8 |
| 2292 | βc-2348 | 19.2 ± 3.3 |
| 2293 | βc-2349 | 9.6 ± 6.4 |
| 2294 | βc-2350 | 10.4 ± 12.8 |
| 2295 | βc-2351 | 17 ± 8.9 |
| 2296 | βc-2352 | 31.2 ± 13.1 |
| 2297 | βc-2353 | 37.1 ± N/A |
| 2298 | βc-2354 | 32.4 ± 6 |
| 2299 | βc-2355 | 21.5 ± 5.3 |
| 2355 | βc-2411 | 16.6 ± 6.3 |
| 2356 | βc-2412 | 12.8 ± 8 |
| 2357 | βc-2413 | 18.6 ± 5.8 |
| 2358 | βc-2414 | 16.3 ± 12.4 |
| 2359 | βc-2415 | 27.2 ± 11.4 |
| 2385 | βc-2441 | 20.1 ± 18.9 |
| 2386 | βc-2442 | 9.2 ± 4 |
| 2387 | βc-2443 | 14.4 ± 8.1 |
| 2388 | βc-2444 | 14.2 ± 3.4 |
| 2389 | βc-2445 | 9.8 ± 7.6 |
| 2445 | βc-2501 | 67.3 ± 5.1 |
| 2446 | βc-2502 | 72.4 ± 6.2 |
| 2447 | βc-2503 | 96.8 ± 6.3 |
| 2448 | βc-2504 | 112.6 ± 7.5 |
| 2449 | βc-2505 | 68.5 ± 9.4 |
| 2450 | βc-2506 | 128.8 ± 10.4 |
| 2451 | βc-2507 | 144.3 ± 12.9 |
| 2452 | βc-2508 | 99.5 ± 8.8 |
| 2453 | βc-2509 | 80.5 ± 8.4 |
| 2454 | βc-2510 | 88.6 ± 10.6 |
| 2455 | βc-2511 | 105.9 ± 8.8 |
| 2456 | βc-2512 | 126.3 ± 18.2 |
| 2457 | βc-2513 | 30.4 ± 13.7 |
| 2458 | βc-2514 | 22.6 ± 2.4 |
| 2459 | βc-2515 | 45.2 ± 30.1 |
| 2460 | βc-2516 | 27.6 ± 7.2 |
| 2461 | βc-2517 | 19.7 ± N/A |
| 2462 | βc-2518 | 21.9 ± 10.5 |
| 2463 | βc-2519 | 29.9 ± 14.6 |
| 2464 | βc-2520 | 27.2 ± 6.1 |
| 2465 | βc-2521 | 11.5 ± N/A |
| 2466 | βc-2522 | 17.9 ± 8.4 |
| 2467 | βc-2523 | 18.5 ± 4.5 |
| 2468 | βc-2524 | 16.8 ± 6.6 |
| 2469 | βc-2525 | 19.4 ± 14.4 |
| 2470 | βc-2526 | 10.7 ± 6.8 |
| 2471 | βc-2527 | 62.5 ± 8.1 |
| 2472 | βc-2528 | 64.5 ± 14.2 |
| 2473 | βc-2529 | 41.4 ± 12.6 |
| 2474 | βc-2530 | 73.5 ± 7.1 |
| 2475 | βc-2531 | 32.2 ± 10.4 |
| 2476 | βc-2532 | 23.9 ± 18.7 |
| 2477 | βc-2533 | 40 ± 10 |
| 2478 | βc-2534 | 60.4 ± N/A |
| 2479 | βc-2535 | 81.3 ± 4.9 |
| 2511 | βc-2567 | 104.5 ± 12.9 |
| 2512 | βc-2568 | 53 ± 9 |
| 2513 | βc-2569 | 67.1 ± 3.6 |
| 2547 | βc-2603 | 18.1 ± 7.9 |
| 2548 | βc-2604 | 14.2 ± 2.5 |
| 2549 | βc-2605 | 28.9 ± 5.9 |
| 2550 | βc-2606 | 23.7 ± 6.8 |
| 2551 | βc-2607 | 17.1 ± 16.7 |
| 2552 | βc-2608 | 18.1 ± 3.6 |
| 2553 | βc-2609 | 23.8 ± N/A |
| 2554 | βc-2610 | 22.6 ± 21.5 |
| 2555 | βc-2611 | 9.4 ± 7.6 |
| 2556 | βc-2612 | 5.1 ± 4.1 |
| 2557 | βc-2613 | 16.3 ± 7.8 |
| 2558 | βc-2614 | 11 ± 8.5 |
| 2559 | βc-2615 | 11.6 ± 4 |
| 2560 | βc-2616 | 14.8 ± 4.1 |
| 2561 | βc-2617 | 9.8 ± 8.1 |
| 2562 | βc-2618 | 12 ± 8.8 |
| 2563 | βc-2619 | 10.7 ± 13.7 |
| 2564 | βc-2620 | 9.2 ± 18.9 |
| 2565 | βc-2621 | 16.9 ± 9.6 |
| 2566 | βc-2622 | 15.5 ± 7.2 |
| 2567 | βc-2623 | 15 ± 6.1 |
| 2765 | βc-2869 | 24.5 ± 26.4 |
| 2798 | βc-2902 | 10.1 ± 9.5 |
| 2819 | βc-2923 | 16.9 ± 2 |
| 2821 | βc-2925 | 11.2 ± 6.3 |
| 2823 | βc-2927 | 15.4 ± 9.6 |
| 2825 | βc-2929 | 9.8 ± 10 |

TABLE 16-continued

β-Catenin Inhibitory Efficacy of DsiRNAs at 1 nM in Mouse Hepa 1-6 Cells

| Tested DsiRNA/Mouse β-catenin Target Location (in NM_007614.2) | Tested DsiRNA/Human β-catenin transcript variant 1 Target Location | % Remaining β-catenin mRNA ± % Error |
|---|---|---|
| 2867 | βc-2973 | 16.6 ± 5.2 |
| 2869 | βc-2975 | 28.7 ± 12.7 |
| 2871 | βc-2977 | 17 ± 9.7 |
| 2873 | βc-2979 | 20 ± 13 |
| 2875 | βc-2981 | 20 ± 17.9 |
| 2877 | βc-2983 | 29 ± 5.7 |
| 2879 | βc-2985 | 12.1 ± 13 |
| 2881 | βc-2987 | 18.3 ± 7.6 |
| 2883 | βc-2989 | 12.4 ± 6.9 |
| 2909 | βc-3015 | 12 ± 9.6 |
| 2911 | βc-3017 | 18.6 ± 21.3 |
| 2913 | βc-3019 | 15.8 ± 16.6 |
| 2915 | βc-3021 | 24 ± 5.9 |
| 2940 | βc-3046 | 24.3 ± 5.1 |
| 2942 | βc-3048 | 10.8 ± 18.4 |
| 2944 | βc-3050 | 15.9 ± 7.1 |
| 2946 | βc-3052 | 16 ± 15.8 |
| 2948 | βc-3054 | 13.4 ± 8.2 |
| 2950 | βc-3056 | 35.2 ± 11.8 |
| 2981 | βc-3087 | 8.9 ± 27.7 |
| 2983 | βc-3089 | 11.3 ± 3.5 |
| 2985 | βc-3091 | 26.6 ± 4.1 |
| 2987 | βc-3093 | 7.3 ± 6.4 |
| 2989 | βc-3095 | 16.1 ± 7 |
| 2991 | βc-3097 | 6.7 ± 4.3 |
| 2993 | βc-3099 | 12.5 ± 5.7 |
| 2995 | βc-3101 | 11.4 ± 3.3 |
| 2997 | βc-3103 | 7.4 ± 9.7 |
| 2999 | βc-3105 | 7.4 ± 3 |
| 3001 | βc-3107 | 8.6 ± 5.1 |
| 3003 | βc-3109 | 6.3 ± 9.2 |
| 3005 | βc-3111 | 5.8 ± 6.9 |
| 3007 | βc-3113 | 8 ± 3.6 |
| 3009 | βc-3115 | 7.9 ± 8.8 |
| 3084 | βc-3191 | 15.9 ± 4.2 |
| 3086 | βc-3193 | 22.1 ± 8.4 |
| 3088 | βc-3195 | 11.1 ± 14.2 |
| 3232 | βc-3387 | 8.3 ± 12.4 |
| 3234 | βc-3389 | 6.1 ± 16.4 |
| 3236 | βc-3391 | 7.5 ± 12.1 |
| 3238 | βc-3393 | 5.9 ± 14.7 |
| 3240 | βc-3395 | 9.6 ± 8.1 |
| 3242 | βc-3397 | 12.7 ± 2.5 |
| 3244 | βc-3399 | 5.4 ± 9.6 |
| 3246 | βc-3401 | 9.4 ± 10.7 |
| 3336 | βc-3500 | 10.2 ± 1.6 |
| 3338 | βc-3502 | 8 ± 6.6 |
| 3340 | βc-3504 | 9 ± 3 |
| 3342 | βc-3506 | 17.7 ± 3.3 |
| 3344 | βc-3508 | 23.8 ± 4 |
| 3345 | βc-3509 | 25.3 ± 3.6 |
| 3346 | βc-3510 | 63.9 ± 10.6 |
| 3348 | βc-3512 | 25.2 ± 6.4 |
| 3350 | βc-3514 | 10.1 ± 2 |
| 3352 | βc-3516 | 17.9 ± 1.9 |
| 3354 | βc-3518 | 11.1 ± 5.4 |
| 3356 | βc-3520 | 8.5 ± 2.6 |
| 3358 | βc-3522 | 12.5 ± 8.6 |
| 3360 | βc-3524 | 15.4 ± 7.4 |
| 3362 | βc-3526 | 7 ± 7.7 |
| 3364 | βc-3528 | 10.5 ± 10.7 |
| 3366 | βc-3530 | 12.9 ± 11.6 |
| 3368 | βc-3532 | 7.2 ± 15.4 |
| 3370 | βc-3534 | 7.7 ± 13.4 |
| 3372 | βc-3536 | 9.7 ± 15.8 |
| 3374 | βc-3538 | 12.6 ± 8.8 |
| 3420 | βc-3583 | 19.8 ± 4 |
| 3422 | βc-3585 | 10.6 ± 2.4 |
| 3424 | βc-3587 | 8.7 ± 2.9 |
| 3426 | βc-3589 | 9.7 ± 1.7 |
| 3428 | βc-3591 | 7.5 ± 4.2 |
| 3430 | βc-3593 | 22 ± 1.7 |
| 3469 | βc-3633 | 14.2 ± 5.1 |
| 3471 | βc-3635 | 12.1 ± 7.6 |
| 3473 | βc-3637 | 17.3 ± 5.6 |
| 3475 | βc-3639 | 9.8 ± 5.4 |
| 3477 | βc-3641 | 9.7 ± 6.5 |
| 3479 | βc-3643 | 11 ± 5.2 |
| 3481 | βc-3645 | 6.9 ± 8.9 |
| 3483 | βc-3647 | 17.5 ± 5 |
| 3485 | βc-3649 | 16.7 ± 1.8 |
| 3487 | βc-3651 | 12.2 ± 4.3 |
| 3489 | βc-3653 | 16.5 ± 3.3 |
| 3491 | βc-3655 | 11.4 ± 14.1 |
| 3493 | βc-3657 | 10 ± 10.2 |
| 3495 | βc-3659 | 8.7 ± 5 |
| 3540 | βc-3708 | 7.4 ± 7 |
| 3542 | βc-3710 | 8.7 ± 3.2 |
| 3544 | βc-3712 | 6 ± 9.4 |
| 3546 | βc-3714 | 11.9 ± 2.9 |
| 3548 | βc-3716 | 27 ± 7.1 |
| βc-m314 | | 77.1 ± 15.6 |
| βc-m325 | | 99.1 ± 19.3 |
| βc-m408 | | 50.4 ± 23.7 |
| βc-m460 | | 58.7 ± 16.5 |
| βc-m526 | | 12.9 ± 4.5 |
| βc-m631 | | 13.7 ± 11.2 |
| βc-m636 | | 16.5 ± 19.9 |
| βc-m642 | | 10.8 ± 8.5 |
| βc-m723 | | 13.7 ± 12.1 |
| βc-m970 | | 12.3 ± 10.9 |
| βc-m976 | | 12 ± 9.5 |
| βc-m981 | | 15.3 ± 4.1 |
| βc-m1066 | | 11.3 ± 8.6 |
| βc-m1106 | | 10.6 ± 7.8 |
| βc-m1354 | | 9.7 ± 6.1 |
| βc-m1363 | | 11.1 ± 3.3 |
| βc-m1373 | | 11.8 ± N/A |
| βc-m1508 | | 11.5 ± 7.1 |
| βc-m1515 | | 9.4 ± 6.9 |
| βc-m1682 | | 11.8 ± 11.4 |
| βc-m1693 | | 16 ± 14 |
| βc-m1698 | | 13.5 ± 6 |
| βc-m1705 | | 10.7 ± 5.3 |
| βc-m1763 | | 7.7 ± 14.2 |
| βc-m2008 | | 18.3 ± 3.5 |
| βc-m2226 | | 11.7 ± 10 |
| βc-m2427 | | 30.8 ± 2.4 |
| βc-m2568 | | 9.7 ± 3.9 |
| βc-m2614 | | 13.3 ± 4.1 |
| βc-m2770 | | 17.5 ± 4.9 |
| βc-m2777 | | 29.8 ± 17.2 |
| βc-m2784 | | 16 ± 15.1 |
| βc-m2806 | | 8.6 ± 8 |
| βc-m2850 | | 13.4 ± 3.1 |
| βc-m2965 | | 12.5 ± 10.3 |
| βc-m2970 | | 11.6 ± 7.6 |
| βc-m2976 | | 12.8 ± 4.3 |
| βc-m3092 | | 7.5 ± 29.8 |
| βc-m3097 | | 11.6 ± 2.7 |
| βc-m3198 | | 14.7 ± 9.3 |
| βc-m3207 | | 7.9 ± N/A |
| βc-m3433 | | 15.4 ± 6.4 |
| βc-m3439 | | 14.3 ± 4.4 |
| βc-m3444 | | 9.7 ± 8.4 |
| βc-m3449 | | 9.9 ± 15.8 |
| βc-m3522 | | 10.3 ± 5.5 |
| βc-m3533 | | 10 ± 5.2 |
| βc-m3538 | | 10.1 ± 4.5 |

Figure 4:
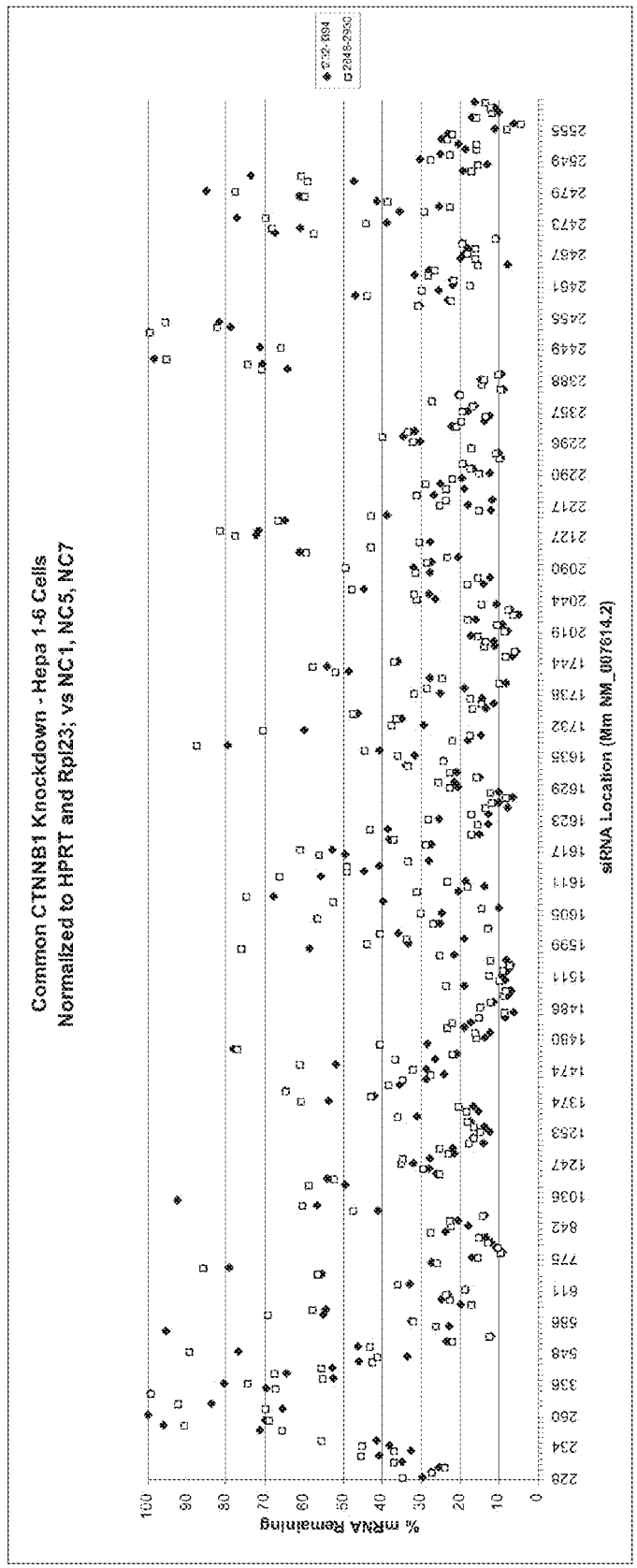
FIGS. 4 and 5 show plots of mouse β-catenin inhibitory efficacies observed at 1 nM in the environment of Hepa 1-6 cells for DsiRNAs targeting sites progressing from 5' to 3' across the mouse β-catenin transcript. Mouse β-catenin levels were normalized to HPRT and Rpl23 levels.
Figure 5:
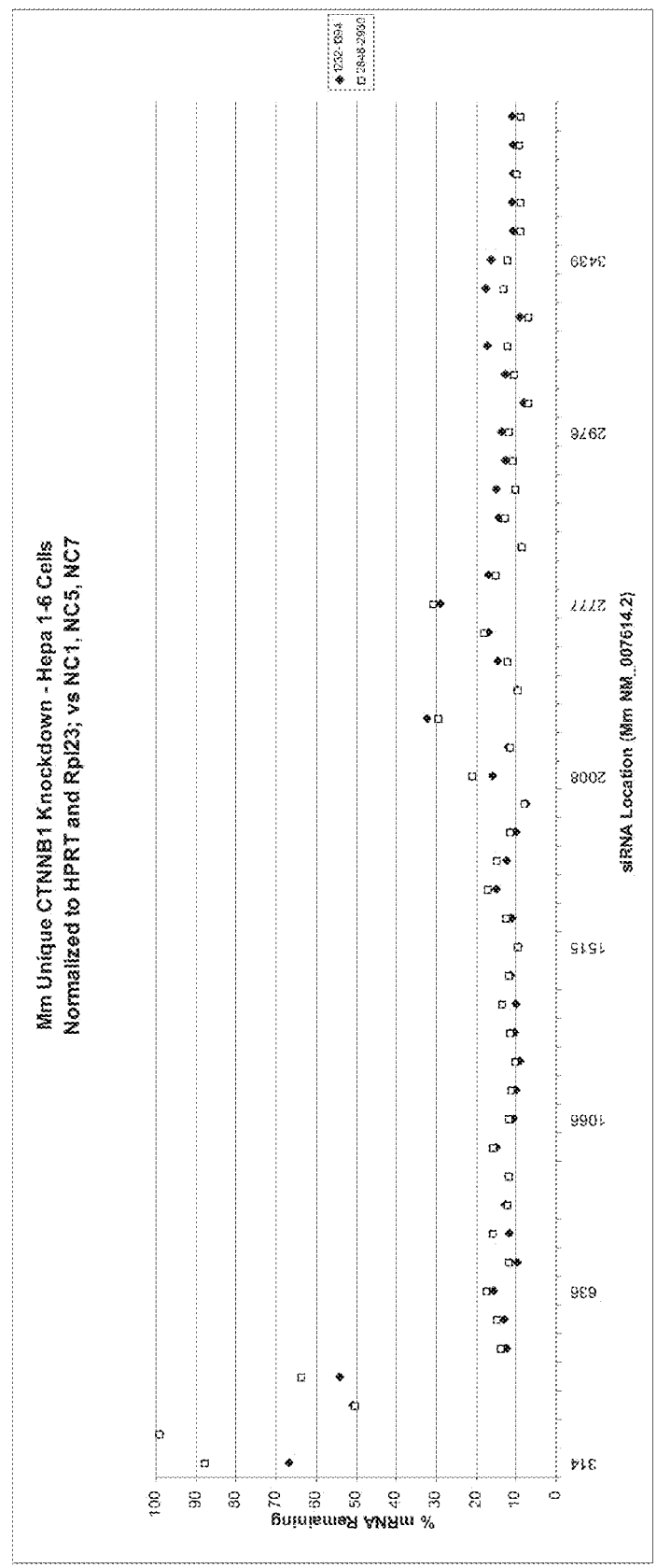

The data shown in above Table 16 were also plotted graphically (see FIGS. 4 and 5).

TABLE 17

100 Mouse β-Catenin-Targeting DsiRNAs (Rank Ordered by Inhibition)

| Tested DsiRNA/Mouse β-catenin Target Location (in NM_007614.2) | Tested DsiRNA/Human β-catenin transcript variant 1 Target Location | % Remaining β-catenin mRNA ± % Error |
|---|---|---|
| 2556 | βc-2612 | 5.1 ± 4.1 |
| 3244 | βc-3399 | 5.4 ± 9.6 |
| 1765 | βc-1821 | 5.6 ± 13.9 |
| 2041 | βc-2097 | 5.6 ± 10.2 |
| 3005 | βc-3111 | 5.8 ± 6.9 |
| 3238 | βc-3393 | 5.9 ± 14.7 |
| 3544 | βc-3712 | 6 ± 9.4 |
| 3234 | βc-3389 | 6.1 ± 16.4 |
| 3003 | βc-3109 | 6.3 ± 9.2 |
| 2991 | βc-3097 | 6.7 ± 4.3 |
| 3481 | βc-3645 | 6.9 ± 8.9 |
| 1513 | βc-1569 | 7 ± 12.8 |
| 3362 | βc-3526 | 7 ± 7.7 |
| 3368 | βc-3532 | 7.2 ± 15.4 |
| 1485 | βc-1541 | 7.3 ± 7.1 |
| 1627 | βc-1683 | 7.3 ± 11 |
| 1764 | βc-1820 | 7.3 ± 37.9 |
| 2987 | βc-3093 | 7.3 ± 6.4 |
| 1489 | βc-1545 | 7.4 ± 10.1 |
| 2042 | βc-2098 | 7.4 ± 6 |
| 2997 | βc-3103 | 7.4 ± 9.7 |
| 2999 | βc-3105 | 7.4 ± 3 |
| 3540 | βc-3708 | 7.4 ± 7 |
| 3236 | βc-3391 | 7.5 ± 12.1 |
| 3428 | βc-3591 | 7.5 ± 4.2 |
| βc-m3092 |  | 7.5 ± 29.8 |
| 3370 | βc-3534 | 7.7 ± 13.4 |
| βc-m1763 |  | 7.7 ± 14.2 |
| 3009 | βc-3115 | 7.9 ± 8.8 |
| βc-m3207 |  | 7.9 ± N/A |
| 3007 | βc-3113 | 8 ± 3.6 |
| 3338 | βc-3502 | 8 ± 6.6 |
| 1488 | βc-1544 | 8.2 ± 8.2 |
| 2019 | βc-2075 | 8.2 ± 15.3 |
| 1512 | βc-1568 | 8.3 ± 14.9 |
| 3232 | βc-3387 | 8.3 ± 12.4 |
| 3356 | βc-3520 | 8.5 ± 2.6 |
| 3001 | βc-3107 | 8.6 ± 5.1 |
| βc-m2806 |  | 8.6 ± 8 |
| 3424 | βc-3587 | 8.7 ± 2.9 |
| 3495 | βc-3659 | 8.7 ± 5 |
| 3542 | βc-3710 | 8.7 ± 3.2 |
| 2981 | βc-3087 | 8.9 ± 27.7 |
| 1510 | βc-1566 | 9 ± 18.1 |
| 1740 | βc-1796 | 9 ± 14.1 |
| 3340 | βc-3504 | 9 ± 3 |
| 837 | βc-893 | 9.2 ± 9.5 |
| 2386 | βc-2442 | 9.2 ± 4 |
| 2564 | βc-2620 | 9.2 ± 18.9 |
| 2555 | βc-2611 | 9.4 ± 7.6 |
| 3246 | βc-3401 | 9.4 ± 10.7 |
| βc-m1515 |  | 9.4 ± 6.9 |
| 2293 | βc-2349 | 9.6 ± 6.4 |
| 3240 | βc-3395 | 9.6 ± 8.1 |
| 3372 | βc-3536 | 9.7 ± 15.8 |
| 3426 | βc-3589 | 9.7 ± 1.7 |
| 3477 | βc-3641 | 9.7 ± 6.5 |
| βc-m1354 |  | 9.7 ± 6.1 |
| βc-m2568 |  | 9.7 ± 3.9 |
| βc-m3444 |  | 9.7 ± 8.4 |
| 2020 | βc-2076 | 9.8 ± 7.1 |
| 2389 | βc-2445 | 9.8 ± 7.6 |
| 2561 | βc-2617 | 9.8 ± 8.1 |
| 2825 | βc-2929 | 9.8 ± 10 |
| 3475 | βc-3639 | 9.8 ± 5.4 |
| βc-m3449 |  | 9.9 ± 15.8 |
| 3493 | βc-3657 | 10 ± 10.2 |
| βc-m3533 |  | 10 ± 5.2 |
| 1596 | βc-1652 | 10.1 ± 13.9 |
| 2798 | βc-2902 | 10.1 ± 9.5 |
| 3350 | βc-3514 | 10.1 ± 2 |
| βc-m3538 |  | 10.1 ± 4.5 |
| 3336 | βc-3500 | 10.2 ± 1.6 |
| βc-m3522 |  | 10.3 ± 5.5 |
| 2294 | βc-2350 | 10.4 ± 12.8 |
| 838 | βc-894 | 10.5 ± 9.4 |
| 3364 | βc-3528 | 10.5 ± 10.7 |
| 3422 | βc-3585 | 10.6 ± 2.4 |
| βc-m1106 |  | 10.6 ± 7.8 |
| 1511 | βc-1567 | 10.7 ± 16.4 |
| 1625 | βc-1681 | 10.7 ± 5 |
| 2470 | βc-2526 | 10.7 ± 6.8 |
| 2563 | βc-2619 | 10.7 ± 13.7 |
| βc-m1705 |  | 10.7 ± 5.3 |
| 2942 | βc-3048 | 10.8 ± 18.4 |
| βc-m642 |  | 10.8 ± 8.5 |
| 1626 | βc-1682 | 10.9 ± 21.3 |
| 2558 | βc-2614 | 11 ± 8.5 |
| 3479 | βc-3643 | 11 ± 5.2 |
| 1628 | βc-1684 | 11.1 ± 3.3 |
| 3088 | βc-3195 | 11.1 ± 14.2 |
| 3354 | βc-3518 | 11.1 ± 5.4 |
| βc-m1363 |  | 11.1 ± 3.3 |
| 2821 | βc-2925 | 11.2 ± 6.3 |
| 2983 | βc-3089 | 11.3 ± 3.5 |
| βc-m1066 |  | 11.3 ± 8.6 |
| 2995 | βc-3101 | 11.4 ± 3.3 |
| 3491 | βc-3655 | 11.4 ± 14.1 |
| 2465 | βc-2521 | 11.5 ± N/A |
| βc-m1508 |  | 11.5 ± 7.1 |

As shown in above Table 14, 348 of 440 asymmetric DsiRNAs examined in human HeLa cells showed greater than 70% reduction of human β-catenin levels in HeLa cells at 1 nM. Of these 348 DsiRNAs, 317 exhibited 80% or greater reduction of human β-catenin levels in HeLa cells at 1 nM, and 229 exhibited 90% or greater reduction of human β-catenin levels in HeLa cells at 1 nM. A number of these DsiRNAs uniquely targeted human β-catenin.

As shown in above Table 16, 295 of 416 asymmetric DsiRNAs examined in mouse Hepa 1-6 cells showed greater than 70% reduction of mouse β-catenin levels in Hepa 1-6 cells at 1 nM. Of these 295 DsiRNAs, 225 exhibited 80% or greater reduction of mouse β-catenin levels in Hepa 1-6 cells at 1 nM, and 68 exhibited 90% or greater reduction of mouse β-catenin levels in Hepa 1-6 cells at 1 nM. A number of these DsiRNAs uniquely targeted mouse β-catenin.

Example 3

β-Catenin Targeting DsiRNAs Effectively Reduced β-Catenin RNA Levels in Tumor Cells and Inhibited Tumor Cell Growth Cell Culture, RNA Transfection and Analysis HCT116 cells were maintained in McCoy's 5a Medium with 10% Fetal Bovine Serum (PBS); HepG2 cells were maintained in MEM with 10% FBS (both media contained penicillin and streptomycin). For transfection, cells were seeded into 24-well plates at 40,000 cells per well the day before transfection, in antibiotic-free medium. To transfect, DsiRNAs were complexed with the lipid transfection reagent RNAiMAX, in OptiMem medium and then added to the cells in medium to yield the indicated final DsiRNA concentrations. Controls included Untransfected cells, Mock cells treated with RNAiMAX without DsiRNA, and Control DsiRNA #114 (with non-specific sequence). After six hours of exposure, the cell culture medium was removed, cells were washed, and fresh medium was added.

For RNA expression analysis, RNA was isolated one day after transfection, using the Promega SV96 RNA isolation kit. RNA was reverse-transcribed, and then Taqman quantitative PCR was performed on a BioRad CFX96, in multiplex using primer and probe sets specific for CTNNB1/β-catenin and the housekeeping gene HPRT1 for normalization.

Cell growth was assayed three days after transfection, using the Promega Cell Titer Blue (CTB) reagent. Briefly, culture medium was replaced with fresh medium containing CTB reagent; after one hour, fluorescence at the appropriate wavelength was measured one a plate reader. Cell number values were graphed relative to Mock treatments.

Figure 6:
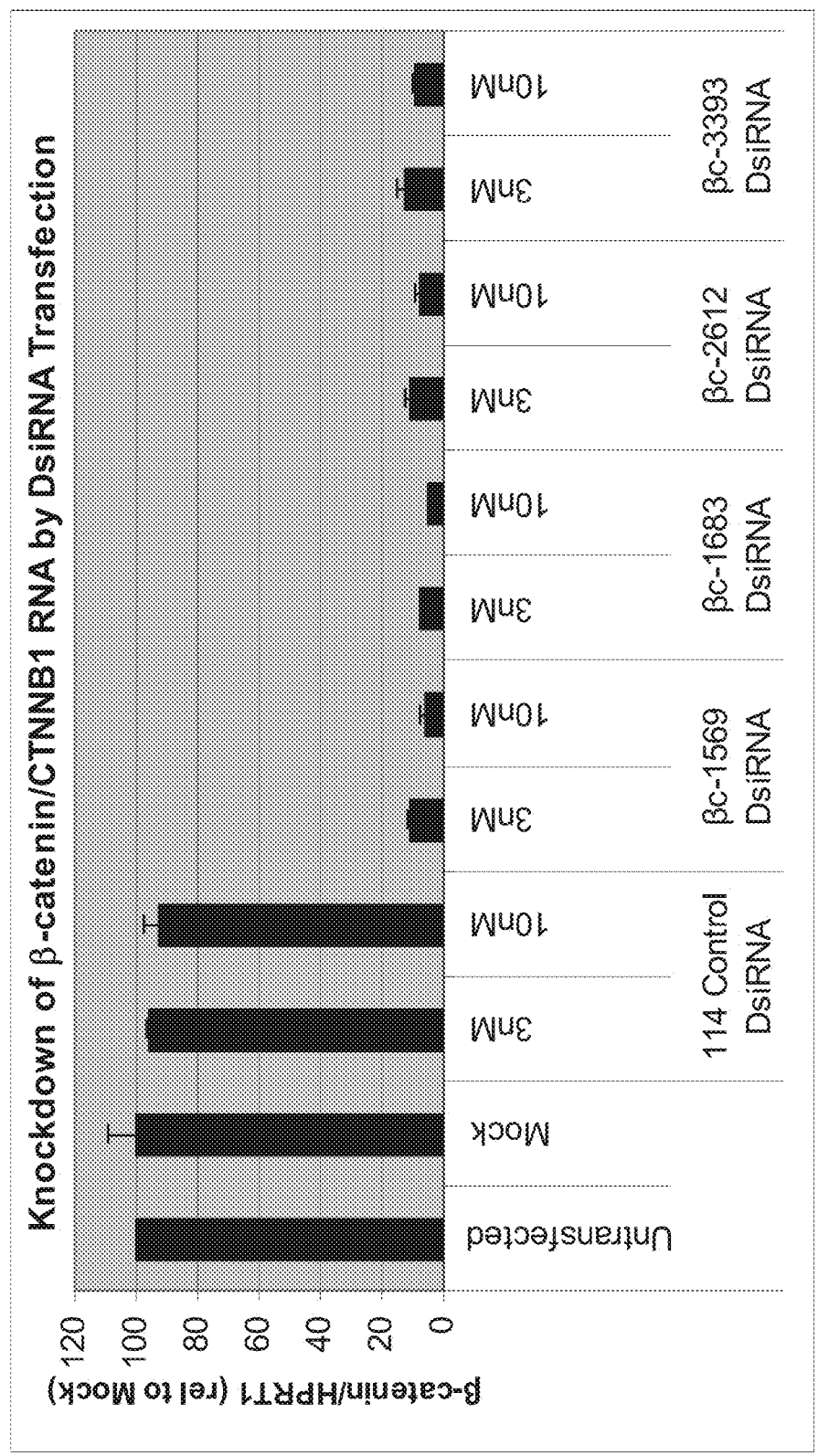
FIG. 6 shows that human β-catenin targeting DsiRNAs effectively reduced β-catenin RNA levels by 90% or more in human HCT116 colon carcinoma cells. HCT116 cells were transfected in vitro with indicated DsiRNAs at 3 nM or 10 nM, and cells were assayed for β-catenin RNA levels at a 24 hour timepoint.

To examine whether human β-catenin targeting DsiRNAs identified as effective at reducing β-catenin transcript levels in HeLa cells were also effective inhibitors of β-catenin in colon cancer cells, four DsiRNAs (βc-1569, βc-1683, βc-2612 and βc-3393) were transfected into colon carcinoma cell line HCT116. As shown in FIG. 6, βc-1569, βc-1683, βc-2612 and βc-3393 DsiRNAs dramatically (>80%) reduced human β-catenin transcript levels in colon carcinoma cell line HCT116 cells at both 3 nM and 10 nM concentrations in the environment of these cells.

Figure 7:
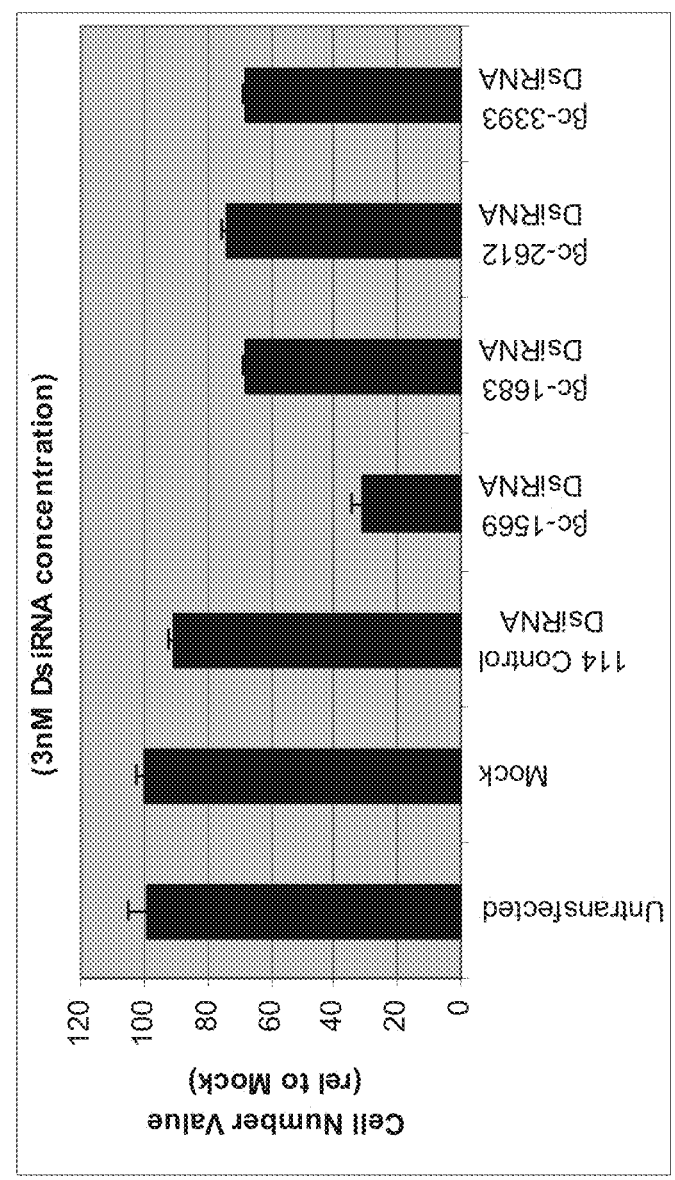
FIG. 7 shows that human β-catenin targeting DsiRNAs significantly inhibited growth of human HepG2 hepatocarcinoma cells. HepG2 cells were transfected in vitro with indicated DsiRNAs at 3 nM, and HepG2 cell lines were assayed for growth at a three day timepoint.
Figure 8:
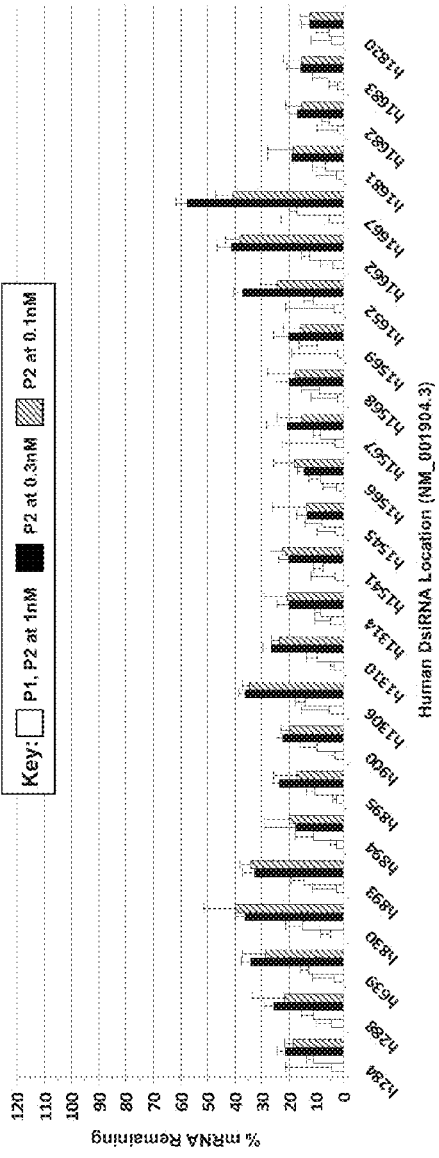
Figure 11:
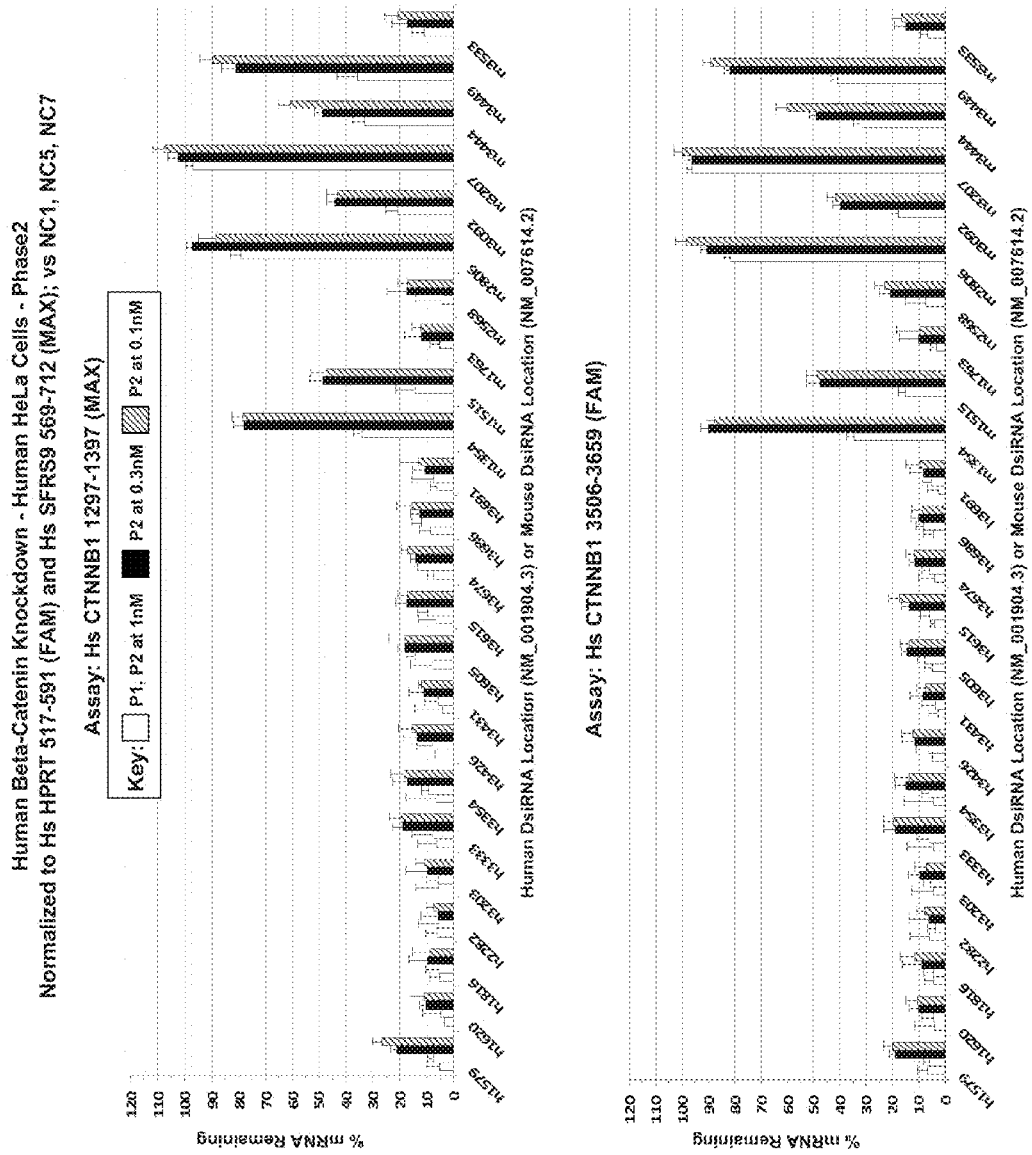
Figure 12:
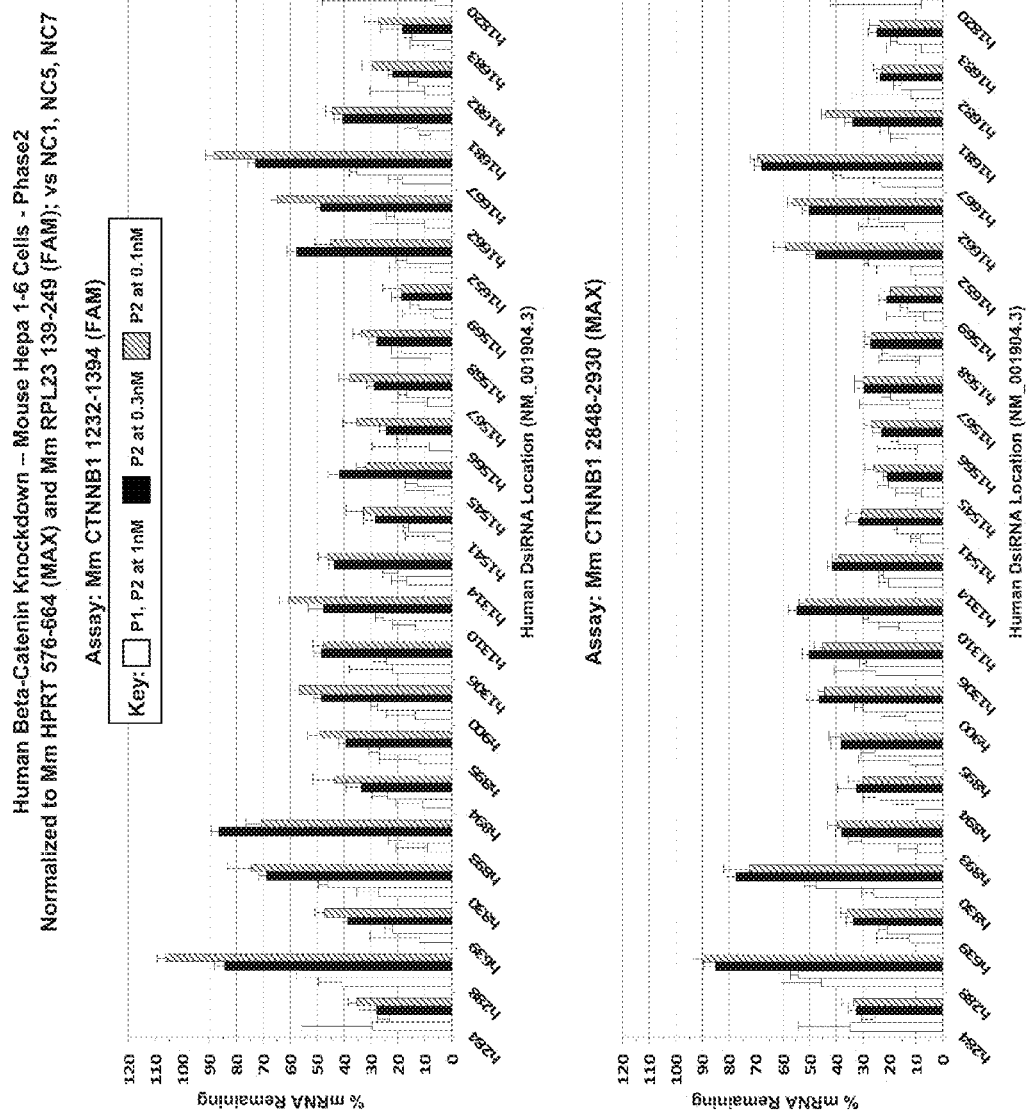
FIGS. 12-15 show histograms of mouse β-catenin inhibitory efficacies observed for indicated DsiRNAs. "P1" indicates phase 1, while "P2" indicates phase 2. In phase 1, DsiRNAs were tested at 1 nM in the environment of mouse Hepa 1-6 cells. In phase 2, DsiRNAs were tested at 1 nM, at 0.3 nM and at 0.1 nM in the environment of mouse Hepa 1-6 cells. Individual bars represent average human β-catenin levels observed in triplicate, with standard errors shown. Human β-catenin levels were normalized to HPRT and RPL23 levels. Expression levels were assayed with probe amplicons positioned at both positions 1232-1394 and 2848-2930 in Mm CTNNB1. (It is noted that the histograms of FIG. 13 reflect phase 2 values obtained for a subpar transfection.)
Figure 13:
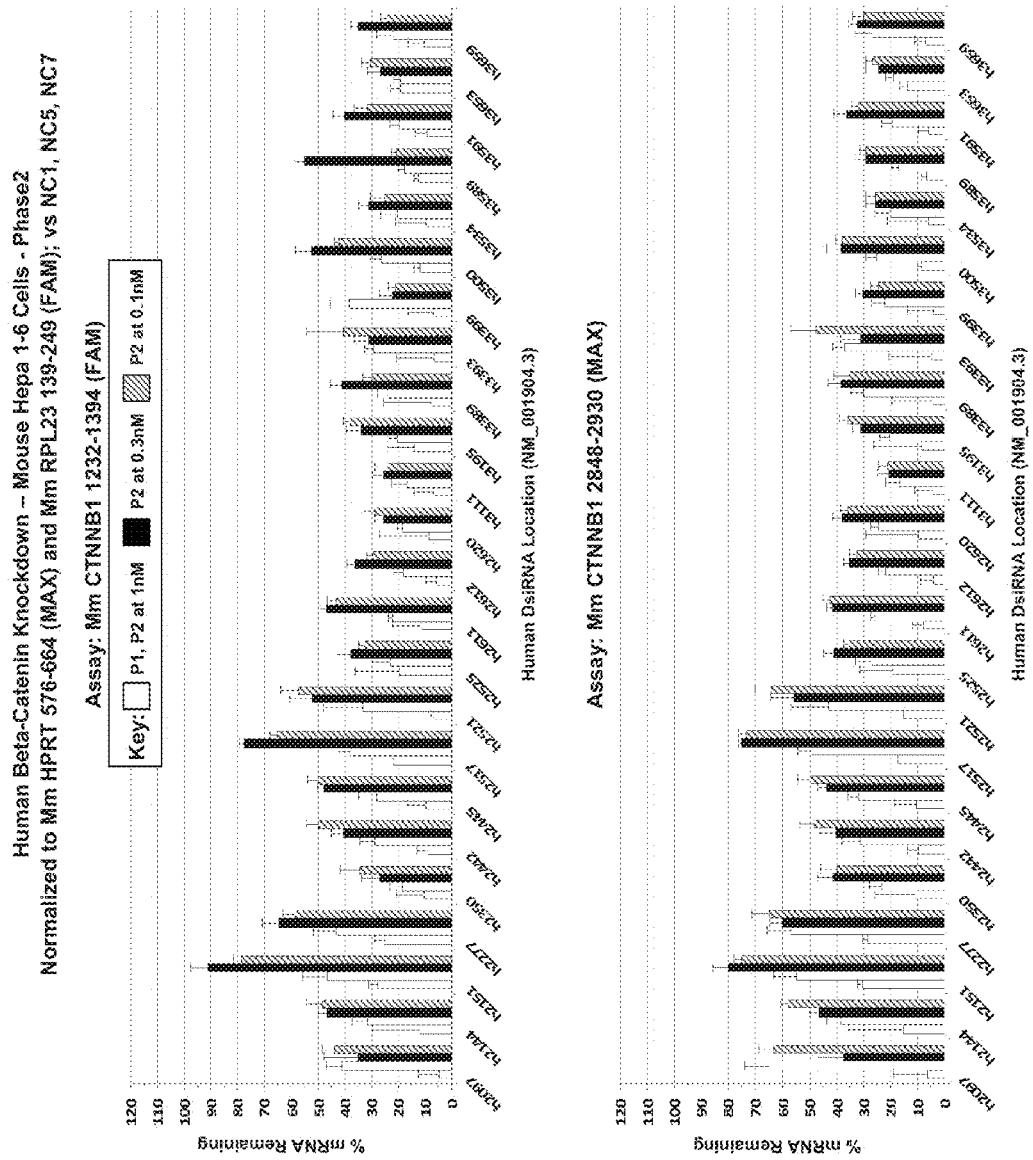
Figure 14:
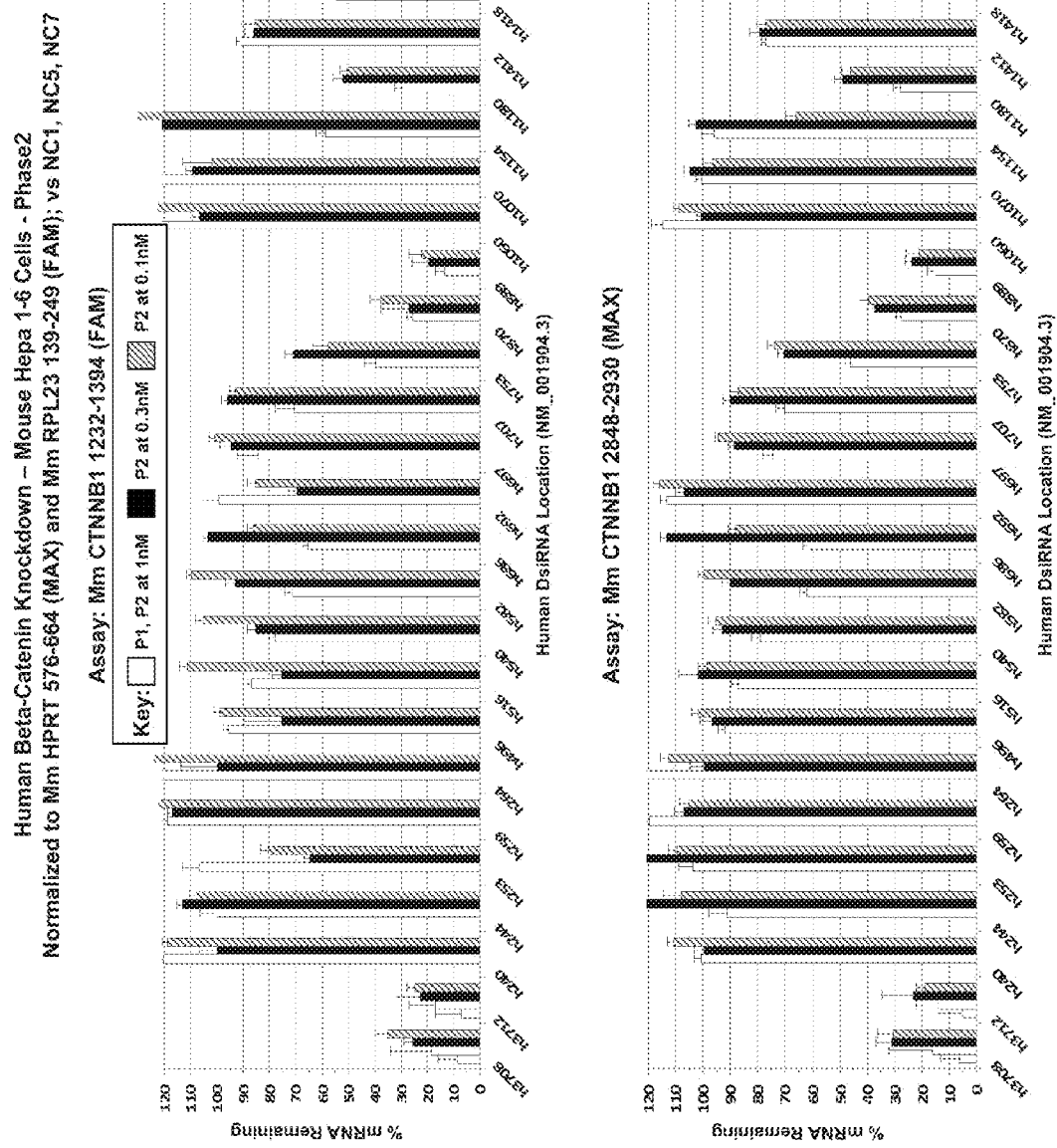
Figure 15:
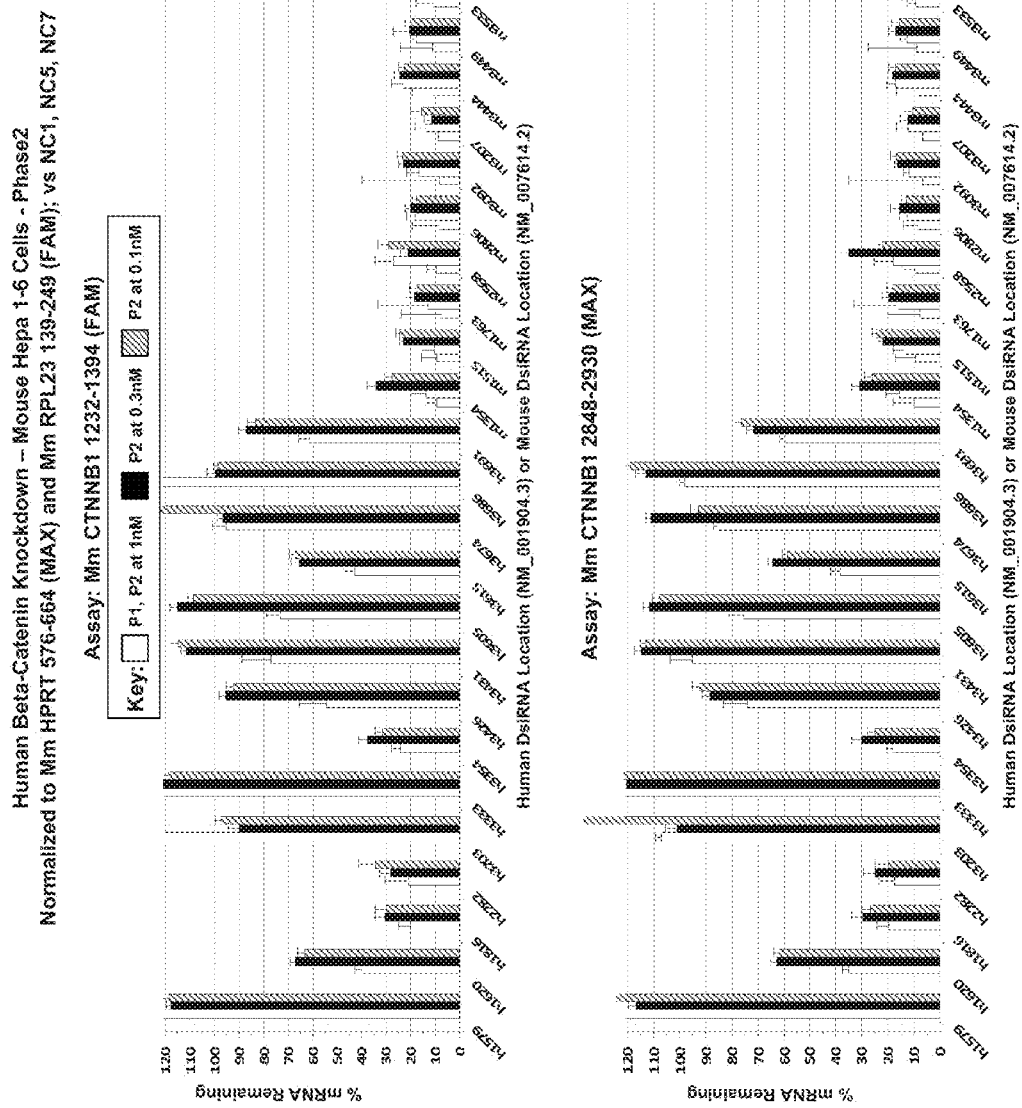

The effects of β-catenin targeting DsiRNAs βc-1569, βc-1683, βc-2612 and βc-3393 were also examined in hepatocarcinoma cell line HepG2, with the effect of DsiRNA treatment upon growth of the hepatocarcinoma cell line assessed. As shown in FIG. 7, following three days of incubation at 3 nM concentration in the environment of HepG2 cells, all four assayed β-catenin targeting DsiRNAs showed significant reduction in tumor cell number (relative to mock-treated and control DsiRNA-treated cells, approximately 30% to 60% or greater cell growth inhibition was observed at day 3 post-transfection). Notably, the β-catenin targeting βc-1569 DsiRNA exhibited approximately 70% reduction in tumor cell numbers, demonstrating the remarkable efficacy of this β-catenin targeting DsiRNA upon a phenotype of therapeutic significance.

Example 4

DsiRNA Inhibition of β-Catenin—Secondary Screen 96 asymmetric DsiRNAs of the above experiment are examined in a secondary assay ("Phase 2"). Specifically, 96 asymmetric DsiRNAs (e.g., βc-284, βc-288, βc-639, βc-830, βc-893, βc-894, βc-895, βc-900, βc-1306, βc-1310, βc-1314, βc-1541, βc-1545, βc-1566, βc-1567, βc-1568, βc-1569, βc-1652, βc-1662, βc-1667, βc-1681, βc-1682, βc-1683, βc-1820, βc-2097, βc-2144, βc-2151, βc-2277, βc-2350, βc-2442, βc-2445, βc-2517, βc-2521, βc-2525, βc-2611, βc-2612, βc-2620, βc-3111, βc-3195, βc-3389, βc-3393, βc-3399, βc-3500, βc-3534, βc-3589, βc-3591, βc-3653, βc-3659, βc-3708, βc-3712, βc-240, βc-244, βc-253, βc-259, βc-264, βc-496, βc-516, βc-540, βc-582, βc-686, βc-692, βc-697, βc-707, βc-753, βc-870, βc-889, βc-1060, βc-1070, βc-1154, βc-1180, βc-1412, βc-1418, βc-1579, βc-1620, βc-1816, βc-2282, βc-3203, βc-3333, βc-3354, βc-3426, βc-3431, βc-3605, βc-3615, βc-3674, βc-3686, βc-3691, βc-m1354, βc-m1515, βc-m1763, βc-m2568, βc-m2806, βc-m3092, βc-m3207, βc-m3444, βc-m3449 and βc-m3533) were assessed for inhibition of human β-catenin at 1 nM, 0.3 nM and 0.1 nM in the environment of human HeLa cells. These 96 asymmetric DsiRNAs are also assessed for inhibition of mouse β-catenin at 1 nM, 0.3 nM and 0.1 nM in the environment of mouse Hepa 1-6 cells. As shown in FIGS. 8-11, a remarkable number of asymmetric DsiRNAs reproducibly exhibited robust human β-catenin inhibitory efficacies at sub-nanomolar concentrations when assayed in the environment of HeLa cells. In addition, as shown in FIGS. 12-15, a number of these asymmetric DsiRNAs also showed robust mouse HIF-1α inhibitory efficacies at 1 nM, 300 pM and 100 pM when assayed in the environment of mouse Hepa 1-6 cells. (Meanwhile, both human β-catenin-specific and mouse (β-catenin-specific inhibitory asymmetric DsiRNAs were also identified.)

While $IC_{50}$ values were not formally calculated during secondary screening, it is clear from FIGS. 8-11 that sub-nanomolar (and, indeed, sub-100 pM) $IC_{50}$ values were observed for the vast majority of DsiRNAs. Thus, β-catenin-targeting DsiRNAs were demonstrated to be remarkably potent and effective inhibitors of β-catenin expression.

Example 5

Modified Forms of β-Catenin-Targeting DsiRNAs Reduce p-Catenin Levels In Vitro

Figure 16:
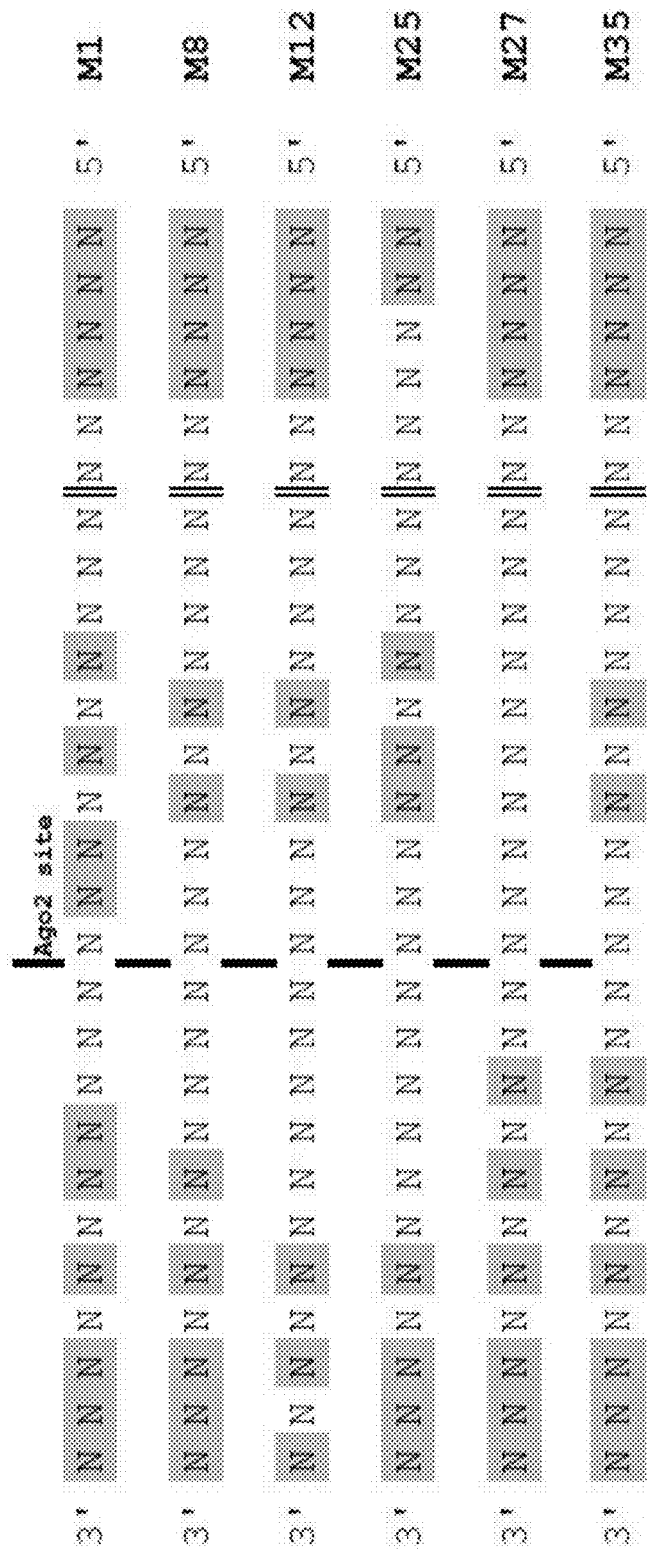
FIG. 16 shows antisense (guide) strand 2'-O-methyl modification patterns employed in phase 3 assays.
Figure 17:
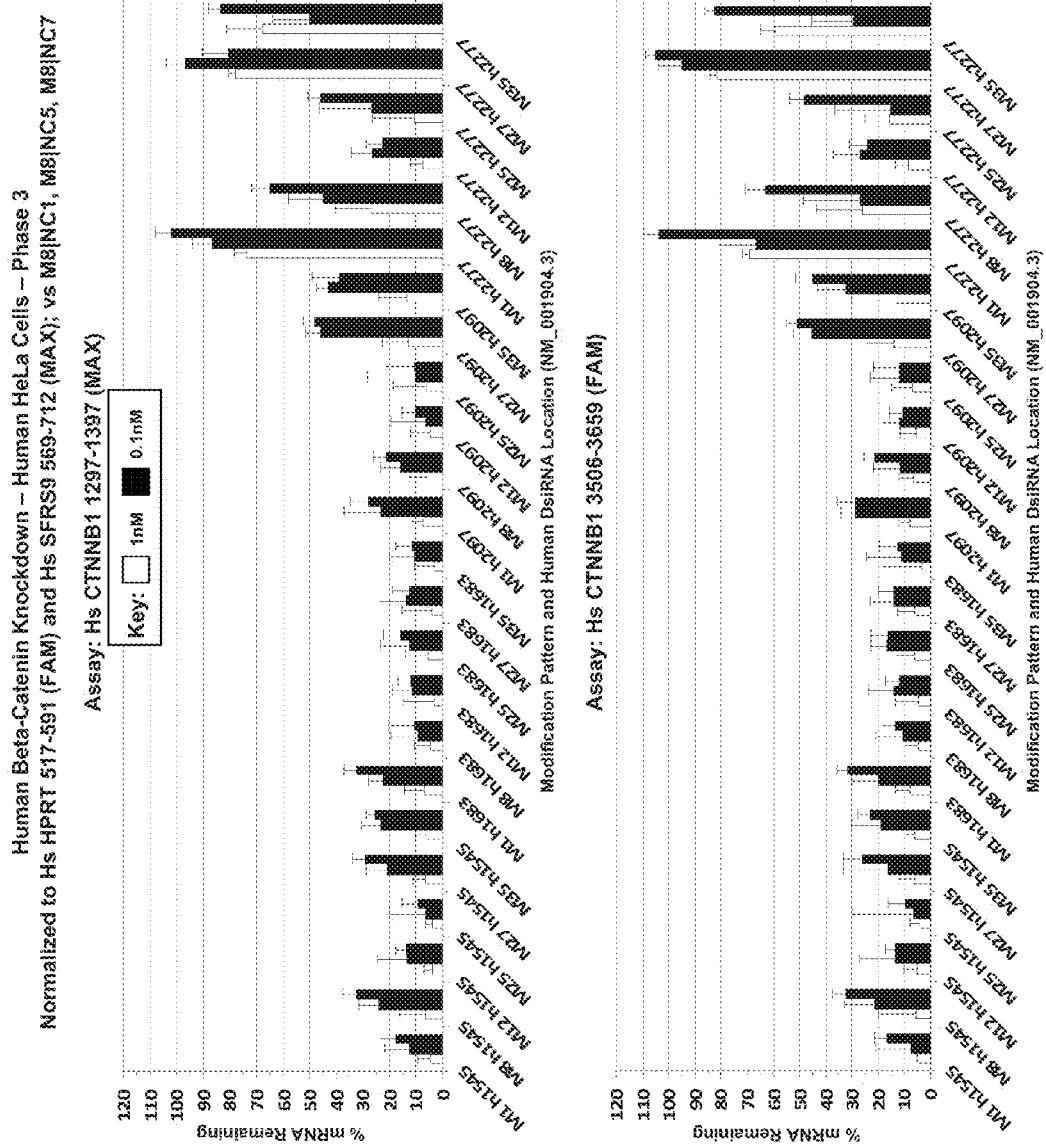
FIGS. 17-24 present histograms showing phase 3 efficacy data for six different guide strand modification patterns each across 32 β-catenin-targeting DsiRNAs in human HeLa cells at 0.1 nM (parallel assays) and 1 nM. Expression levels were assayed with probe amplicons positioned at both positions 1297-1397 and 3506-3659 in Hs CTNNB1, with human β-catenin levels normalized to HPRT and SFRS9 levels.
Figure 18:
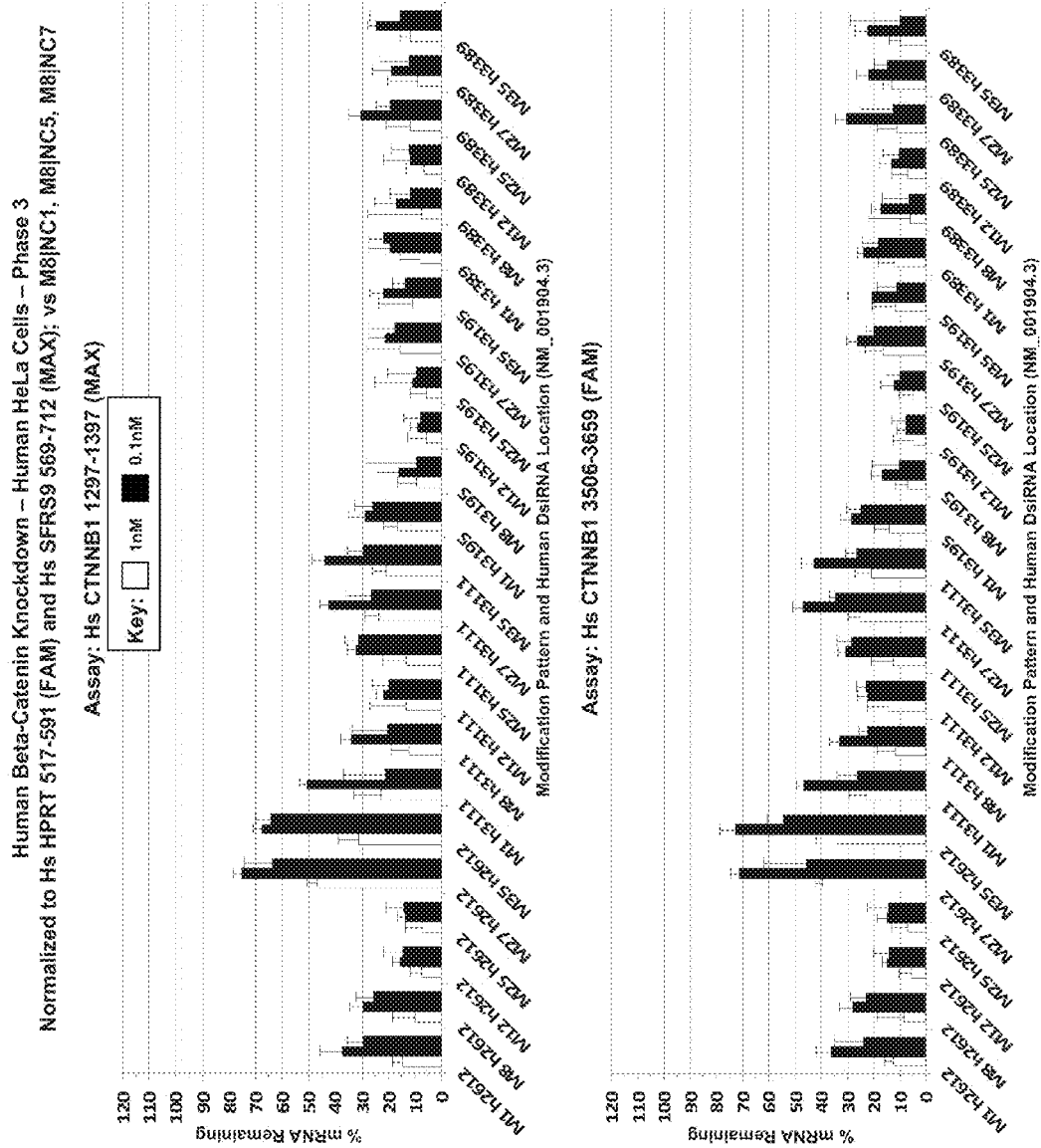
Figure 19:
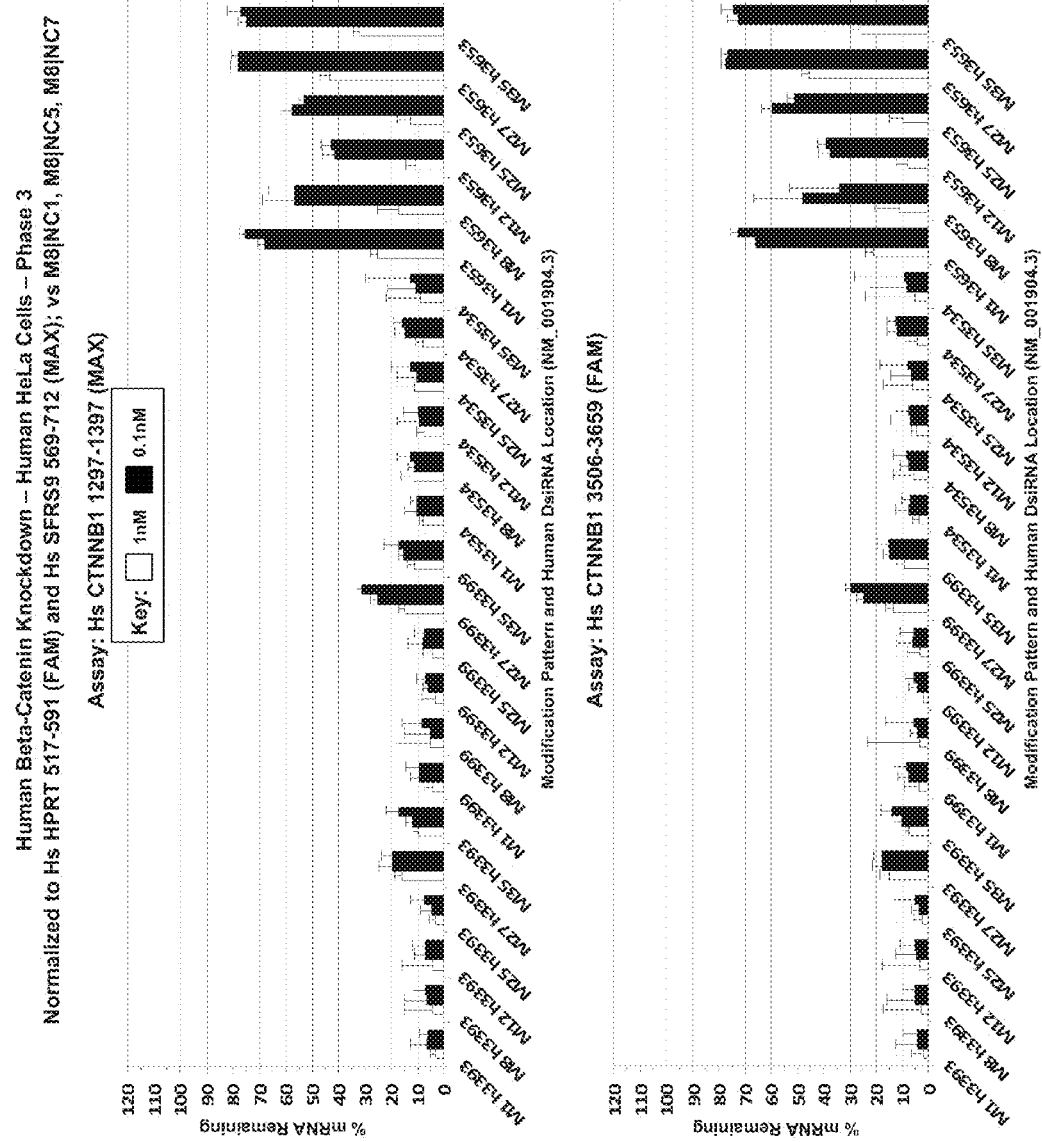
Figure 20:
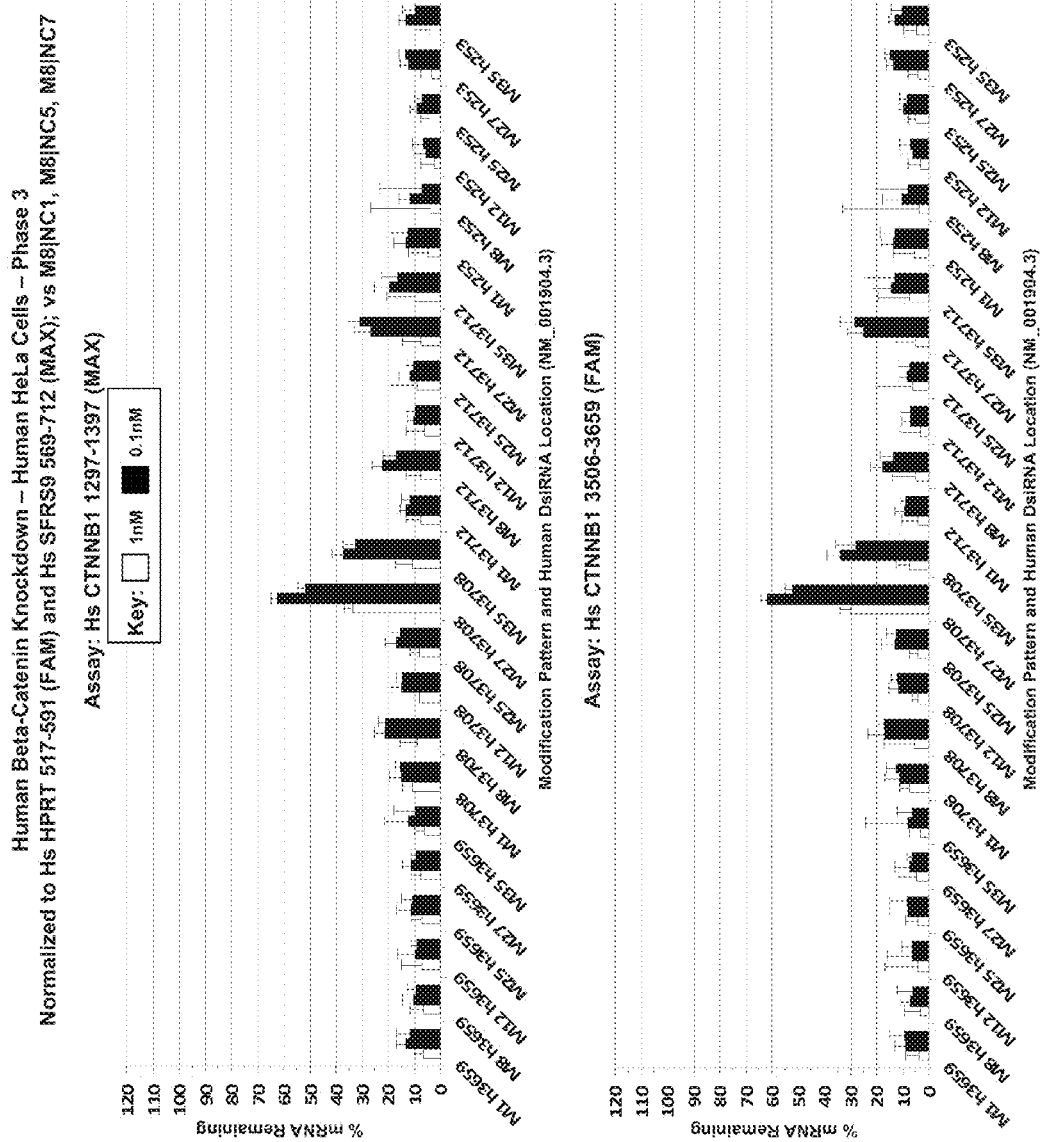
Figure 21:
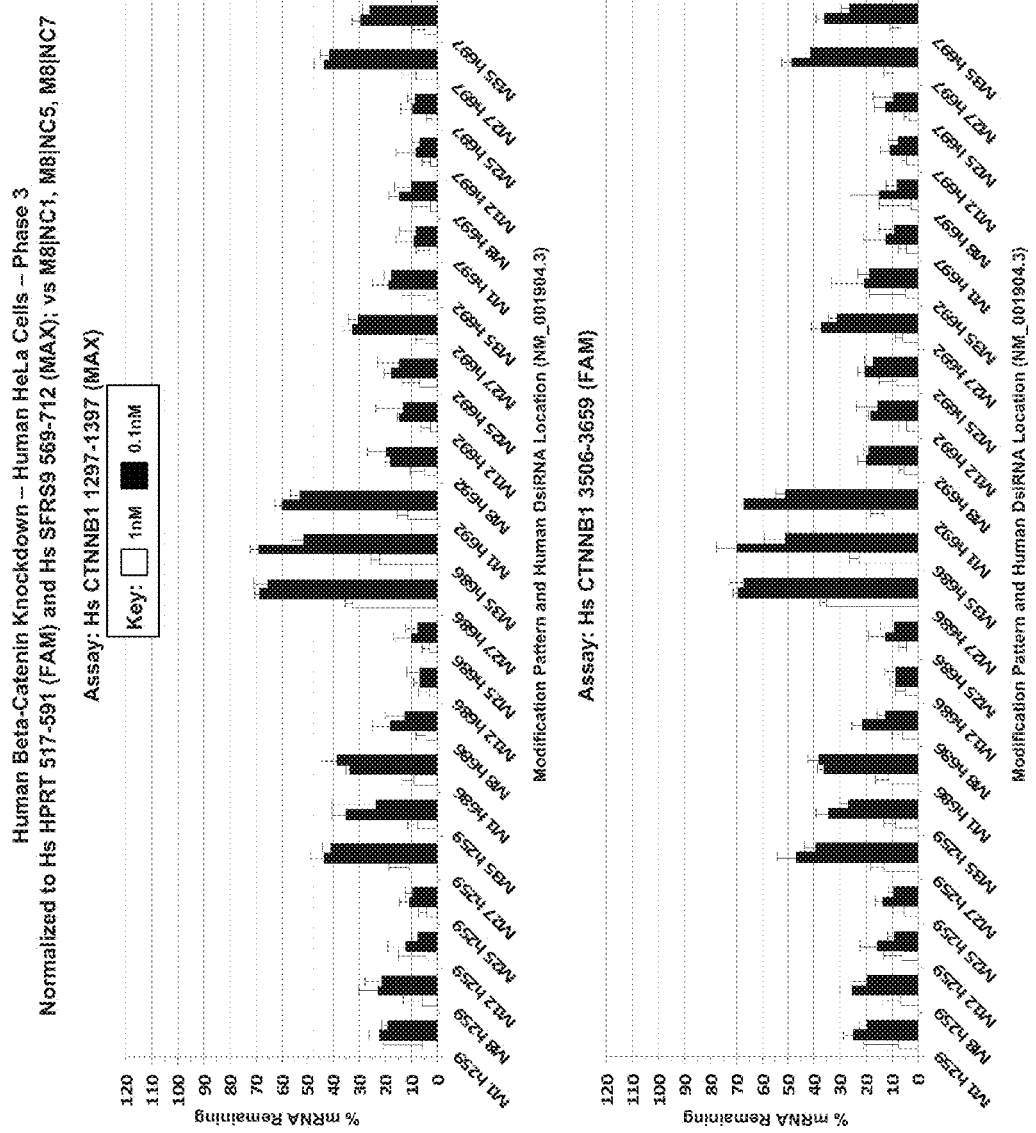
Figure 22:
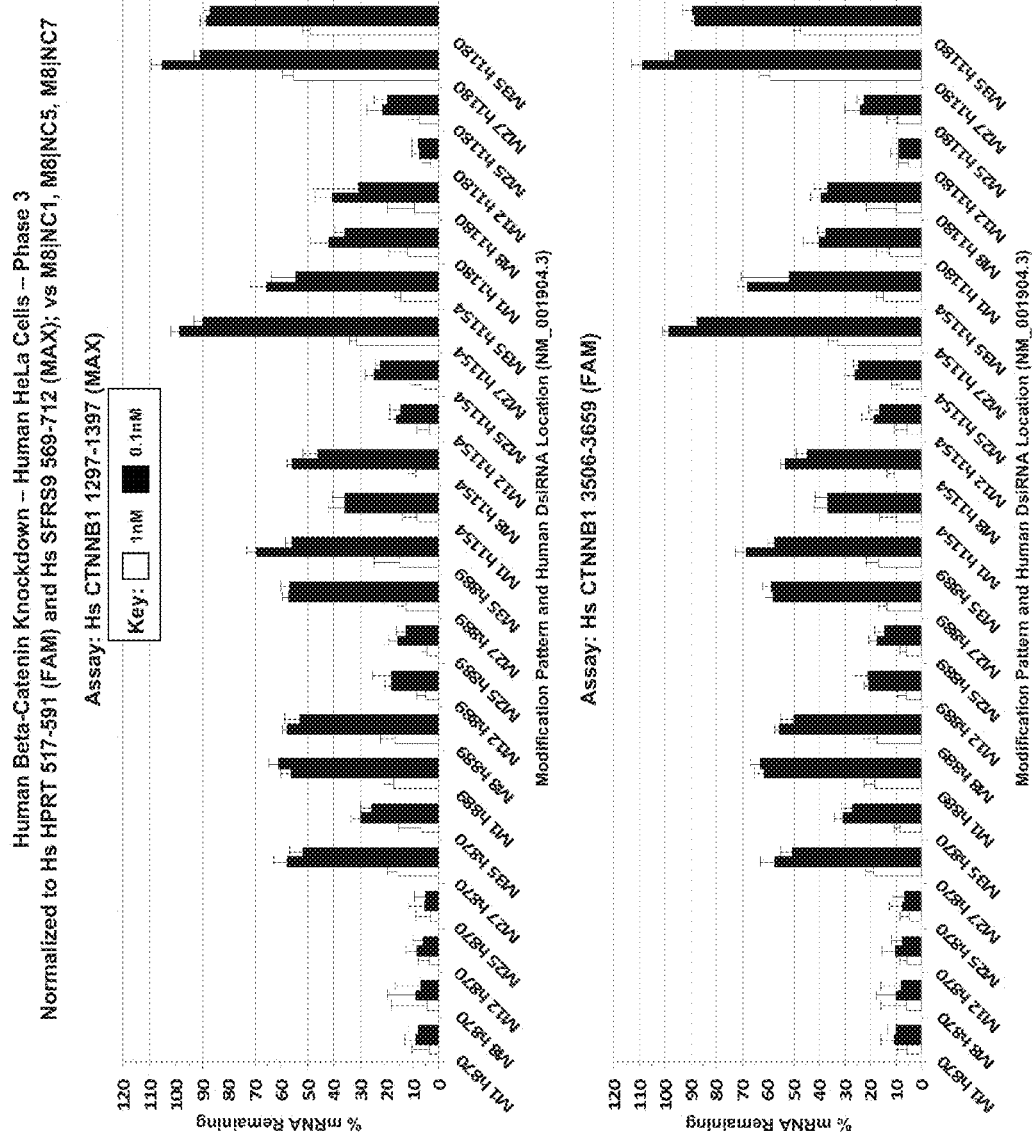
Figure 23:
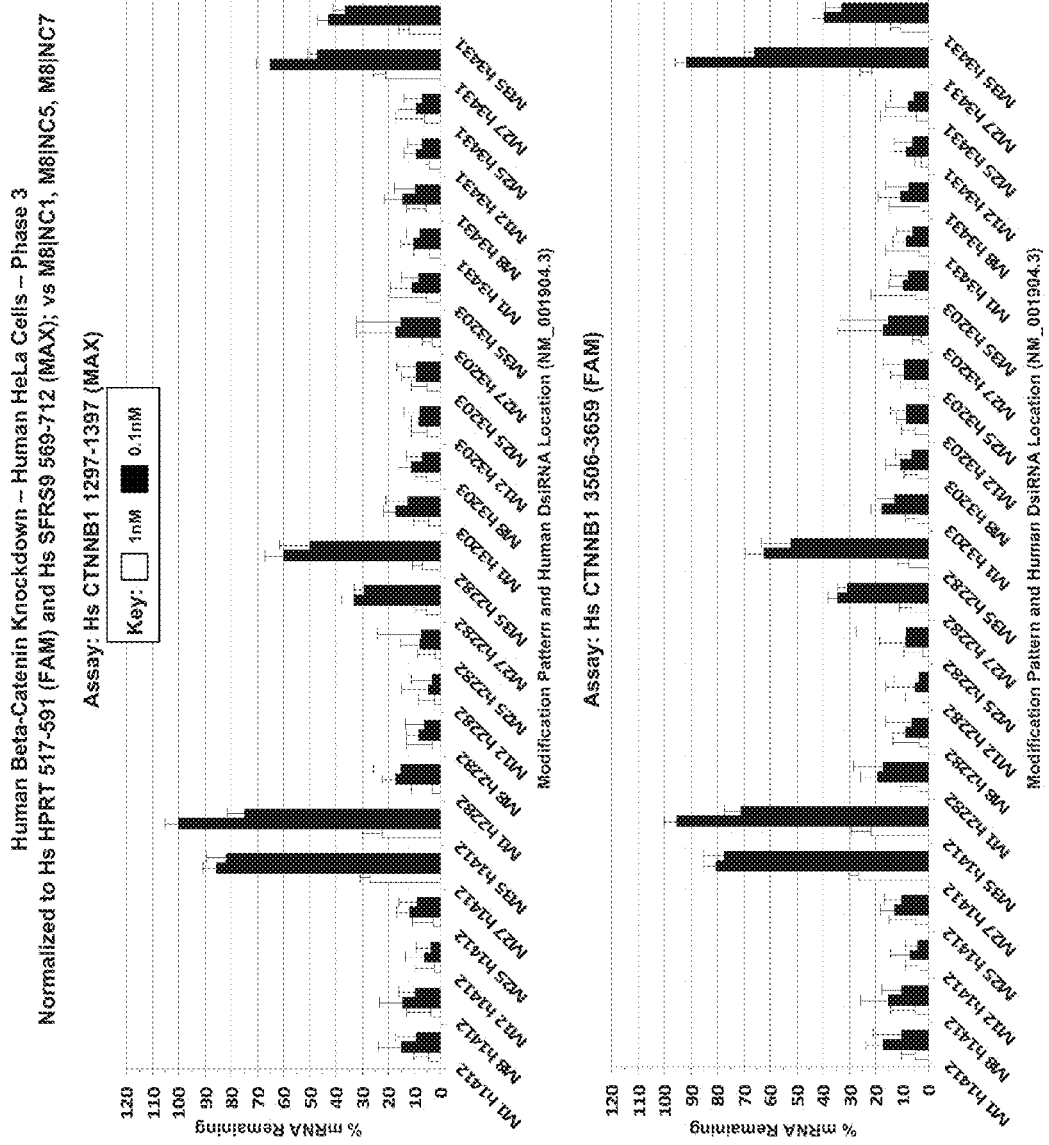
Figure 24:
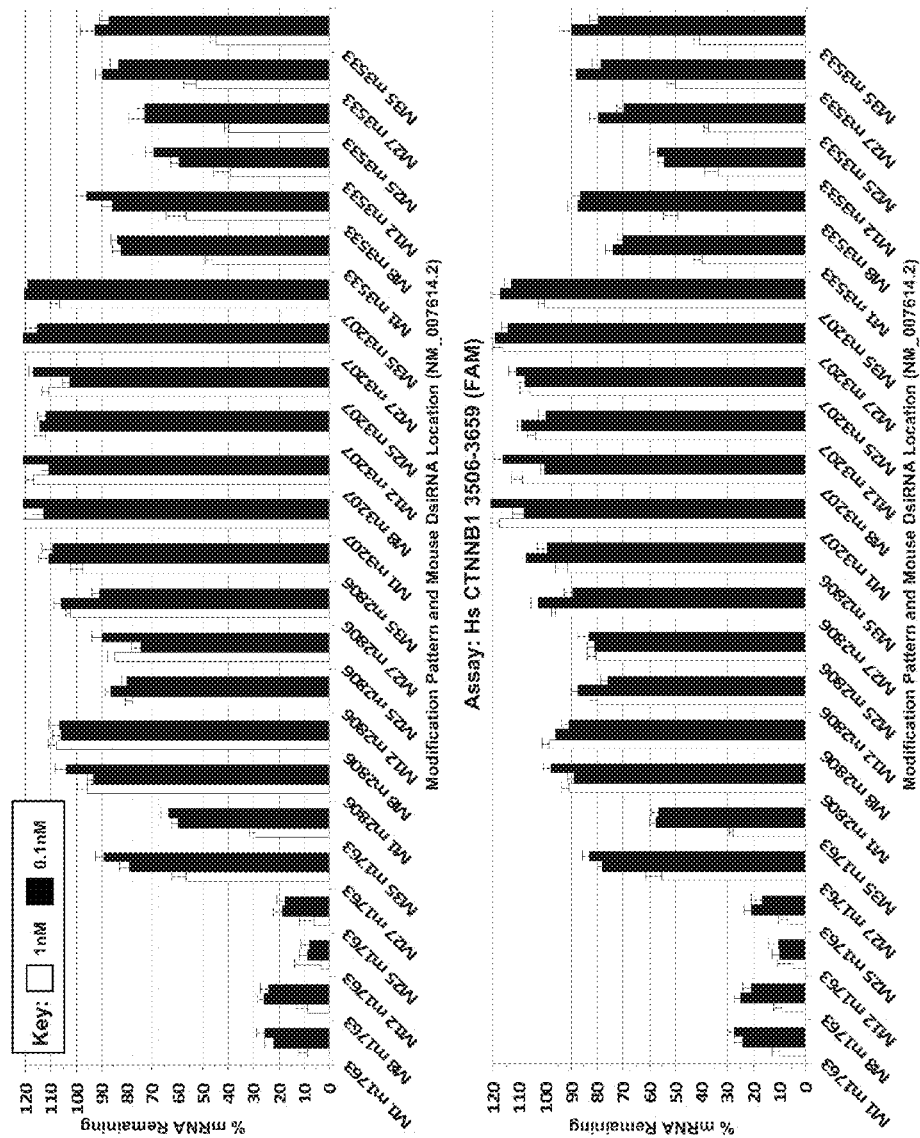

32 β-catenin-targeting DsiRNAs (βc-1545, βc-1683, βc-2097, βc-2277, βc-2612, βc-3111, βc-3195, βc-3389, βc-3393, βc-3399, βc-3534, βc-3653, βc-3659, βc-3708, βc-3712, βc-253, βc-259, βc-686, βc-692, βc-697, βc-870, βc-889, βc-1154, βc-1180, βc-1412, βc-2282, βc-3203, βc-3431, βc-m1763, βc-m2806, βc-m3207 and βc-m3533) were prepared with 2'-O-methyl modification patterns as shown in schematic of FIG. 16. For each of the 32 DsiRNA sequences, DsiRNAs possessing each of the six antisense (guide) strand modification patterns were assayed for β-catenin inhibition in human HeLa cells at 0.1 nM (in parallel assays) and 1.0 nM concentrations in the environment of the HeLa cells. Results of these experiments are presented as histograms in FIGS. 17 to 24. In general, the 32 DsiRNA sequences exhibited a trend towards somewhat reduced efficacy of β-catenin inhibition as the extent of 2'-O-methyl modification of the guide strand increased. However, for almost all DsiRNA sequences examined, a modification pattern could be identified that allowed the DsiRNA to retain significant β-catenin inhibitory efficacy in vitro. It was also notable that many DsiRNAs (e.g., βc-1545, βc-1683, βc-3195, βc-3389, βc-3393, βc-3399, βc-3534, βc-3659, βc-3712, βc-253 and β-3203) exhibited robust β-catenin inhibitory efficacy in even the most highly modified states examined. These data confirm that it is possible to identify highly effective β-catenin inhibitory DsiRNAs that are robustly tolerant to modification, such that levels of modification sufficient to stabilize such DsiRNAs and/or reduce immunogenicity of such DsiRNAs when therapeutically administered to a subject in vivo can be applied to these DsiRNAs.

In certain embodiments, the invention provides a DsiRNA selected from among one or more of the following:

TABLE 18

Select β-Catenin-Targeting DsiRNAs

| DsiRNA Name | 27 nt Target Sequence | 21 nt Target Sequence |
| --- | --- | --- |
| βc-496 | SEQ ID NO: 2231 | SEQ ID NO: 4449 |
| βc-540 | SEQ ID NO: 2235 | SEQ ID NO: 4453 |
| βc-639 | SEQ ID NO: 2325 | SEQ ID NO: 4543 |
| βc-900 | SEQ ID NO: 2348 | SEQ ID NO: 4566 |
| βc-1545 | SEQ ID NO: 2391 | SEQ ID NO: 4609 |

TABLE 18-continued

Select β-Catenin-Targeting DsiRNAs

| DsiRNA Name | 27 nt Target Sequence | 21 nt Target Sequence |
|---|---|---|
| βc-2151 | SEQ ID NO: 2477 | SEQ ID NO: 4695 |
| βc-3203 | SEQ ID NO: 2274 | SEQ ID NO: 4492 |
| βc-3399 | SEQ ID NO: 2618 | SEQ ID NO: 4836 |
| βc-3591 | SEQ ID NO: 2645 | SEQ ID NO: 4863 |
| βc-3708 | SEQ ID NO: 2661 | SEQ ID NO: 4879 |

Among the DsiRNAs of Table 18 that were tested in the above-described modified DsiRNA assays, βc-1545, βc-3203 and βc-3399 were shown to be robustly effective DsiRNA sequences even when modified (and βc-1545 and βc-3399 were observed to be highly effective inhibitors of β-catenin under all modification conditions examined).

Example 6

β-Catenin-Targeting DsiRNAs Reduced Axin-2 Levels In Vitro

Figure 26:
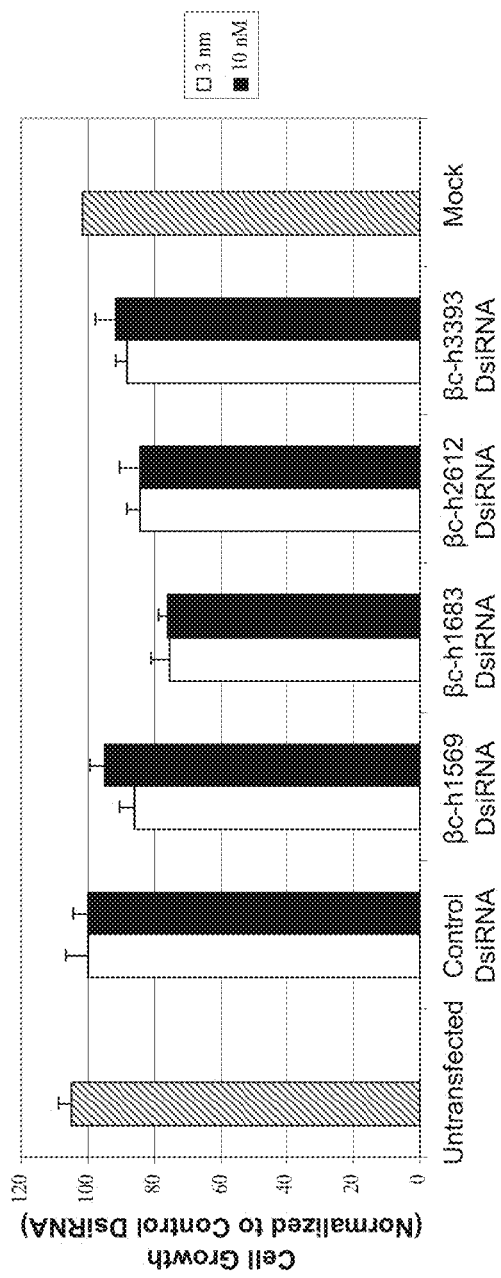
FIG. 26 shows that transfection of human colorectal cancer cell line HCT116 cells with certain DsiRNAs targeting human β-catenin (βc-h1683, βc-h2612 and βc-h3393) inhibited the growth of such cells at five days post-transfection, as compared to cells administered a control DsiRNA. Cell growth inhibition was assayed using a CellTiter-Blue® Cell Viability Assay (Promega) at five days post-transfection.

The impact of β-catenin-targeting DsiRNAs upon Axin-2, a known downstream target of β-catenin was examined in both HCT116 (colon carcinoma) and HepG2 (hepatocellular carcinoma) cell lines. As shown in FIG. 26, βcat-h1569, βcat-h1683, βcat-h2612 and βcat-h3393 were all robust inhibitors of Axin-2, with approximately 80%-90% knockdown observed for each of these DsiRNAs in both cell lines. Cells were assayed at two days post-transfection at indicated concentrations (3 nM and 10 nM) with designated DsiRNAs. Thus, the effect of β-catenin knockdown was also observed in the mRNA levels of the downstream target of β-catenin, Axin-2.

Example 7

β-Catenin Targeting DsiRNAs Inhibited Tumor Cell Growth in Colorectal and Hepatocellular Carcinoma Cell Lines As described above, FIG. 7 shows the growth inhibitory impact of β-catenin-targeting DsiRNAs upon HepG2 hepatocellular carcinoma cells. To identify whether such cell growth inhibitory effects could also be observed in other cancer cell lines, the impact of β-catenin-targeting DsiRNAs upon growth of both HCT116 (colorectal carcinoma) and HuH7 (hepatocellular carcinoma) cell lines was also examined. As shown in FIG. 26, transfection of human colorectal cancer cell line HCT116 cells with certain DsiRNAs targeting human β-catenin (βc-1683, βc-2612 and β-3393) inhibited the growth of such cells at five days post-transfection, as compared to cells administered a control DsiRNA. Cell growth inhibition was assayed using a CellTiter-Blue® Cell Viability Assay (Promega) at five days post-transfection.

Figure 27:
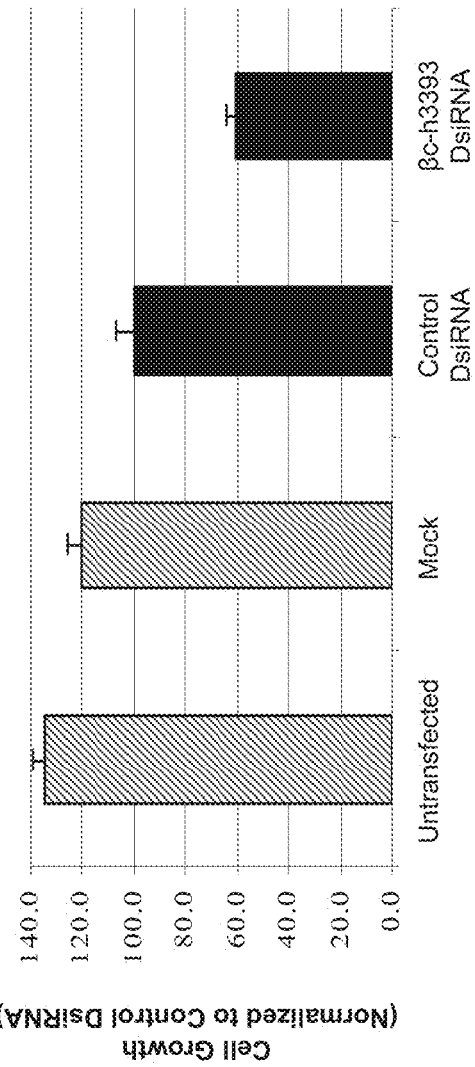
FIG. 27 shows that transfection of human hepatocellular carcinoma cell line HuH7 cells with a DsiRNA targeting human β-catenin inhibited the growth of such cells at five days post-transfection, as compared to cells administered a control DsiRNA. Cell growth inhibition was assayed using a CellTiter-Blue® Cell Viability Assay (Promega) at five days post-transfection.

More robust inhibition of cancer cell line growth was observed following administration of βc-3393 DsiRNA to human hepatocellular carcinoma cell line HuH7 cells (FIG. 27). At five days post-transfection, approximately 40% inhibition of HuH7 cell growth was observed, as compared to cells administered a control DsiRNA. Cell growth inhibition was assayed using a CellTiter-Blue® Cell Viability Assay (Promega) at five days post-transfection. Thus, the cancer cell line growth inhibitory effect of β-catenin-targeting DsiRNAs was observed to be generalizable across at least three distinct cell lines (and was surprisingly robust in the two distinct hepatocellular carcinoma cell lines examined, HepG2 and HuH7).

Figure 28:
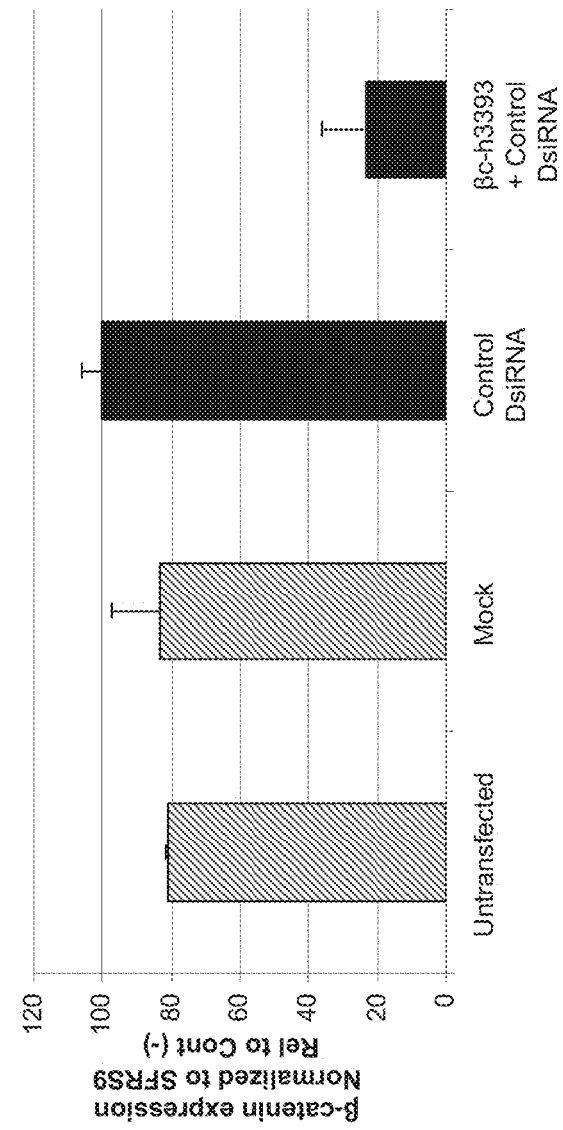
FIG. 28 shows that transfection of human hepatocellular carcinoma cell line HuH7 cells with a DsiRNA targeting human β-catenin (specifically, a βc-h3393 25/27mer possessing an "M11" modified antisense (guide) strand consisting of 2'-O-methyl modifications at the following positions starting from the 5'-terminus (position 1) of the antisense strand: 1, 2, 3, 4, 11, 13, 25 and 27) produced knockdown of β-catenin levels of approximately 80% at two days post-transfection, when administered with a control DsiRNA, as compared to cells administered only the control DsiRNA.

As shown in FIG. 28, transfection of human hepatocellular carcinoma cell line HuH7 cells with a DsiRNA targeting human β-catenin (specifically, a βc-3393 25/27mer possessing an "M11" modified antisense (guide) strand consisting of 2'-O-methyl modifications at the following positions starting from the 5'-terminus (position 1) of the antisense strand: 1, 2, 3, 4, 11, 13, 25 and 27) produced knockdown of β-catenin mRNA levels of approximately 80% at two days post-transfection, when administered with a control DsiRNA, as compared to cells administered only the control DsiRNA. Thus, β-catenin-targeting DsiRNAs were potent inhibitors of both β-catenin expression levels and of cell growth in hepatocellular carcinoma cell lines HepG2 and HuH7.

Figure 29:
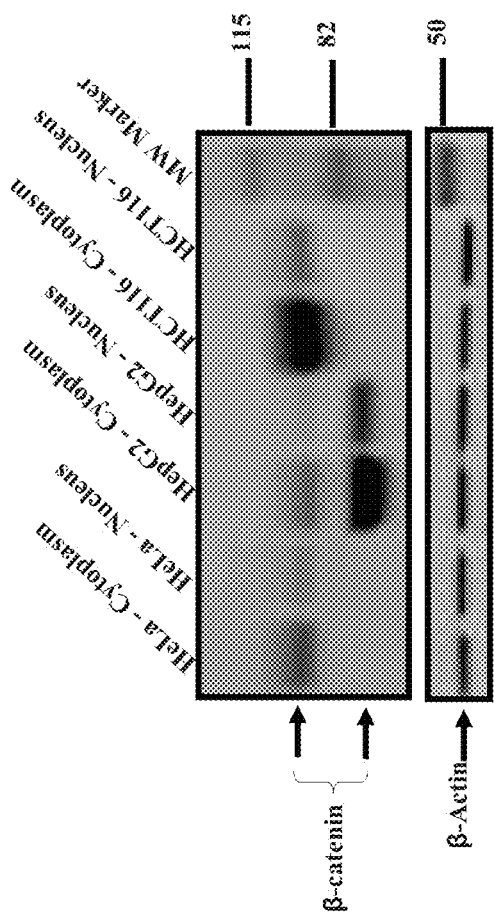
FIG. 29 shows fractionated human β-catenin protein levels found in HeLa (cervical cancer), HepG2 (hepatocellular liver carcinoma) and HCT116 (colorectal carcinoma) cell lines. Nuclear and cytoplasmic levels of β-catenin were identified for each cell line via Western blot, with β-actin levels assayed as an internal control. Cell extracts were obtained from confluent six well pates, using a NE-PER Nuclear and Cytoplasmic Extraction Reagents Kit (Thermo Fisher Scientific Inc). 75 ug of protein was loaded from each cell line. A known truncation mutant form of β-catenin protein was observed in HepG2 cells.

The expression of β-Catenin in human HeLa, HepG2 and HCT116 carcinoma cell lines was confirmed in vitro, with subcellular distribution of expressed β-Catenin protein also examined. Nuclear and cytoplasmic levels of β-catenin were identified for each cell line via Western blot (FIG. 29), with β-actin levels assayed as an internal control. Cell extracts were obtained from confluent six well pates, using a NE-PER Nuclear and Cytoplasmic Extraction Reagents Kit (Thermo Fisher Scientific Inc). 75 ug of protein was loaded from each cell line. HeLa (cervical cancer), HepG2 (hepatocellular liver carcinoma) and HCT116 (colorectal carcinoma) cell lines each expressed β-Catenin protein at robust levels, with β-Catenin protein primarily found in the cytoplasm of each cell type (though significant nuclear fractions were also observed for each cell type). Notably, a known truncation mutant form of β-catenin protein was observed in HepG2 cells.

Example 8

β-Catenin-Targeting DsiRNAs Reduced p-Catenin mRNA and Protein Levels In Vivo

Figure 30:
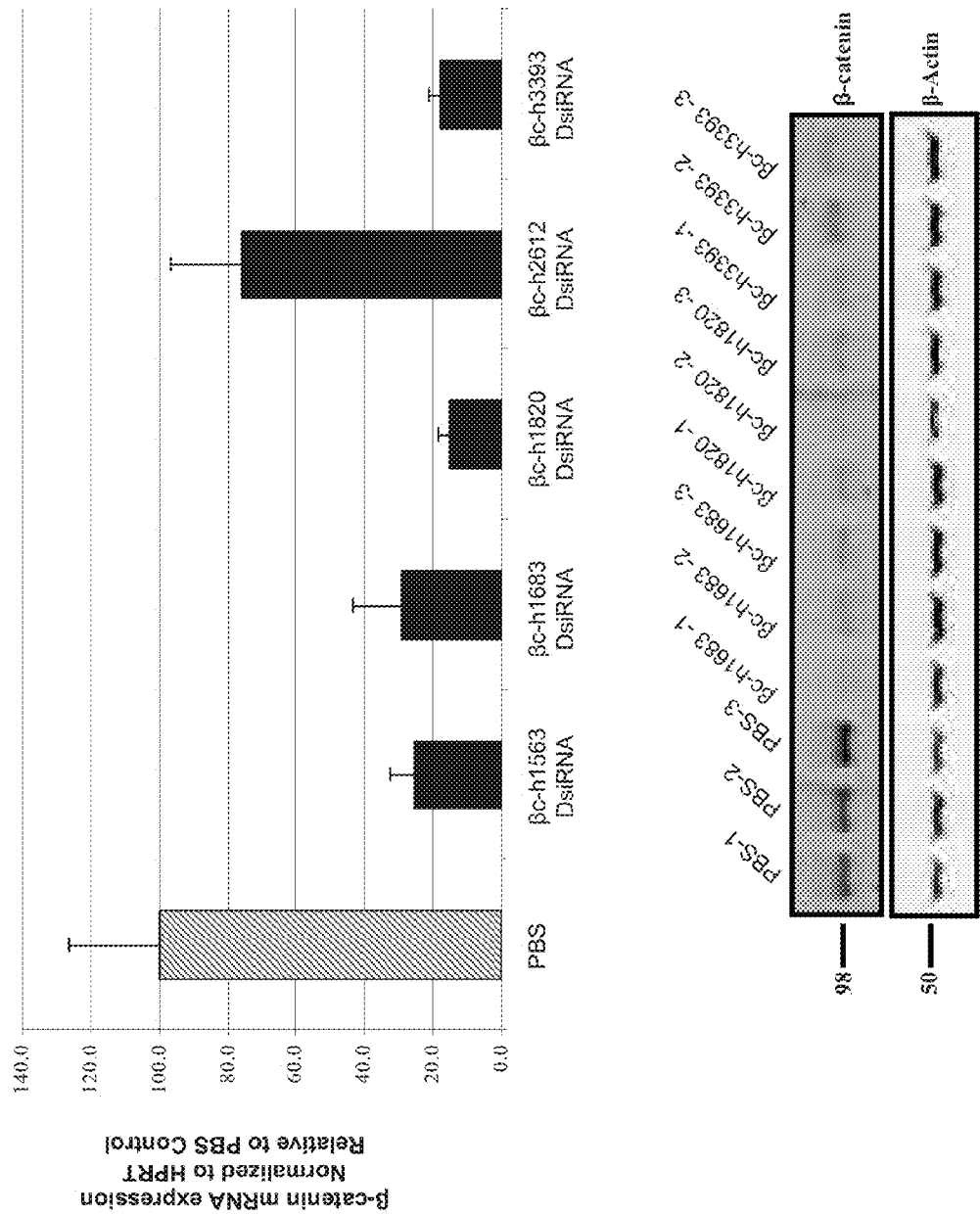
FIG. 30 demonstrates that DsiRNAs targeting human β-catenin were active in vivo in normal mouse liver, inhibiting both β-catenin mRNA (top panel) and protein (bottom panel) levels significantly (e.g., in many instances, approximately 70-90% knockdown was observed) when administered as a single dose intravenously to normal mice (n=5 mice per group) at 10 mg/kg and formulated in Invivofectamine® 2.0 (Invitrogen™, Carlsbad, Calif.). Liver tissue was harvested at 72 hours post-administration. All DsiRNAs targeting human β-catenin possessed "M11" modified antisense (guide) strands.

The Impact of β-Catenin-Targeting DsiRNAs Upon β-Catenin Expression Levels was examined in vivo. Specifically, human β-catenin-targeting DsiRNAs βc-1683, βc-1820 and βc-3393 (previously noted as also being active inhibitors of mouse (3-Catenin) were demonstrated to be remarkably effective inhibitors of mouse β-catenin expression in vivo in normal mouse liver, inhibiting both β-catenin mRNA (FIG. 30, top panel) and protein (FIG. 30, bottom panel) levels significantly (e.g., for these DsiRNAs, approximately 70-90% knockdown was observed) when administered as a single dose intravenously to normal mice (n=5 mice per group) at 10 mg/kg and formulated in Invivofectamine® 2.0 (Invitrogen™, Carlsbad, Calif.). In such experiments, liver tissue was harvested at 72 hours post-administration. All DsiRNAs targeting β-catenin possessed "M11" modified antisense (guide) strands. Notably, βc-1563 also exhibited robust inhibition of β-catenin mRNA levels in vivo; however, corresponding β-catenin protein levels were not assessed for this DsiRNA. Meanwhile, βc-2612 was also observed to inhibit β-catenin mRNA levels, even if not to the extent observed for βc-1563, βc-1683, βc-1820 and βc-3393, or to the extent observed for certain modified forms of βc-2612 in additional experiments described below.

Figure 31:
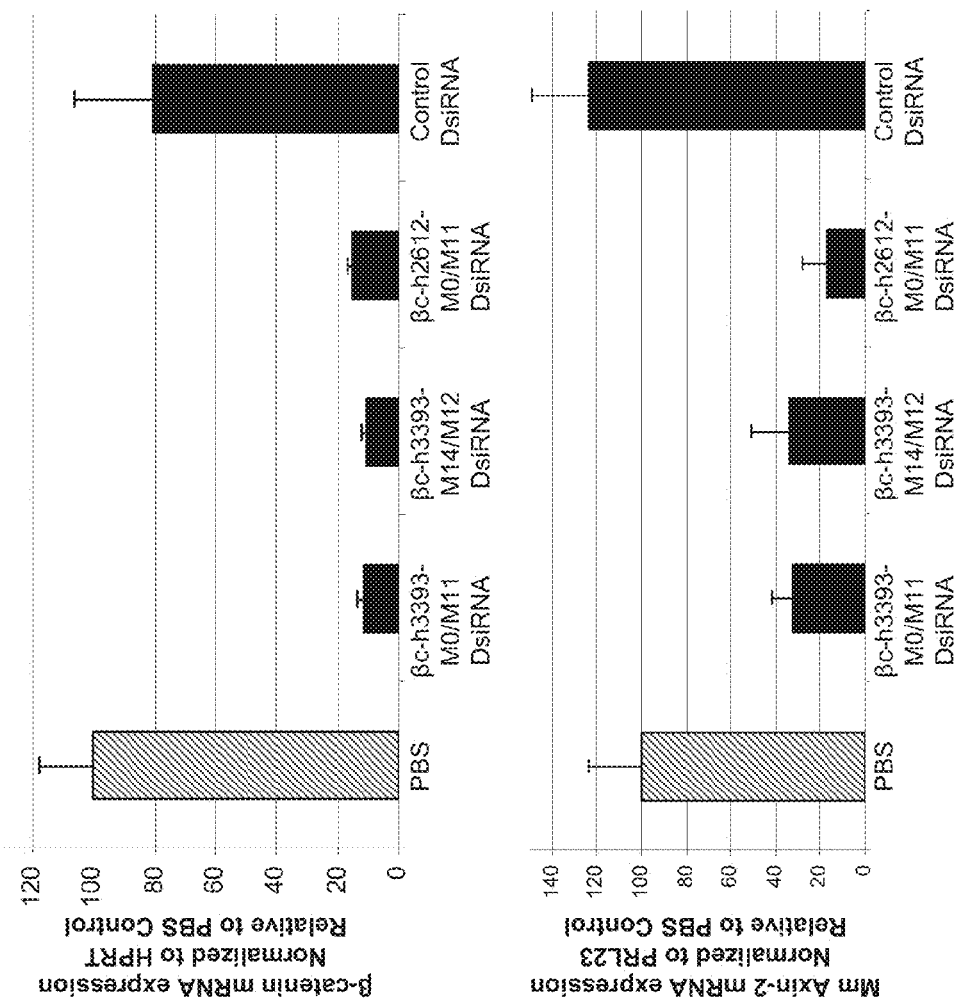
FIG. 31 shows that DsiRNAs targeting human β-catenin were active in vivo in normal mouse liver, inhibiting both β-catenin mRNA (top panel) and Axin-2 mRNA (bottom panel) levels significantly (e.g., in many instances, approximately 70-90% knockdown was observed) when administered as a single dose intravenously to normal mice (n=5 mice per group) at 10 mg/kg and formulated in Invivofectamine® 2.0 (Invitrogen™, Carlsbad, Calif.). Liver tissue was harvested at 72 hours post-administration. DsiRNAs targeting human β-catenin possessed varying modification patterns as indicated, with, e.g., an "M0/M11" pattern corresponding to a 25/27mer DsiRNA possessing an unmodified sense (passenger) strand and a modified antisense (guide) strand having the "M11" pattern of 2'-O-methlylation. It is noted that the "M14" modification pattern of the sense strand corresponds to modification of the sense strand at the following positions, starting from the 5'-terminus (position 1) of the sense strand: 2, 4, 6, 8, 12, 14, 16 and 18.

The above in vivo results were confirmed and expanded upon under differing conditions in subsequent experiments that also employed modified forms of certain DsiRNAs. As shown in FIG. 31, DsiRNAs targeting β-catenin were shown to be active in vivo inhibitors of both β-catenin and Axin-2 in normal mouse liver, inhibiting both β-catenin mRNA (top panel) and Axin-2 mRNA (bottom panel) levels significantly (e.g., in many instances, approximately 70-90% knockdown was observed) when administered as a single dose intravenously to normal mice (n=5 mice per group) at 10 mg/kg and formulated in Invivofectamine® 2.0 (Invitrogen™, Carlsbad, Calif.). For such experiments, liver tissue was harvested at 72 hours post-administration. In these experiments, βc-3393 and βc-2612 DsiRNAs possessed varying modification patterns as indicated in FIG. 31, with, e.g., an "M0/M11" pattern corresponding to a 25/27mer DsiRNA possessing an unmodified sense (passenger) strand and a modified antisense (guide) strand having the "M11" pattern of 2'-O-methlyation. (Meanwhile, the "M14" modification pattern of the sense strand employed for βc-3393-M14/M12 corresponds to modification of the sense strand at the following positions, starting from the 5'-terminus (position 1) of the sense strand: 2, 4, 6, 8, 12, 14, 16 and 18. All three assayed DsiRNAs (βc-2612-M0/M11 and parallel differentially modified forms of βc-3393) showed greater than 80% inhibition of β-catenin levels in vivo in normal mouse liver, and at least 60% knockdown of Axin-2.

Figure 32:
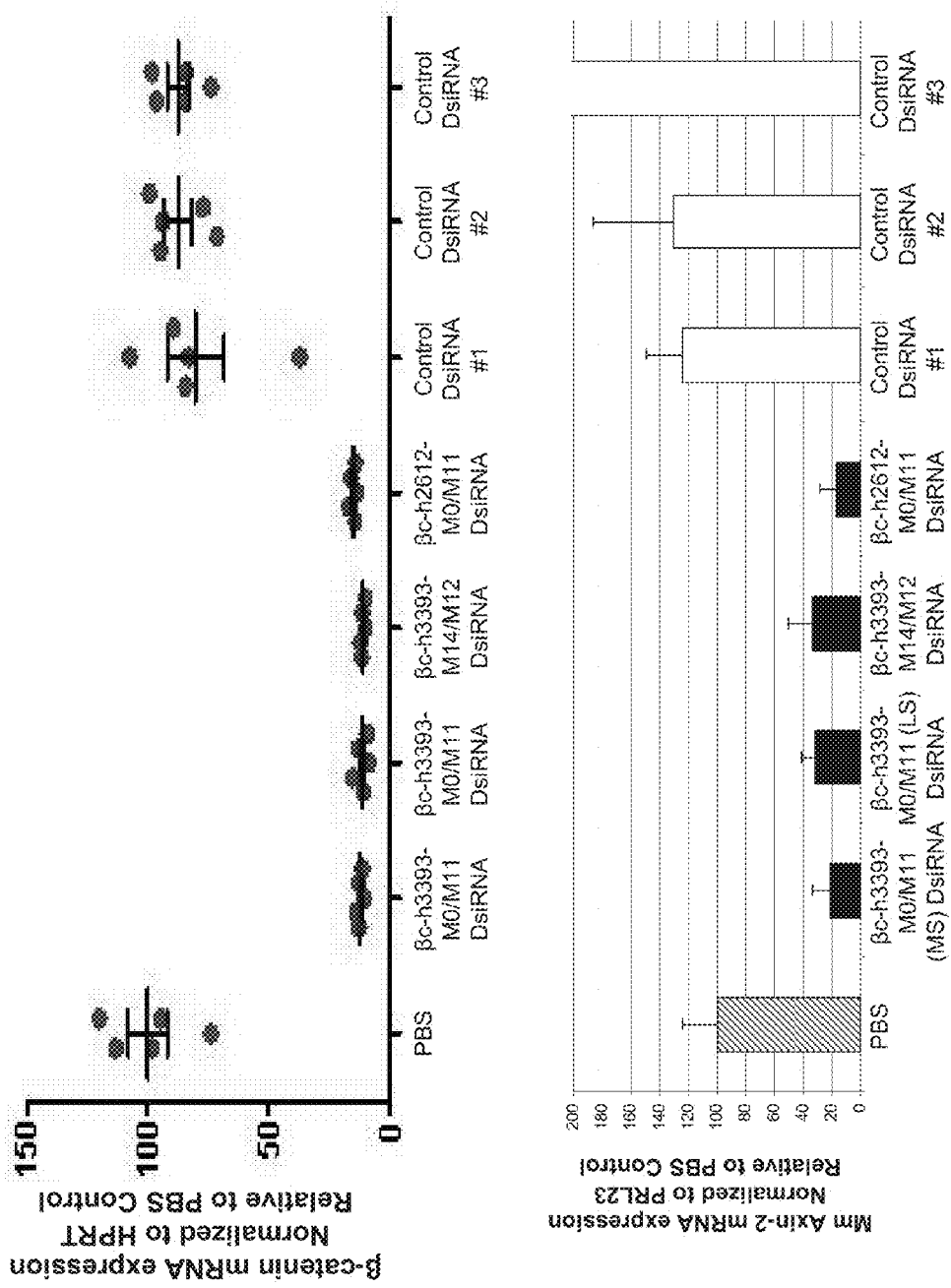
FIG. 32 demonstrates that DsiRNAs targeting human β-catenin were also active at a 48 hour timepoint in vivo in normal mouse liver, inhibiting both β-catenin mRNA (top panel) and Axin-2 mRNA (bottom panel) levels significantly (e.g., in many instances, approximately 70-90% knockdown was observed) when administered as a single dose intravenously to normal mice (n=5 mice per group) at 10 mg/kg and formulated in Invivofectamine® 2.0 (Invitrogen™, Carlsbad, Calif.). Liver tissue was harvested at 48 hours post-administration. DsiRNAs targeting human β-catenin possessed varying modification patterns as indicated and as described above. Control DsiRNAs possessed similar patterns of modification of sense and antisense strands.

Modified forms of βc-3393 and βc-2612 DsiRNAs were also observed to be active inhibitors of β-catenin and Axin-2 expression at a 48 hour timepoint in vivo in normal mouse liver. Specifically, as shown in FIG. 32, βc-3393-M0/M11 (MS), βc-3393-M0/M11 (LS), βc-3393-M14/M12 and βc-2612-M0/M11 DsiRNAs all robustly inhibited both β-catenin mRNA (top panel) and Axin-2 mRNA (bottom panel) levels significantly (e.g., in all instances, approximately 70-90% knockdown was observed) when administered as a single dose intravenously to normal mice (n=5 mice per group) at 10 mg/kg and formulated in Invivofectamine® 2.0 (Invitrogen™, Carlsbad, Calif.). In these experiments, liver tissue was harvested at 48 hours post-administration. DsiRNAs targeting β-catenin possessed varying modification patterns as indicated in FIG. 32 and as described above. Control DsiRNAs possessed similar patterns of modification of sense and antisense strands.

Thus, β-catenin DsiRNAs were observed to be surprisingly potent and effective inhibitors of β-catenin expression in vivo.

Example 9

Inhibition of β-Catenin by Additional Preferred DsiRNAs

The remaining DsiRNA molecules shown in Table 9, possessing sense and antisense strand sequences as shown and targeting β-catenin wild-type sequences (and variant sequences where applicable) are designed and synthesized as described above and tested in HeLa cells (and, optionally, in mouse Hepa 1-6 cells) for inhibitory efficacy as described in Examples 3 and 4 above. The ability of these DsiRNA agents to inhibit β-catenin expression is optionally assessed in comparison to corresponding β-catenin target sequence-directed 21mer siRNAs (21 nucleotide target sequences of (β-catenin dsRNA agents described herein are presented in Tables 5 and 10 above). These additional DsiRNAs and the DsiRNAs tested herein are also examined for the ability to outperform cognate siRNAs, as determined via measurement of efficacy in decreasing levels of β-catenin target relative to a cognate 21mer siRNA agent. The duration of such inhibitory effects is also examined at both 24 hours and 48 hours post-administration, with concentrations of 0.1 nM, 0.3 nM, 1 nM and 5 nM tested. DsiRNAs of the instant invention are examined for the ability to outperform their cognate 21mer siRNA, as determined via measurement of potency and/or duration of effect.

Optionally, the DsiRNA molecules shown in Tables 6-8 and 11-13 above are also similarly synthesized and tested.

Example 10

Indications

As described herein, the nucleic acid molecules of the present invention are used in assays to diagnose disease state related to β-catenin levels. In addition, the nucleic acid molecules can be used to treat disease state related to β-catenin misregulation, levels, etc.

Particular disorders and disease states that can be associated with β-catenin expression modulation include, but are not limited to cancer and/or proliferative diseases, conditions, or disorders and other diseases, conditions or disorders that are related to or will respond to the levels of β-catenin in a cell or tissue, alone or in combination with other therapies. Particular degenerative and disease states that are associated with β-catenin expression modulation include but are not limited to, for example prostate cancer, lung cancer, colorectal cancer, bladder cancer, pancreatic cancer, and breast cancer.

In certain therapeutic embodiments, the disease or disorder to be treated is selected from the group consisting of a hyperproliferative disorder, such as cancer, such as a cancer selected from the group consisting of colorectal cancer, hepatocellular cancer, endometrial cancer, malignant melanoma, ovarian cancer, pancreatic cancer, pituitary cancer, oesophageal cancer, lung cancer, breast cancer, kidney cancer, haematopoetic system cancer, cervical cancer, CNS cancer, bone cancer, biliary tract cancer and adrenal gland cancer. Optionally, the disease or disorder is a cancer selected from the group consisting of colorectal cancer, hepatocellular cancer, endometrial cancer, and malignant melanoma. In certain embodiments, the disorder is a cancer selected from the group consisting of liver cancer and kidney cancer. In certain embodiments, the disease or disorder is associated with a mutation in the β-catenin gene or a gene whose protein product is associated with or interacts with β-catenin, such as the APC gene. Therefore, in various embodiments, the target mRNA is a mutated form of the β-catenin sequence, for example it may comprise one or more single point mutations, such as SNPs associated with cancer.

Examples of such diseases where mutations in the β-catenin or APC gene lead to abnormal levels of β-catenin activity are: (1) Colorectal cancer, APC and β-catenin are mutually mutated in more than 70% of all cases (Powell et al., Nature, 1992; Morin et al., Science, 1997; Sparks et al., Cancer Res, 1998); (2) Hepatocellular cancer, β-catenin are mutated in more than 25% of cases (de La Coste A, PNAS, 1998); (3) Endometrial cancer, β-catenin are mutated>10%; and (4) Malignant melanoma, β-catenin are mutated>10% (Rubinfeld et al., Science, 1997).

Further examples of such diseases are cancer of the ovary, pancreas, pituitary, oesophagus, lung, breast, kidney, haematopoetic system, cervix, CNS, bone, biliary tract and adrenal gland. It has been shown that mutations in the β-catenin or APC gene are associated with these diseases (Catalogue of Somatic Mutations in Cancer available from the Sanger Institute (United Kingdom) homepage http://www.sanger.ac.uk/).

In certain embodiments, the disease or disorder is associated with abnormal levels of a mutated form of β-catenin. In certain embodiments, the disease or disorder is associated with abnormal levels of a wild-type form of β-catenin. One aspect of the invention is directed to a method of treating a mammal suffering from or susceptible to conditions associated with abnormal levels of β-catenin, comprising administering to the mammal a therapeutically effective amount of a DsiRNA of the invention targeted to β-catenin or various compositions or conjugates thereof.

Gemcytabine and cyclophosphamide are non-limiting examples of chemotherapeutic agents that can be combined with or used in conjunction with the nucleic acid molecules (e.g. DsiRNA molecules) of the instant invention. Those skilled in the art will recognize that other drugs such as anti-cancer compounds and therapies can be similarly be readily combined with the nucleic acid molecules of the instant invention (e.g. DsiRNA molecules) and are hence within the scope of the instant invention. Such compounds and therapies are well known in the art (see for example Cancer: Principles and Practice of Oncology, Volumes 1 and 2, eds Devita, V. T., Hellman, S., and Rosenberg, S. A., J.B. Lippincott Company, Philadelphia, USA) and include, without limitations, antifolates; fluoropyrimidines; cytarabine; purine analogs; adenosine analogs; amsacrine; topoisomerase I inhibitors; anthrapyrazoles; retinoids; antibiotics such as bleomycin, anthacyclins, mitomycin C, dactinomycin, and mithramycin; hexamethylmelamine; dacarbazine; 1-asperginase; platinum analogs; alkylating agents such as nitrogen mustard, melphalan, chlorambucil, busulfan, ifosfamide, 4-hydroperoxycyclophosphamide, nitrosoureas, thiotepa; plant derived compounds such as vinca alkaloids, epipodophyllotoxins, taxol; Tamoxifen; radiation therapy; surgery; nutritional supplements; gene therapy; radiotherapy such as 3D-CRT; immunotoxin therapy such as ricin, monoclonal antibodies Herceptin; and the like. For combination therapy, the nucleic acids of the invention are prepared in one of two ways. First, the agents are physically combined in a preparation of nucleic acid and chemotherapeutic agent, such as a mixture of a nucleic acid of the invention encapsulated in liposomes and ifosfamide in a solution for intravenous administration, wherein both agents are present in a therapeutically effective concentration (e.g., ifosfamide in solution to deliver 1000-1250 mg/m2/day and liposome-associated nucleic acid of the invention in the same solution to deliver 0.1-100 mg/kg/day). Alternatively, the agents are administered separately but simultaneously in their respective effective doses (e.g., 1000-1250 mg/m2/d ifosfamide and 0.1 to 100 mg/kg/day nucleic acid of the invention).

Those skilled in the art will recognize that other compounds and therapies used to treat the diseases and conditions described herein can similarly be combined with the nucleic acid molecules of the instant invention (e.g. siNA molecules) and are hence within the scope of the instant invention.

Example 11

Serum Stability of DsiRNAs

Serum stability of DsiRNA agents is assessed via incubation of DsiRNA agents in 50% fetal bovine serum for various periods of time (up to 24 h) at 37° C. Serum is extracted and the nucleic acids are separated on a 20% non-denaturing PAGE and can be visualized with Gelstar stain. Relative levels of protection from nuclease degradation are assessed for DsiRNAs (with and without modifications).

Example 12

Use of Additional Cell Culture Models to Evaluate the Down-Regulation of β-Catenin Gene Expression A variety of endpoints have been used in cell culture models to look at β-catenin-mediated effects after treatment with anti-β-catenin agents. Phenotypic endpoints include inhibition of cell proliferation, RNA expression, and reduction of β-catenin protein expression. Because β-catenin mutations are directly associated with increased proliferation of certain tumor cells, a proliferation endpoint for cell culture assays can be used as a screen, e.g., as documented in the above examples. There are several methods by which this endpoint can be measured. Following treatment of cells with DsiRNA, cells are allowed to grow (typically 5 days), after which the cell viability, the incorporation of bromodeoxyuridine (BrdU) into cellular DNA and/or the cell density are measured. The assay of cell density can be done in a 96-well format, e.g. by using commercially available fluorescent nucleic acid stains (such as Syto® 13 or CyQuant®). As a secondary, confirmatory endpoint, a DsiRNA-mediated decrease in the level of β-catenin protein expression can be evaluated using a β-catenin-specific ELISA.

Example 13

Evaluation of Anti-β-Catenin DsiRNA Efficacy in a Mouse Model of β-Catenin Misregulation Anti-β-catenin DsiRNA chosen from in vitro assays can be further tested in mouse models, including, e.g., xenograft and other animal models as recited above. In one example, mice possessing misregulated (e.g., elevated) β-catenin levels are administered a DsiRNA agent of the present invention via hydrodynamic tail vein injection. 3-4 mice per group (divided based upon specific DsiRNA agent tested) are injected with 50 μg or 200 μg of DsiRNA. Levels of β-catenin RNA are evaluated using RT-qPCR. Additionally or alternatively, levels of β-catenin (e.g., (β-catenin protein levels and/or cancer cell/tumor formation, growth or spread) can be evaluated using an art-recognized method, or phenotypes associated with misregulation of β-catenin (e.g., tumor formation, growth, metastasis, etc.) are monitored (optionally as a proxy for measurement of β-catenin transcript or (β-catenin protein levels). Active DsiRNA in such animal models can also be subsequently tested in combination with standard chemotherapies.

Example 14

Diagnostic Uses

The DsiRNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of DsiRNA molecules involves utilizing reconstituted RNAi systems, for example, using cellular lysates or partially purified cellular lysates. DsiRNA molecules of this invention can be used as diagnostic tools to examine genetic drift and mutations within diseased cells. The close relationship between DsiRNA activity and the structure of the target β-catenin RNA allows the detection of mutations in a region of the β-catenin molecule, which alters the base-pairing and three-dimensional structure of the target β-catenin RNA. By using multiple DsiRNA molecules described in this invention, one can map nucleotide changes, which are important to RNA structure and function in vitro, as well as in cells and tissues. Cleavage of target β-catenin RNAs with DsiRNA molecules can be used to inhibit gene expression and define the role of specified gene products in the progression of a β-catenin-associated disease or disorder. In this manner, other genetic targets can be defined as important mediators of the disease. These experiments will lead to better treatment of the disease progression by affording the possibility of combination therapies (e.g., multiple DsiRNA molecules targeted to different genes, DsiRNA molecules coupled with known small molecule inhibitors, or intermittent treatment with combinations of DsiRNA molecules and/or other chemical or biological molecules). Other in vitro uses of DsiRNA molecules of this invention are well known in the art, and include detection of the presence of RNAs associated with a disease or related condition. Such RNA is detected by determining the presence of a cleavage product after treatment with a DsiRNA using standard methodologies, for example, fluorescence resonance emission transfer (FRET).

In a specific example, DsiRNA molecules that cleave only wild-type or mutant or polymorphic forms of the target β-catenin RNA are used for the assay. The first DsiRNA molecules (i.e., those that cleave only wild-type forms of target (β-catenin RNA) are used to identify wild-type β-catenin RNA present in the sample and the second DsiRNA molecules (i.e., those that cleave only mutant or polymorphic forms of target RNA) are used to identify mutant or polymorphic β-catenin RNA in the sample. As reaction controls, synthetic substrates of both wild-type and mutant or polymorphic β-catenin RNA are cleaved by both DsiRNA molecules to demonstrate the relative DsiRNA efficiencies in the reactions and the absence of cleavage of the "non-targeted" β-catenin RNA species. The cleavage products from the synthetic substrates also serve to generate size markers for the analysis of wild-type and mutant β-catenin RNAs in the sample population. Thus, each analysis requires two DsiRNA molecules, two substrates and one unknown sample, which is combined into six reactions. The presence of cleavage products is determined using an RNase protection assay so that full-length and cleavage fragments of each β-catenin RNA can be analyzed in one lane of a polyacrylamide gel. It is not absolutely required to quantify the results to gain insight into the expression of mutant or polymorphic β-catenin RNAs and putative risk of β-catenin-associated phenotypic changes in target cells. The expression of β-catenin mRNA whose protein product is implicated in the development of the phenotype (i.e., disease related/associated) is adequate to establish risk. If probes of comparable specific activity are used for both transcripts, then a qualitative comparison of β-catenin RNA levels is adequate and decreases the cost of the initial diagnosis. Higher mutant or polymorphic form to wild-type ratios are correlated with higher risk whether β-catenin RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying DsiRNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description.

The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

SEQUENCE LISTING (7794 sequences)

SEQ ID NO: 1 - DNA, 3720 bp, Homo sapiens
aggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcgattg

SEQ ID NO: 2 - DNA, 3415 bp, Homo sapiens
aggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcgattg

SEQ ID NO: 3 - DNA, 3256 bp, Homo sapiens
aggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcgattg

SEQ ID NO: 4 - protein, 781 aa, Homo sapiens
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 5 - DNA, 3640 bp, Mus musculus
gcgcggcggaacgctccgcgcggagcggcagcggcaggatacacggtgccgcgccgcttataaatcgctccttgtgcggcgccatcttaagccctcgctcggtggcggccgcgtcagctcgtgtcctgtgaagcccgcggcccggggaggcggagacggagcacggtgggcgccgagccgtcagtgcaggaggccgaggccgagcgggcggccgcgagtgagcagcgcgcgggcctgagggtacctgaagctcagcgcacagctgctgtgacaccgctgcgtggacaatggctactcaagctgacctgatggagttggacatggccatggagccggacagaaaagctgctgtcagccactggcagcagcagtcttacttggattctggaatccattctggtgccaccaccacagctccttccctgagtggcaagggcaaccctgaggaagaagatgttgacacctcccaagtcctttatgaatgggagcaaggcttttcccagtccttcacgcaagagcaagtagctgatattgacgggcagtatgcaatgactagggctcagagggtccgagctgccatgttccctgagacgctagatgagggcatgcagatcccatccacgcagtttgacgctgctcatcccactaatgtccagcgcttggctgaaccatcacagatgttgaaacatgcagttgtcaatttgattaactatcaggatgacgcggaacttgccacacgtgcaattcctgagctgacaaaactgctaaacgatgaggaccaggtggtagttaataaagctgctgttatggtccatcagctttccaaaaaggaagcttccagacatgccatcatgcgctcccctcagatggtgtctgccattgtacgcaccatgcagaatacaaatgatgtagagacagctcgttgtactgctgggactctgcacaacctttctcaccaccgcgagggcttgctggccatctttaagtctggtggcatcccagcgctggtgaaaatgcttgggtcaccagtggattctgtactgttctacgccatcacgacactgcataatctcctgctccatcaggaaggagctaaaatggcagtgcgcctagctggtggactgcagaaaatggttgctttgctcaacaaaacaaacgtgaaattcttggctattacaacagactgccttcagatcttagcttatggcaatcaagagagcaagctcatcattctggccagtggtggaccccaagccttagtaaacataatgaggacctacacttatgagaagcttctgtggaccacaagcagagtgctgaaggtgctgtctgtctgctctagcaacaagccggccattgtagaagctggtgggatgcaggcactggggcttcatctgacagacccaagtcagcgacttgttcaaaactgtctttggactctcagaaacctttcagatgcagcgactaagcaggaagggatggaaggcctccttgggactctagtgcagcttctgggttccgatgatataaatgtggtcacctgtgcagctggaattctctctaacctcacttgcaataattacaaaaacaagatgatggtgtgccaagtgggtggcatagaggctcttgtacgcaccgtccttcgtgctggtgacagggaagacatcactgagcctgccatctgtgctcttcgtcatctgaccagccggcatcaggaagccgagatggcccagaatgccgttcgccttcattatggactgcctgttgtggttaaactcctgcacccaccatcccactggcctctgataaaggcaactgttggattgattcgaaaccttgccctttgcccagcaaatcatgcgcctttgcgggaacagggtgctattccacgactagttcagctgcttgtacgagcacatcaggacacccaacggcgcacctccatgggtggaacgcagcagcagtttgtggagggcgtgcgcatggaggagatagtagaagggtgtactggagctctccacatccttgctcgggacgttcacaaccggattgtaatccgaggactcaataccattccattgtttgtgcagttgctttattctcccattgaaaatatccaaagagtagctgcaggggtcctctgtgaacttgctcaggacaaggaggctgcagaggccattgaagctgagggagccacagctcccctgacagagttactccactccaggaatgaaggcgtggcaacatacgcagctgctgtcctattccgaatgtctgaggacaagccacaggattacaagaagcggctttcagtcgagctgaccagttccctcttcaggacagagccaatggcttggaatgagactgcagatcttggactggacattggtgcccagggagaagcccttggatatcgccaggatgatcccagctaccgttcttttcactctggtggatacggccaggatgccttggggatggaccctatgatggagcatgagatgggtggccaccaccctggtgctgactatccagttgatgggctgcctgatctgggacacgcccaggacctcatggatgggctgcccccaggtgatagcaatcagctggcctggtttgatactgacctgtaaatcgtcctttaggtaagaaagcttataaaagccagtgtgggtgaatactttactctgcctgcagaactccagaaagacttggtagggtgggaatggttttaggcctgtttgtaaatctgccaccaaacagatacataccttggaaggagatgttcatgtgtggaagtttctcacgttgatgtttttgccacagcttttgcagcgttatactcagatgagtaacatttgctgttttcaacattaatagcagcctttctctctatacagctgtagtgtctgaacgtgcattgtgattggcctgtagagttgctgagagggctcgaggggtgggctggtatctcagaaagtgcctgacacactaaccaagctgagtttcctatgggaacagtcgaagtacgctttttgttctggtcctttttggtcgaggagtaacaatacaaatggatttggggagtgactcacgcagtgaagaatgcacacgaatggatcacaagatggcgttatcaaaccctagccttgcttgttctttgttttaatatctgtagtggtgctgactttgcttgcttttattttttgcagtaactgttagtttttaagtagtgttatgttctagtgaacctgctacagcaatttctgatttctaagaaccgagtaatggtgtagaacactaattcataatcacgctaattgtaatctggagacgtgtaacattgtgtagccttttgtataaatagacagatagaaatggtccgattagtttcctttttaatatgcttaaaataagcaggtggatctatttcatgtttttgaacaaaaactttatcggggatacgtgcggtagggtaaatcagtaagaggtgttatttgagccttgttttggacagtataccagttgccttttatcccaaagttgttgtaacctgctgtgatacaatgcttcaacagatgcggttatagaaatggttcagaattaaacttttaattcattcaaaaaaaaaaaaaaaaaa

SEQ ID NO: 6 - DNA, 3565 bp, Mus musculus
gcggcgccatcttaagccctcgctcggtggcggccgcgtcagctcgtgtcctgtgaagcccgcggcccggggaggcggagacggagcacggtgggcgccgagccgtcagtgcaggaggccgaggccgagcgggcggccgcgagtgagcagcgcgcgggcctgagggtacctgaagctcagcgcacagctgctgtgacaccgctgcgtggacaatggctactcaagctgacctgatggagttggacatggccatggagccggacagaaaagctgctgtcagccactggcagcagcagtcttacttggattctggaatccattctggtgccaccaccacagctccttccctgagtggcaagggcaaccctgaggaagaagatgttgacacctcccaagtcctttatgaatgggagcaaggcttttcccagtccttcacgcaagagcaagtagctgatattgacgggcagtatgcaatgactagggctcagagggtccgagctgccatgttccctgagacgctagatgagggcatgcagatcccatccacgcagtttgacgctgctcatcccactaatgtccagcgcttggctgaaccatcacagatgttgaaacatgcagttgtcaatttgattaactatcaggatgacgcggaacttgccacacgtgcaattcctgagctgacaaaactgctaaacgatgaggaccaggtggtagttaataaagctgctgttatggtccatcagctttccaaaaaggaagcttccagacatgccatcatgcgctcccctcagatggtgtctgccattgtacgcaccatgcagaatacaaatgatgtagagacagctcgttgtactgctgggactctgcacaacctttctcaccaccgcgagggcttgctggccatctttaagtctggtggcatcccagcgctggtgaaaatgcttgggtcaccagtggattctgtactgttctacgccatcacgacactgcataatctcctgctccatcaggaaggagctaaaatggcagtgcgcctagctggtggactgcagaaaatggttgctttgctcaacaaaacaaacgtgaaattcttggctattacaacagactgccttcagatcttagcttatggcaatcaagagagcaagctcatcattctggccagtggtggaccccaagccttagtaaacataatgaggacctacacttatgagaagcttctgtggaccacaagcagagtgctgaaggtgctgtctgtctgctctagcaacaagccggccattgtagaagctggtgggatgcaggcactggggcttcatctgacagacccaagtcagcgacttgttcaaaactgtctttggactctcagaaacctttcagatgcagcgactaagcaggaagggatggaaggcctccttgggactctagtgcagcttctgggttccgatgatataaatgtggtcacctgtgcagctggaattctctctaacctcacttgcaataattacaaaaacaagatgatggtgtgccaagtgggtggcatagaggctcttgtacgcaccgtccttcgtgctggtgacagggaagacatcactgagcctgccatctgtgctcttcgtcatctgaccagccggcatcaggaagccgagatggcccagaatgccgttcgccttcattatggactgcctgttgtggttaaactcctgcacccaccatcccactggcctctgataaaggcaactgttggattgattcgaaaccttgccctttgcccagcaaatcatgcgcctttgcgggaacagggtgctattccacgactagttcagctgcttgtacgagcacatcaggacacccaacggcgcacctccatgggtggaacgcagcagcagtttgtggagggcgtgcgcatggaggagatagtagaagggtgtactggagctctccacatccttgctcgggacgttcacaaccggattgtaatccgaggactcaataccattccattgtttgtgcagttgctttattctcccattgaaaatatccaaagagtagctgcaggggtcctctgtgaacttgctcaggacaaggaggctgcagaggccattgaagctgagggagccacagctcccctgacagagttactccactccaggaatgaaggcgtggcaacatacgcagctgctgtcctattccgaatgtctgaggacaagccacaggattacaagaagcggctttcagtcgagctgaccagttccctcttcaggacagagccaatggcttggaatgagactgcagatcttggactggacattggtgcccagggagaagcccttggatatcgccaggatgatcccagctaccgttcttttcactctggtggatacggccaggatgccttggggatggaccctatgatggagcatgagatgggtggccaccaccctggtgctgactatccagttgatgggctgcctgatctgggacacgcccaggacctcatggatgggctgcccccaggtgatagcaatcagctggcctggtttgatactgacctgtaaatcgtcctttaggtaagaaagcttataaaagccagtgtgggtgaatactttactctgcctgcagaactccagaaagacttggtagggtgggaatggttttaggcctgtttgtaaatctgccaccaaacagatacataccttggaaggagatgttcatgtgtggaagtttctcacgttgatgtttttgccacagcttttgcagcgttatactcagatgagtaacatttgctgttttcaacattaatagcagcctttctctctatacagctgtagtgtctgaacgtgcattgtgattggcctgtagagttgctgagagggctcgaggggtgggctggtatctcagaaagtgcctgacacactaaccaagctgagtttcctatgggaacagtcgaagtacgctttttgttctggtcctttttggtcgaggagtaacaatacaaatggatttggggagtgactcacgcagtgaagaatgcacacgaatggatcacaagatggcgttatcaaaccctagccttgcttgttctttgttttaatatctgtagtggtgctgactttgcttgcttttattttttgcagtaactgttagtttttaagtagtgttatgttctagtgaacctgctacagcaatttctgatttctaagaaccgagtaatggtgtagaacactaattcataatcacgctaattgtaatctggagacgtgtaacattgtgtagccttttgtataaatagacagatagaaatggtccgattagtttcctttttaatatgcttaaaataagcaggtggatctatttcatgtttttgaacaaaaactttatcggggatacgtgcggtagggtaaatcagtaagaggtgttatttgagccttgttttggacagtataccagttgccttttatcccaaagttgttgtaacctgctgtgatacaatgcttcaacagatgcggttatagaaatggttcagaattaaacttttaattcattcaaaaaaaaaaaaaaaaaa

SEQ ID NO: 7 - protein, 781 aa, Mus musculus
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEALGYRQDDPSYRSFHSGGYGQDALGMDPMMEHEMGGHHPGADYPVDGLPDLGHAQDLMDGLPPGDSNQLAWFDTDL

SEQ ID NO: 8 - DNA, 25 bp, Artificial Sequence
  Synthetic oligonucleotide
cugaggguauuugaaguauaccata

SEQ ID NO: 9 - DNA, 25 bp, Artificial Sequence
  Synthetic oligonucleotide
ggguauuugaaguauaccauacaac

SEQ ID NO: 10 - DNA, 25 bp, Artificial Sequence
  Synthetic oligonucleotide
aaguauaccauacaacuguuuugaa

SEQ ID NO: 11 - DNA, 25 bp, Artificial Sequence
  Synthetic oligonucleotide
accauacaacuguuuugaaaaucca

SEQ ID NO: 12 - DNA, 25 bp, Artificial Sequence
  Synthetic oligonucleotide
acaacuguuuugaaaauccagcgtg

SEQ ID NO: 13 - DNA, 25 bp, Artificial Sequence
  Synthetic oligonucleotide
gggauuuucucaguccuucacucaa

SEQ ID NO: 14 - DNA, 25 bp, Artificial Sequence
  Synthetic oligonucleotide
cucaagaacaaguagcugauauuga

SEQ ID NO: 15 - DNA, 25 bp, Artificial Sequence
  Synthetic oligonucleotide
aacaaguagcugauauugauggaca

SEQ ID NO: 16 - DNA, 25 bp, Artificial Sequence
  Synthetic oligonucleotide
caaguagcugauauugauggacagt

SEQ ID NO: 17 - DNA, 25 bp, Artificial Sequence
  Synthetic oligonucleotide
auggacaguaugcaaugacucgagc

SEQ ID NO: 18 - DNA, 25 bp, Artificial Sequence
  Synthetic oligonucleotide
cuauguucccugagacauuagauga

SEQ ID NO: 19 - DNA, 25 bp, Artificial Sequence
  Synthetic oligonucleotide
cugaaacaugcaguuguaaacuuga

SEQ ID NO: 20 - DNA, 25 bp, Artificial Sequence
  Synthetic oligonucleotide
caugcaguuguaaacuugauuaact

SEQ ID NO: 21 - DNA, 25 bp, Artificial Sequence
  Synthetic oligonucleotide
aguuguaaacuugauuaacuaucaa

SEQ ID NO: 22 - DNA, 25 bp, Artificial Sequence
  Synthetic oligonucleotide
uugauuaacuaucaagaugaugcag

SEQ ID NO: 23 - DNA, 25 bp, Artificial Sequence
  Synthetic oligonucleotide
cugaacugacaaaacugcuaaauga

SEQ ID NO: 24 - DNA, 25 bp, Artificial Sequence
  Synthetic oligonucleotide
agauggugucugcuauuguacguac

SEQ ID NO: 25 - DNA, 25 bp, Artificial Sequence
  Synthetic oligonucleotide
acguaccaugcagaauacaaaugat

SEQ ID NO: 26 - DNA, 25 bp, Artificial Sequence
  Synthetic oligonucleotide
uacaacucuccacaaccuuuuauta

SEQ ID NO: 27 - DNA, 25 bp, Artificial Sequence
  Synthetic oligonucleotide
cucuccacaaccuuuuauuacauca

SEQ ID NO: 28 - DNA, 25 bp, Artificial Sequence
  Synthetic oligonucleotide
cacaaccuuuuauuacaucaagaag

SEQ ID NO: 29 - DNA, 25 bp, Artificial Sequence
  Synthetic oligonucleotide
cuuuuauuacaucaagaaggagcta

SEQ ID NO: 30 - DNA, 25 bp, Artificial Sequence
  Synthetic oligonucleotide
aaaacaaauguuaaauucuuggcta

SEQ ID NO: 31 - DNA, 25 bp, Artificial Sequence
  Synthetic oligonucleotide
uacgacagacugccuucaaauuuta

SEQ ID NO: 32 - DNA, 25 bp, Artificial Sequence
  Synthetic oligonucleotide
cagacugccuucaaauuuuagcuta

SEQ ID NO: 33 - DNA, 25 bp, Artificial Sequence
  Synthetic oligonucleotide
cuuuaguaaauauaaugaggaccta

SEQ ID NO: 34 - DNA, 25 bp, Artificial Sequence
  Synthetic oligonucleotide
aaaacuacuguggaccacaagcaga

SEQ ID NO: 35 - DNA, 25 bp, Artificial Sequence
  Synthetic oligonucleotide
agucaacgucuuguucagaacugtc

SEQ ID NO: 36 - DNA, 25 bp, Artificial Sequence
  Synthetic oligonucleotide
cgucuuguucagaacugucuuugga

SEQ ID NO: 37 - DNA, 25 bp, Artificial Sequence
  Synthetic oligonucleotide
uguucagaacugucuuuggacuctc

SEQ ID NO: 38 - DNA, 25 bp, Artificial Sequence
  Synthetic oligonucleotide
gguucagaugauauaaaugugguca

SEQ ID NO: 39 - DNA, 25 bp, Artificial Sequence
  Synthetic oligonucleotide
ucuuucuaaccucacuugcaauaat

SEQ ID NO: 40 - DNA, 25 bp, Artificial Sequence
  Synthetic oligonucleotide
cucacuugcaauaauuauaagaaca

SEQ ID NO: 41 - DNA, 25 bp, Artificial Sequence
  Synthetic oligonucleotide
caauaauuauaagaacaagaugatg

SEQ ID NO: 42 - DNA, 25 bp, Artificial Sequence
  Synthetic oligonucleotide
guauagaggcucuugugcguacugt

SEQ ID NO: 43 - DNA, 25 bp, Artificial Sequence
  Synthetic oligonucleotide
ggcuacuguuggauugauucgaaat

SEQ ID NO: 44 - DNA, 25 bp, Artificial Sequence
  Synthetic oligonucleotide
cauggaagaaauaguugaagguugt

SEQ ID NO: 45 - DNA, 25 bp, Artificial Sequence
  Synthetic oligonucleotide
uggaagaaauaguugaagguuguac

SEQ ID NO: 46 - DNA, 25 bp, Artificial Sequence
  Synthetic oligonucleotide
auugaaaacauccaaagaguagctg

SEQ ID NO: 47 - DNA, 25 bp, Artificial Sequence
  Synthetic oligonucleotide
gaggacaagccacaagauuacaaga

SEQ ID NO: 48 - DNA, 25 bp, Artificial Sequence
  Synthetic oligonucleotide
gauacugaccuguaaaucauccutt

SEQ ID NO: 49 - DNA, 25 bp, Artificial Sequence
  Synthetic oligonucleotide
uuagguaagaaguuuuaaaaagcca

SEQ ID NO: 50 - DNA, 25 bp, Artificial Sequence
  Synthetic oligonucleotide
cagguauauacuuugaaaggagatg

SEQ ID NO: 51 - DNA, 25 bp, Artificial Sequence
  Synthetic oligonucleotide
gaaguuauuaacuuuaauguuuutt

SEQ ID NO: 52 - DNA, 25 bp, Artificial Sequence
  Synthetic oligonucleotide
ccacagcuuuugcaacuuaauactc

SEQ ID NO: 53 - DNA, 25 bp, Artificial Sequence
  Synthetic oligonucleotide
cauuugcuguuuuaaacauuaauag

SEQ ID NO: 54 - DNA, 25 bp, Artificial Sequence
  Synthetic oligonucleotide
caauugaaguaaacuuuuuguuctg

SEQ ID NO: 55 - DNA, 25 bp, Artificial Sequence
  Synthetic oligonucleotide
acccuagccuugcuuguuaaauutt

SEQ ID NO: 56 - DNA, 25 bp, Artificial Sequence
  Synthetic oligonucleotide
gccuugcuuguuaaauuuuuuuutt

SEQ ID NO: 57 - DNA, 25 bp, Artificial Sequence
  Synthetic oligonucleotide
gaaguagcucuuuuuuuuuuuuutt

SEQ ID NO: 58 - DNA, 25 bp, Artificial Sequence
  Synthetic oligonucleotide
guaguguuaaguuauagugaauact

SEQ ID NO: 59 - DNA, 25 bp, Artificial Sequence
  Synthetic oligonucleotide
gugaauacugcuacagcaauuucta

SEQ ID NO: 60 - DNA, 25 bp, Artificial Sequence
  Synthetic oligonucleotide
uacugcuacagcaauuucuaauutt

SEQ ID NO: 61 - DNA, 25 bp, Artificial Sequence
  Synthetic oligonucleotide
cuaauuuuuaagaauugaguaaugg

SEQ ID NO: 62 - DNA, 25 bp, Artificial Sequence
  Synthetic oligonucleotide
uuuuaagaauugaguaaugguguag

SEQ ID NO: 63 - DNA, 25 bp, Artificial Sequence
  Synthetic oligonucleotide
cauaaucacucuaauuaauuguaat

SEQ ID NO: 64 - DNA, 25 bp, Artificial Sequence
  Synthetic oligonucleotide
uaauuguaaucugaauaaaguguaa

SEQ ID NO: 65 - DNA, 25 bp, Artificial Sequence
  Synthetic oligonucleotide
guaaucugaauaaaguguaacaatt

SEQ ID NO: 66 - DNA, 25 bp, Artificial Sequence
  Synthetic oligonucleotide
ugaauaaaguguaacaauuguguag

SEQ ID NO: 67 - DNA, 25 bp, Artificial Sequence
  Synthetic oligonucleotide
guagccuuuuuguauaaaauagaca

SEQ ID NO: 68 - DNA, 25 bp, Artificial Sequence
  Synthetic oligonucleotide
uguauaaaauagacaaauagaaaat

SEQ ID NO: 69 - DNA, 25 bp, Artificial Sequence
  Synthetic oligonucleotide
aaaaugguccaauuaguuuccuutt

SEQ ID NO: 70 - DNA, 25 bp, Artificial Sequence
  Synthetic oligonucleotide
ccaauuaguuuccuuuuuaauaugc

SEQ ID NO: 71 - DNA, 25 bp, Artificial Sequence
  Synthetic oligonucleotide
uuugaucaaaaacuauuugggauat

SEQ ID NO: 72 - DNA, 25 bp, Artificial Sequence
  Synthetic oligonucleotide
gagguguuauuuggaaccuuguutt

SEQ ID NO: 73 - DNA, 25 bp, Artificial Sequence
  Synthetic oligonucleotide
guuauuuggaaccuuguuuuggaca

SEQ ID NO: 74 - DNA, 25 bp, Artificial Sequence
  Synthetic oligonucleotide
accuuguuuuggacaguuuaccagt

SEQ ID NO: 75 - DNA, 25 bp, Artificial Sequence
  Synthetic oligonucleotide
gauacgaugcuucaagagaaaaugc

SEQ ID NO: 76 - DNA, 25 bp, Artificial Sequence
  Synthetic oligonucleotide
caagagaaaaugcgguuauaaaaaa

SEQ ID NO: 77 - DNA, 25 bp, Artificial Sequence
  Synthetic oligonucleotide
gaaaaugcgguuauaaaaaauggtt

SEQ ID NO: 78 - DNA, 25 bp, Artificial Sequence
  Synthetic oligonucleotide
guuauaaaaaaugguucagaauuaa

SEQ ID NO: 79 - DNA, 25 bp, Artificial Sequence
  Synthetic oligonucleotide
aaaaugguucagaauuaaacuuuta

SEQ ID NO: 80 - DNA, 25 bp, Artificial Sequence
  Synthetic oligonucleotide
gcguggacaauggcuacucaagctg

SEQ ID NO: 81 - DNA, 25 bp, Artificial Sequence
  Synthetic oligonucleotide
cguggacaauggcuacucaagcuga

SEQ ID NO: 82 - DNA, 25 bp, Artificial Sequence
  Synthetic oligonucleotide
guggacaauggcuacucaagcugat

SEQ ID NO: 83 - DNA, 25 bp, Artificial Sequence
  Synthetic oligonucleotide
uggacaauggcuacucaagcugatt

SEQ ID NO: 84 - DNA, 25 bp, Artificial Sequence
  Synthetic oligonucleotide
ggacaauggcuacucaagcugautt

SEQ ID NO: 85 - DNA, 25 bp, Artificial Sequence
  Synthetic oligonucleotide
gacaauggcuacucaagcugauutg

SEQ ID NO: 86 - DNA, 25 bp, Artificial Sequence
  Synthetic oligonucleotide
acaauggcuacucaagcugauuuga

SEQ ID NO: 87 - DNA, 25 bp, Artificial Sequence
  Synthetic oligonucleotide
caauggcuacucaagcugauuugat

SEQ ID NO: 88 - DNA, 25 bp, Artificial Sequence
  Synthetic oligonucleotide
ugauggaguuggacauggccaugga

SEQ ID NO: 89 - DNA, 25 bp, Artificial Sequence
  Synthetic oligonucleotide
gauggaguuggacauggccauggaa

SEQ ID NO: 90 - DNA, 25 bp, Artificial Sequence
  Synthetic oligonucleotide
auggaguuggacauggccauggaac

SEQ ID NO: 91 - DNA, 25 bp, Artificial Sequence
  Synthetic oligonucleotide
uggaguuggacauggccauggaacc

SEQ ID NO: 92 - DNA, 25 bp, Artificial Sequence
  Synthetic oligonucleotide
ggaguuggacauggccauggaacca

SEQ ID NO: 93 - DNA, 25 bp, Artificial Sequence
  Synthetic oligonucleotide
gaguuggacauggccauggaaccag

SEQ ID NO: 94 - DNA, 25 bp, Artificial Sequence
  Synthetic oligonucleotide
aguuggacauggccauggaaccaga

SEQ ID NO: 95 - DNA, 25 bp, Artificial Sequence
  Synthetic oligonucleotide
ucuggaauccauucuggugccacta

SEQ ID NO: 96 - DNA, 25 bp, Artificial Sequence
  Synthetic oligonucleotide
cuggaauccauucuggugccacuac

SEQ ID NO: 97 - DNA, 25 bp, Artificial Sequence
  Synthetic oligonucleotide
uggaauccauucuggugccacuacc

SEQ ID NO: 98 - DNA, 25 bp, Artificial Sequence
  Synthetic oligonucleotide
ggaauccauucuggugccacuacca

SEQ ID NO: 99 - DNA, 25 bp, Artificial Sequence
  Synthetic oligonucleotide
gaauccauucuggugccacuaccac

SEQ ID NO: 100 - DNA, 25 bp, Artificial Sequence
  Synthetic oligonucleotide
uagaugagggcaugcagaucccatc

SEQ ID NO: 101 - DNA, 25 bp, Artificial Sequence
  Synthetic oligonucleotide
agaugagggcaugcagaucccauct

SEQ ID NO: 102 - DNA, 25 bp, Artificial Sequence
  Synthetic oligonucleotide
gaugagggcaugcagaucccaucta

SEQ ID NO: 103 - DNA, 25 bp, Artificial Sequence
  Synthetic oligonucleotide
augagggcaugcagaucccaucuac

SEQ ID NO: 104 - DNA, 25 bp, Artificial Sequence
  Synthetic oligonucleotide
ugagggcaugcagaucccaucuaca

SEQ ID NO: 105 - DNA, 25 bp, Artificial Sequence
  Synthetic oligonucleotide
gagggcaugcagaucccaucuacac

SEQ ID NO: 106 - DNA, 25 bp, Artificial Sequence
  Synthetic oligonucleotide
gcugcucaucccacuaauguccagc

SEQ ID NO: 107 - DNA, 25 bp, Artificial Sequence
  Synthetic oligonucleotide
cugcucaucccacuaauguccagcg

SEQ ID NO: 108 - DNA, 25 bp, Artificial Sequence
  Synthetic oligonucleotide
ugcucaucccacuaauguccagcgt

SEQ ID NO: 109 - DNA, 25 bp, Artificial Sequence
  Synthetic oligonucleotide
gcucaucccacuaauguccagcgtt

SEQ ID NO: 110 - DNA, 25 bp, Artificial Sequence
  Synthetic oligonucleotide
cucaucccacuaauguccagcgutt

SEQ ID NO: 111 - DNA, 25 bp, Artificial Sequence
  Synthetic oligonucleotide
ucaucccacuaauguccagcguutg

SEQ ID NO: 112 - DNA, 25 bp, Artificial Sequence
  Synthetic oligonucleotide
caucccacuaauguccagcguuugg

SEQ ID NO: 113 - DNA, 25 bp, Artificial Sequence
  Synthetic oligonucleotide
aucccacuaauguccagcguuuggc

SEQ ID NO: 114 - DNA, 25 bp, Artificial Sequence
  Synthetic oligonucleotide
uuggcugaaccaucacagaugcuga

SEQ ID NO: 115 - DNA, 25 bp, Artificial Sequence
  Synthetic oligonucleotide
uggcugaaccaucacagaugcugaa

SEQ ID NO: 116 - DNA, 25 bp, Artificial Sequence
  Synthetic oligonucleotide
ggcugaaccaucacagaugcugaaa

SEQ ID NO: 117 - DNA, 25 bp, Artificial Sequence
  Synthetic oligonucleotide
gaacuugccacacgugcaauccctg

SEQ ID NO: 118 - DNA, 25 bp, Artificial Sequence
  Synthetic oligonucleotide
aacuugccacacgugcaaucccuga

SEQ ID NO: 119 - DNA, 25 bp, Artificial Sequence
  Synthetic oligonucleotide
guuaugguccaucagcuuucuaaaa

SEQ ID NO: 120 - DNA, 25 bp, Artificial Sequence
  Synthetic oligonucleotide
uuaugguccaucagcuuucuaaaaa

SEQ ID NO: 121 - DNA, 25 bp, Artificial Sequence
  Synthetic oligonucleotide
aaaaaggaagcuuccagacacgcta

SEQ ID NO: 122 - DNA, 25 bp, Artificial Sequence
  Synthetic oligonucleotide
aaaaggaagcuuccagacacgcuat

SEQ ID NO: 123 - DNA, 25 bp, Artificial Sequence
  Synthetic oligonucleotide
accaugcagaauacaaaugauguag

SEQ ID NO: 124 - DNA, 25 bp, Artificial Sequence
  Synthetic oligonucleotide
ccaugcagaauacaaaugauguaga

SEQ ID NO: 125 - DNA, 25 bp, Artificial Sequence
  Synthetic oligonucleotide
caugcagaauacaaaugauguagaa

SEQ ID NO: 126 - DNA, 25 bp, Artificial Sequence
  Synthetic oligonucleotide
augcagaauacaaaugauguagaaa

SEQ ID NO: 127 - DNA, 25 bp, Artificial Sequence
  Synthetic oligonucleotide
ugcagaauacaaaugauguagaaac

SEQ ID NO: 128 - DNA, 25 bp, Artificial Sequence
  Synthetic oligonucleotide
gcagaauacaaaugauguagaaaca

SEQ ID NO: 129 - DNA, 25 bp, Artificial Sequence
  Synthetic oligonucleotide
cagaauacaaaugauguagaaacag

SEQ ID NO: 130 - DNA, 25 bp, Artificial Sequence
  Synthetic oligonucleotide
agaauacaaaugauguagaaacagc

SEQ ID NO: 131 - DNA, 25 bp, Artificial Sequence
  Synthetic oligonucleotide
cuggccaucuuuaagucuggaggca

SEQ ID NO: 132 - DNA, 25 bp, Artificial Sequence
  Synthetic oligonucleotide
uggccaucuuuaagucuggaggcat

SEQ ID NO: 133 - DNA, 25 bp, Artificial Sequence
  Synthetic oligonucleotide
gaaggagcuaaaauggcagugcgtt

SEQ ID NO: 134 - DNA, 25 bp, Artificial Sequence
  Synthetic oligonucleotide
aaggagcuaaaauggcagugcgutt

SEQ ID NO: 135 - DNA, 25 bp, Artificial Sequence
  Synthetic oligonucleotide
aggagcuaaaauggcagugcguuta

SEQ ID NO: 136 - DNA, 25 bp, Artificial Sequence
  Synthetic oligonucleotide
ggagcuaaaauggcagugcguuuag

SEQ ID NO: 137 - DNA, 25 bp, Artificial Sequence
  Synthetic oligonucleotide
gagcuaaaauggcagugcguuuagc

SEQ ID NO: 138 - DNA, 25 bp, Artificial Sequence
  Synthetic oligonucleotide
cuguggaccacaagcagagugcuga

SEQ ID NO: 139 - DNA, 25 bp, Artificial Sequence
  Synthetic oligonucleotide
uguggaccacaagcagagugcugaa

SEQ ID NO: 140 - DNA, 25 bp, Artificial Sequence
  Synthetic oligonucleotide
guggaccacaagcagagugcugaag

SEQ ID NO: 141 - DNA, 25 bp, Artificial Sequence
  Synthetic oligonucleotide
uggaccacaagcagagugcugaagg

SEQ ID NO: 142 - DNA, 25 bp, Artificial Sequence
  Synthetic oligonucleotide
ggaccacaagcagagugcugaaggt

SEQ ID NO: 143 - DNA, 25 bp, Artificial Sequence
  Synthetic oligonucleotide
gaccacaagcagagugcugaaggtg

SEQ ID NO: 144 - DNA, 25 bp, Artificial Sequence
  Synthetic oligonucleotide
accacaagcagagugcugaaggugc

SEQ ID NO: 145 - DNA, 25 bp, Artificial Sequence
  Synthetic oligonucleotide
ccacaagcagagugcugaaggugct

SEQ ID NO: 146 - DNA, 25 bp, Artificial Sequence
  Synthetic oligonucleotide
cacaagcagagugcugaaggugcta

SEQ ID NO: 147 - DNA, 25 bp, Artificial Sequence
  Synthetic oligonucleotide
acaagcagagugcugaaggugcuat

SEQ ID NO: 148 - DNA, 25 bp, Artificial Sequence
  Synthetic oligonucleotide
caagcagagugcugaaggugcuatc

SEQ ID NO: 149 - DNA, 25 bp, Artificial Sequence
  Synthetic oligonucleotide
aagcagagugcugaaggugcuauct

SEQ ID NO: 150 - DNA, 25 bp, Artificial Sequence
  Synthetic oligonucleotide
agcagagugcugaaggugcuauctg

SEQ ID NO: 151 - DNA, 25 bp, Artificial Sequence
  Synthetic oligonucleotide
gcagagugcugaaggugcuaucugt

SEQ ID NO: 152 - DNA, 25 bp, Artificial Sequence
  Synthetic oligonucleotide
aacugucuuuggacucucaggaatc

SEQ ID NO: 153 - DNA, 25 bp, Artificial Sequence
  Synthetic oligonucleotide
acugucuuuggacucucaggaauct

SEQ ID NO: 154 - DNA, 25 bp, Artificial Sequence
  Synthetic oligonucleotide
gaugauauaaauguggucaccugtg

SEQ ID NO: 155 - DNA, 25 bp, Artificial Sequence
  Synthetic oligonucleotide
augauauaaauguggucaccugugc

SEQ ID NO: 156 - DNA, 25 bp, Artificial Sequence
  Synthetic oligonucleotide
ugauauaaauguggucaccugugca

SEQ ID NO: 157 - DNA, 25 bp, Artificial Sequence
  Synthetic oligonucleotide
gauauaaauguggucaccugugcag

SEQ ID NO: 158 - DNA, 25 bp, Artificial Sequence
  Synthetic oligonucleotide
auauaaauguggucaccugugcagc

SEQ ID NO: 159 - DNA, 25 bp, Artificial Sequence
  Synthetic oligonucleotide
uauaaauguggucaccugugcagct

SEQ ID NO: 160 - DNA, 25 bp, Artificial Sequence
  Synthetic oligonucleotide
auaaauguggucaccugugcagctg

SEQ ID NO: 161 - DNA, 25 bp, Artificial Sequence
  Synthetic oligonucleotide
uaaauguggucaccugugcagcugg

SEQ ID NO: 162 - DNA, 25 bp, Artificial Sequence
  Synthetic oligonucleotide
aaauguggucaccugugcagcugga

SEQ ID NO: 163 - DNA, 25 bp, Artificial Sequence
  Synthetic oligonucleotide
aauguggucaccugugcagcuggaa

SEQ ID NO: 164 - DNA, 25 bp, Artificial Sequence
  Synthetic oligonucleotide
auguggucaccugugcagcuggaat

SEQ ID NO: 165 - DNA, 25 bp, Artificial Sequence
  Synthetic oligonucleotide
uguggucaccugugcagcuggaatt

SEQ ID NO: 166 - DNA, 25 bp, Artificial Sequence
  Synthetic oligonucleotide
guggucaccugugcagcuggaautc

SEQ ID NO: 167 - DNA, 25 bp, Artificial Sequence
  Synthetic oligonucleotide
uggucaccugugcagcuggaauuct

SEQ ID NO: 168 - DNA, 25 bp, Artificial Sequence
  Synthetic oligonucleotide
ggucaccugugcagcuggaauuctt

SEQ ID NO: 169 - DNA, 25 bp, Artificial Sequence
  Synthetic oligonucleotide
gucaccugugcagcuggaauucutt

SEQ ID NO: 170 - DNA, 25 bp, Artificial Sequence
  Synthetic oligonucleotide
ucaccugugcagcuggaauucuutc

SEQ ID NO: 171 - DNA, 25 bp, Artificial Sequence
  Synthetic oligonucleotide
caccugugcagcuggaauucuuuct

SEQ ID NO: 172 - DNA, 25 bp, Artificial Sequence
  Synthetic oligonucleotide
accugugcagcuggaauucuuucta

SEQ ID NO: 173 - DNA, 25 bp, Artificial Sequence
  Synthetic oligonucleotide
ccugugcagcuggaauucuuucuaa

SEQ ID NO: 174 - DNA, 25 bp, Artificial Sequence
  Synthetic oligonucleotide
ucuaaccucacuugcaauaauuata

SEQ ID NO: 175 - DNA, 25 bp, Artificial Sequence
  Synthetic oligonucleotide
cuaaccucacuugcaauaauuauaa

SEQ ID NO: 176 - DNA, 25 bp, Artificial Sequence
  Synthetic oligonucleotide
uaaccucacuugcaauaauuauaag

SEQ ID NO: 177 - DNA, 25 bp, Artificial Sequence
  Synthetic oligonucleotide
aaccucacuugcaauaauuauaaga

SEQ ID NO: 178 - DNA, 25 bp, Artificial Sequence
  Synthetic oligonucleotide
accucacuugcaauaauuauaagaa

SEQ ID NO: 179 - DNA, 25 bp, Artificial Sequence
  Synthetic oligonucleotide
gcuggugacagggaagacaucactg

SEQ ID NO: 180 - DNA, 25 bp, Artificial Sequence
  Synthetic oligonucleotide
cuggugacagggaagacaucacuga

SEQ ID NO: 181 - DNA, 25 bp, Artificial Sequence
  Synthetic oligonucleotide
uggugacagggaagacaucacugag

SEQ ID NO: 182 - DNA, 25 bp, Artificial Sequence
  Synthetic oligonucleotide
ggugacagggaagacaucacugagc

SEQ ID NO: 183 - DNA, 25 bp, Artificial Sequence
  Synthetic oligonucleotide
gugacagggaagacaucacugagcc

SEQ ID NO: 184 - DNA, 25 bp, Artificial Sequence
  Synthetic oligonucleotide
ugacagggaagacaucacugagcct

SEQ ID NO: 185 - DNA, 25 bp, Artificial Sequence
  Synthetic oligonucleotide
gacagggaagacaucacugagcctg

SEQ ID NO: 186 - DNA, 25 bp, Artificial Sequence
  Synthetic oligonucleotide
acagggaagacaucacugagccugc

SEQ ID NO: 187 - DNA, 25 bp, Artificial Sequence
  Synthetic oligonucleotide
cagggaagacaucacugagccugcc

SEQ ID NO: 188 - DNA, 25 bp, Artificial Sequence
  Synthetic oligonucleotide
agggaagacaucacugagccugcca

SEQ ID NO: 189 - DNA, 25 bp, Artificial Sequence
  Synthetic oligonucleotide
gggaagacaucacugagccugccat

SEQ ID NO: 190 - DNA, 25 bp, Artificial Sequence
  Synthetic oligonucleotide
ggaagacaucacugagccugccatc

SEQ ID NO: 191 - DNA, 25 bp, Artificial Sequence
  Synthetic oligonucleotide
gaagacaucacugagccugccauct

SEQ ID NO: 192 - DNA, 25 bp, Artificial Sequence
  Synthetic oligonucleotide
aagacaucacugagccugccauctg

SEQ ID NO: 193 - DNA, 25 bp, Artificial Sequence
  Synthetic oligonucleotide
agacaucacugagccugccaucugt

SEQ ID NO: 194 - DNA, 25 bp, Artificial Sequence
  Synthetic oligonucleotide
gacaucacugagccugccaucugtg

SEQ ID NO: 195 - DNA, 25 bp, Artificial Sequence
  Synthetic oligonucleotide
acaucacugagccugccaucugugc

SEQ ID NO: 196 - DNA, 25 bp, Artificial Sequence
  Synthetic oligonucleotide
caucacugagccugccaucugugct

SEQ ID NO: 197 - DNA, 25 bp, Artificial Sequence
  Synthetic oligonucleotide
aucacugagccugccaucugugctc

SEQ ID NO: 198 - DNA, 25 bp, Artificial Sequence
  Synthetic oligonucleotide
ucacugagccugccaucugugcuct

SEQ ID NO: 199 - DNA, 25 bp, Artificial Sequence
  Synthetic oligonucleotide
cacugagccugccaucugugcuctt

SEQ ID NO: 200 - DNA, 25 bp, Artificial Sequence
  Synthetic oligonucleotide
acugagccugccaucugugcucutc

SEQ ID NO: 201 - DNA, 25 bp, Artificial Sequence
  Synthetic oligonucleotide
cugagccugccaucugugcucuucg

SEQ ID NO: 202 - DNA, 25 bp, Artificial Sequence
  Synthetic oligonucleotide
ugagccugccaucugugcucuucgt

SEQ ID NO: 203 - DNA, 25 bp, Artificial Sequence
  Synthetic oligonucleotide
gagccugccaucugugcucuucgtc

SEQ ID NO: 204 - DNA, 25 bp, Artificial Sequence
  Synthetic oligonucleotide
agccugccaucugugcucuucguca

SEQ ID NO: 205 - DNA, 25 bp, Artificial Sequence
  Synthetic oligonucleotide
gccugccaucugugcucuucgucat

SEQ ID NO: 206 - DNA, 25 bp, Artificial Sequence
  Synthetic oligonucleotide
ccugccaucugugcucuucgucatc

SEQ ID NO: 207 - DNA, 25 bp, Artificial Sequence
  Synthetic oligonucleotide
cugccaucugugcucuucgucauct

SEQ ID NO: 208 - DNA, 25 bp, Artificial Sequence
  Synthetic oligonucleotide
ugccaucugugcucuucgucauctg

SEQ ID NO: 209 - DNA, 25 bp, Artificial Sequence
  Synthetic oligonucleotide
gccaucugugcucuucgucaucuga

SEQ ID NO: 210 - DNA, 25 bp, Artificial Sequence
  Synthetic oligonucleotide
ccaucugugcucuucgucaucugac

SEQ ID NO: 211 - DNA, 25 bp, Artificial Sequence
  Synthetic oligonucleotide
caucugugcucuucgucaucugacc

SEQ ID NO: 212 - DNA, 25 bp, Artificial Sequence
  Synthetic oligonucleotide
aucugugcucuucgucaucugacca

SEQ ID NO: 213 - DNA, 25 bp, Artificial Sequence
  Synthetic oligonucleotide
ucugugcucuucgucaucugaccag

SEQ ID NO: 214 - DNA, 25 bp, Artificial Sequence
  Synthetic oligonucleotide
cugugcucuucgucaucugaccagc

SEQ ID NO: 215 - DNA, 25 bp, Artificial Sequence
  Synthetic oligonucleotide
ugugcucuucgucaucugaccagcc

SEQ ID NO: 216 - DNA, 25 bp, Artificial Sequence
  Synthetic oligonucleotide
gugcucuucgucaucugaccagccg

SEQ ID NO: 217 - DNA, 25 bp, Artificial Sequence
  Synthetic oligonucleotide
ugcucuucgucaucugaccagccga

SEQ ID NO: 218 - DNA, 25 bp, Artificial Sequence
  Synthetic oligonucleotide
gcucuucgucaucugaccagccgac

SEQ ID NO: 219 - DNA, 25 bp, Artificial Sequence
  Synthetic oligonucleotide
cucuucgucaucugaccagccgaca

SEQ ID NO: 220 - DNA, 25 bp, Artificial Sequence
  Synthetic oligonucleotide
ucuucgucaucugaccagccgacac

SEQ ID NO: 221 - DNA, 25 bp, Artificial Sequence
  Synthetic oligonucleotide
cuucgucaucugaccagccgacacc

SEQ ID NO: 222 - DNA, 25 bp, Artificial Sequence
  Synthetic oligonucleotide
uucgucaucugaccagccgacacca

SEQ ID NO: 223 - DNA, 25 bp, Artificial Sequence
  Synthetic oligonucleotide
cacccaccaucccacuggccucuga

SEQ ID NO: 224 - DNA, 25 bp, Artificial Sequence
  Synthetic oligonucleotide
acccaccaucccacuggccucugat

SEQ ID NO: 225 - DNA, 25 bp, Artificial Sequence
  Synthetic oligonucleotide
cccaccaucccacuggccucugata

SEQ ID NO: 226 - DNA, 25 bp, Artificial Sequence
  Synthetic oligonucleotide
ccaccaucccacuggccucugauaa

SEQ ID NO: 227 - DNA, 25 bp, Artificial Sequence
  Synthetic oligonucleotide
caccaucccacuggccucugauaaa

SEQ ID NO: 228 - DNA, 25 bp, Artificial Sequence
  Synthetic oligonucleotide
accaucccacuggccucugauaaag

SEQ ID NO: 229 - DNA, 25 bp, Artificial Sequence
  Synthetic oligonucleotide
ccaucccacuggccucugauaaagg

SEQ ID NO: 230 - DNA, 25 bp, Artificial Sequence
  Synthetic oligonucleotide
caucccacuggccucugauaaaggc

SEQ ID NO: 231 - DNA, 25 bp, Artificial Sequence
  Synthetic oligonucleotide
aucccacuggccucugauaaaggct

SEQ ID NO: 232 - DNA, 25 bp, Artificial Sequence
  Synthetic oligonucleotide
ucccacuggccucugauaaaggcta

SEQ ID NO: 233 - DNA, 25 bp, Artificial Sequence
  Synthetic oligonucleotide
cccacuggccucugauaaaggcuac

SEQ ID NO: 234 - DNA, 25 bp, Artificial Sequence
  Synthetic oligonucleotide
ccacuggccucugauaaaggcuact

SEQ ID NO: 235 - DNA, 25 bp, Artificial Sequence
  Synthetic oligonucleotide
cacuggccucugauaaaggcuactg

SEQ ID NO: 236 - DNA, 25 bp, Artificial Sequence
  Synthetic oligonucleotide
acuggccucugauaaaggcuacugt

SEQ ID NO: 237 - DNA, 25 bp, Artificial Sequence
  Synthetic oligonucleotide
acuguuggauugauucgaaaucutg

SEQ ID NO: 238 - DNA, 25 bp, Artificial Sequence
  Synthetic oligonucleotide
cuguuggauugauucgaaaucuugc

SEQ ID NO: 239 - DNA, 25 bp, Artificial Sequence
  Synthetic oligonucleotide
aauaccauuccauuguuugugcagc

SEQ ID NO: 240 - DNA, 25 bp, Artificial Sequence
  Synthetic oligonucleotide
auaccauuccauuguuugugcagct

SEQ ID NO: 241 - DNA, 25 bp, Artificial Sequence
  Synthetic oligonucleotide
uaccauuccauuguuugugcagctg

SEQ ID NO: 242 - DNA, 25 bp, Artificial Sequence
  Synthetic oligonucleotide
accauuccauuguuugugcagcugc

SEQ ID NO: 243 - DNA, 25 bp, Artificial Sequence
  Synthetic oligonucleotide
ccauuccauuguuugugcagcugct

SEQ ID NO: 244 - DNA, 25 bp, Artificial Sequence
  Synthetic oligonucleotide
cauuccauuguuugugcagcugctt

SEQ ID NO: 245 - DNA, 25 bp, Artificial Sequence
  Synthetic oligonucleotide
ugcuuuauucucccauugaaaacat

SEQ ID NO: 246 - DNA, 25 bp, Artificial Sequence
  Synthetic oligonucleotide
gcuuuauucucccauugaaaacatc

SEQ ID NO: 247 - DNA, 25 bp, Artificial Sequence
  Synthetic oligonucleotide
cuuuauucucccauugaaaacaucc

SEQ ID NO: 248 - DNA, 25 bp, Artificial Sequence
  Synthetic oligonucleotide
uuuauucucccauugaaaacaucca

SEQ ID NO: 249 - DNA, 25 bp, Artificial Sequence
  Synthetic oligonucleotide
guccucugugaacuugcucaggaca

SEQ ID NO: 250 - DNA, 25 bp, Artificial Sequence
  Synthetic oligonucleotide
uccucugugaacuugcucaggacaa

SEQ ID NO: 251 - DNA, 25 bp, Artificial Sequence
  Synthetic oligonucleotide
ccucugugaacuugcucaggacaag

SEQ ID NO: 252 - DNA, 25 bp, Artificial Sequence
  Synthetic oligonucleotide
cucugugaacuugcucaggacaagg

SEQ ID NO: 253 - DNA, 25 bp, Artificial Sequence
  Synthetic oligonucleotide
ucugugaacuugcucaggacaagga

SEQ ID NO: 254 - DNA, 25 bp, Artificial Sequence
  Synthetic oligonucleotide
cugugaacuugcucaggacaaggaa

SEQ ID NO: 255 - DNA, 25 bp, Artificial Sequence
  Synthetic oligonucleotide
ugugaacuugcucaggacaaggaag

SEQ ID NO: 256 - DNA, 25 bp, Artificial Sequence
  Synthetic oligonucleotide
gugaacuugcucaggacaaggaagc

SEQ ID NO: 257 - DNA, 25 bp, Artificial Sequence
  Synthetic oligonucleotide
ugaacuugcucaggacaaggaagct

SEQ ID NO: 258 - DNA, 25 bp, Artificial Sequence
  Synthetic oligonucleotide
gaacuugcucaggacaaggaagctg

SEQ ID NO: 259 - DNA, 25 bp, Artificial Sequence
  Synthetic oligonucleotide
aacuugcucaggacaaggaagcugc

SEQ ID NO: 260 - DNA, 25 bp, Artificial Sequence
  Synthetic oligonucleotide
auugaagcugagggagccacagctc

SEQ ID NO: 261 - DNA, 25 bp, Artificial Sequence
  Synthetic oligonucleotide
uugaagcugagggagccacagcucc

SEQ ID NO: 262 - DNA, 25 bp, Artificial Sequence
  Synthetic oligonucleotide
ugaagcugagggagccacagcucct

SEQ ID NO: 263 - DNA, 25 bp, Artificial Sequence
  Synthetic oligonucleotide
uuccgaaugucugaggacaagccac

SEQ ID NO: 264 - DNA, 25 bp, Artificial Sequence
  Synthetic oligonucleotide
uccgaaugucugaggacaagccaca

SEQ ID NO: 265 - DNA, 25 bp, Artificial Sequence
  Synthetic oligonucleotide
ccgaaugucugaggacaagccacaa

SEQ ID NO: 266 - DNA, 25 bp, Artificial Sequence
  Synthetic oligonucleotide
cgaaugucugaggacaagccacaag

SEQ ID NO: 267 - DNA, 25 bp, Artificial Sequence
  Synthetic oligonucleotide
gaaugucugaggacaagccacaaga

SEQ ID NO: 268 - DNA, 25 bp, Artificial Sequence
  Synthetic oligonucleotide
aaugucugaggacaagccacaagat

SEQ ID NO: 269 - DNA, 25 bp, Artificial Sequence
  Synthetic oligonucleotide
augucugaggacaagccacaagatt

SEQ ID NO: 270 - DNA, 25 bp, Artificial Sequence
  Synthetic oligonucleotide
ugucugaggacaagccacaagauta

SEQ ID NO: 271 - DNA, 25 bp, Artificial Sequence
  Synthetic oligonucleotide
acagagccaauggcuuggaaugaga

SEQ ID NO: 272 - DNA, 25 bp, Artificial Sequence
  Synthetic oligonucleotide
cagagccaauggcuuggaaugagac

SEQ ID NO: 273 - DNA, 25 bp, Artificial Sequence
  Synthetic oligonucleotide
agagccaauggcuuggaaugagact

SEQ ID NO: 274 - DNA, 25 bp, Artificial Sequence
  Synthetic oligonucleotide
gagccaauggcuuggaaugagactg

SEQ ID NO: 275 - DNA, 25 bp, Artificial Sequence
  Synthetic oligonucleotide
agccaauggcuuggaaugagacugc

SEQ ID NO: 276 - DNA, 25 bp, Artificial Sequence
  Synthetic oligonucleotide
gccaauggcuuggaaugagacugct

SEQ ID NO: 277 - DNA, 25 bp, Artificial Sequence
  Synthetic oligonucleotide
ccaauggcuuggaaugagacugctg

SEQ ID NO: 278 - DNA, 25 bp, Artificial Sequence
  Synthetic oligonucleotide
caauggcuuggaaugagacugcuga

SEQ ID NO: 279 - DNA, 25 bp, Artificial Sequence
  Synthetic oligonucleotide
aauggcuuggaaugagacugcugat

SEQ ID NO: 280 - DNA, 25 bp, Artificial Sequence
  Synthetic oligonucleotide
auggcuuggaaugagacugcugatc

SEQ ID NO: 281 - DNA, 25 bp, Artificial Sequence
  Synthetic oligonucleotide
uggcuuggaaugagacugcugauct

SEQ ID NO: 282 - DNA, 25 bp, Artificial Sequence
  Synthetic oligonucleotide
cuuggauaucgccaggaugauccta

SEQ ID NO: 283 - DNA, 25 bp, Artificial Sequence
  Synthetic oligonucleotide
uuggauaucgccaggaugauccuag

SEQ ID NO: 284 - DNA, 25 bp, Artificial Sequence
  Synthetic oligonucleotide
uggauaucgccaggaugauccuagc

SEQ ID NO: 285 - DNA, 25 bp, Artificial Sequence
  Synthetic oligonucleotide
ggauaucgccaggaugauccuagct

SEQ ID NO: 286 - DNA, 25 bp, Artificial Sequence
  Synthetic oligonucleotide
gauaucgccaggaugauccuagcta

SEQ ID NO: 287 - DNA, 25 bp, Artificial Sequence
  Synthetic oligonucleotide
cguucuuuucacucugguggauatg

SEQ ID NO: 288 - DNA, 25 bp, Artificial Sequence
  Synthetic oligonucleotide
guucuuuucacucugguggauaugg

SEQ ID NO: 289 - DNA, 25 bp, Artificial Sequence
  Synthetic oligonucleotide
uucuuuucacucugguggauauggc

SEQ ID NO: 290 - DNA, 25 bp, Artificial Sequence
  Synthetic oligonucleotide
ucuuuucacucugguggauauggcc

SEQ ID NO: 291 - DNA, 25 bp, Artificial Sequence
  Synthetic oligonucleotide
cuuuucacucugguggauauggcca

SEQ ID NO: 292 - DNA, 25 bp, Artificial Sequence
  Synthetic oligonucleotide
caugagauggguggccaccaccctg

SEQ ID NO: 293 - DNA, 25 bp, Artificial Sequence
  Synthetic oligonucleotide
augagauggguggccaccacccugg

SEQ ID NO: 294 - DNA, 25 bp, Artificial Sequence
  Synthetic oligonucleotide
ugagauggguggccaccacccuggt

SEQ ID NO: 295 - DNA, 25 bp, Artificial Sequence
  Synthetic oligonucleotide
gagauggguggccaccacccuggtg

SEQ ID NO: 296 - DNA, 25 bp, Artificial Sequence
  Synthetic oligonucleotide
agauggguggccaccacccuggugc

SEQ ID NO: 297 - DNA, 25 bp, Artificial Sequence
  Synthetic oligonucleotide
gauggguggccaccacccuggugct

SEQ ID NO: 298 - DNA, 25 bp, Artificial Sequence
  Synthetic oligonucleotide
auggguggccaccacccuggugctg

SEQ ID NO: 299 - DNA, 25 bp, Artificial Sequence
  Synthetic oligonucleotide
uggguggccaccacccuggugcuga

SEQ ID NO: 300 - DNA, 25 bp, Artificial Sequence
  Synthetic oligonucleotide
ggguggccaccacccuggugcugac

SEQ ID NO: 301 - DNA, 25 bp, Artificial Sequence
  Synthetic oligonucleotide
gguggccaccacccuggugcugact

SEQ ID NO: 302 - DNA, 25 bp, Artificial Sequence
  Synthetic oligonucleotide
guggccaccacccuggugcugacta

SEQ ID NO: 303 - DNA, 25 bp, Artificial Sequence
  Synthetic oligonucleotide
uggccaccacccuggugcugacuat

SEQ ID NO: 304 - DNA, 25 bp, Artificial Sequence
  Synthetic oligonucleotide
ggccaccacccuggugcugacuatc

SEQ ID NO: 305 - DNA, 25 bp, Artificial Sequence
  Synthetic oligonucleotide
gccaccacccuggugcugacuaucc

SEQ ID NO: 306 - DNA, 25 bp, Artificial Sequence
  Synthetic oligonucleotide
ccaccacccuggugcugacuaucca

SEQ ID NO: 307 - DNA, 25 bp, Artificial Sequence
  Synthetic oligonucleotide
caccacccuggugcugacuauccag

SEQ ID NO: 308 - DNA, 25 bp, Artificial Sequence
  Synthetic oligonucleotide
accacccuggugcugacuauccagt

SEQ ID NO: 309 - DNA, 25 bp, Artificial Sequence
  Synthetic oligonucleotide
ccacccuggugcugacuauccagtt

SEQ ID NO: 310 - DNA, 25 bp, Artificial Sequence
  Synthetic oligonucleotide
cacccuggugcugacuauccagutg

SEQ ID NO: 311 - DNA, 25 bp, Artificial Sequence
  Synthetic oligonucleotide
acccuggugcugacuauccaguuga

SEQ ID NO: 312 - DNA, 25 bp, Artificial Sequence
  Synthetic oligonucleotide
cccuggugcugacuauccaguugat

SEQ ID NO: 313 - DNA, 25 bp, Artificial Sequence
  Synthetic oligonucleotide
ccuggugcugacuauccaguugatg

SEQ ID NO: 314 - DNA, 25 bp, Artificial Sequence
  Synthetic oligonucleotide
cuggugcugacuauccaguugaugg

SEQ ID NO: 315 - DNA, 25 bp, Artificial Sequence
  Synthetic oligonucleotide
uggugcugacuauccaguugauggg

SEQ ID NO: 316 - DNA, 25 bp, Artificial Sequence
  Synthetic oligonucleotide
ggugcugacuauccaguugaugggc

SEQ ID NO: 317 - DNA, 25 bp, Artificial Sequence
  Synthetic oligonucleotide
gugcugacuauccaguugaugggct

SEQ ID NO: 318 - DNA, 25 bp, Artificial Sequence
  Synthetic oligonucleotide
ugcugacuauccaguugaugggctg

SEQ ID NO: 319 - DNA, 25 bp, Artificial Sequence
  Synthetic oligonucleotide
gcugacuauccaguugaugggcugc

SEQ ID NO: 320 - DNA, 25 bp, Artificial Sequence
  Synthetic oligonucleotide
cugacuauccaguugaugggcugcc

SEQ ID NO: 321 - DNA, 25 bp, Artificial Sequence
  Synthetic oligonucleotide
ugacuauccaguugaugggcugcca

SEQ ID NO: 322 - DNA, 25 bp, Artificial Sequence
  Synthetic oligonucleotide
gacuauccaguugaugggcugccag

SEQ ID NO: 323 - DNA, 25 bp, Artificial Sequence
  Synthetic oligonucleotide
acuauccaguugaugggcugccaga

SEQ ID NO: 324 - DNA, 25 bp, Artificial Sequence
  Synthetic oligonucleotide
cuauccaguugaugggcugccagat

SEQ ID NO: 325 - DNA, 25 bp, Artificial Sequence
  Synthetic oligonucleotide
uauccaguugaugggcugccagatc

SEQ ID NO: 326 - DNA, 25 bp, Artificial Sequence
  Synthetic oligonucleotide
auccaguugaugggcugccagauct

SEQ ID NO: 327 - DNA, 25 bp, Artificial Sequence
  Synthetic oligonucleotide
gcccaggaccucauggaugggcugc

SEQ ID NO: 328 - DNA, 25 bp, Artificial Sequence
  Synthetic oligonucleotide
cccaggaccucauggaugggcugcc

SEQ ID NO: 329 - DNA, 25 bp, Artificial Sequence
  Synthetic oligonucleotide
ccaggaccucauggaugggcugcct

SEQ ID NO: 330 - DNA, 25 bp, Artificial Sequence
  Synthetic oligonucleotide
agcaaucagcuggccugguuugata

SEQ ID NO: 331 - DNA, 25 bp, Artificial Sequence
  Synthetic oligonucleotide
gcaaucagcuggccugguuugauac

SEQ ID NO: 332 - DNA, 25 bp, Artificial Sequence
  Synthetic oligonucleotide
caaucagcuggccugguuugauact

SEQ ID NO: 333 - DNA, 25 bp, Artificial Sequence
  Synthetic oligonucleotide
aaucagcuggccugguuugauactg

SEQ ID NO: 334 - DNA, 25 bp, Artificial Sequence
  Synthetic oligonucleotide
aucagcuggccugguuugauacuga

SEQ ID NO: 335 - DNA, 25 bp, Artificial Sequence
  Synthetic oligonucleotide
ucagcuggccugguuugauacugac

SEQ ID NO: 336 - DNA, 25 bp, Artificial Sequence
  Synthetic oligonucleotide
cagcuggccugguuugauacugacc

SEQ ID NO: 337 - DNA, 25 bp, Artificial Sequence
  Synthetic oligonucleotide
agcuggccugguuugauacugacct

SEQ ID NO: 338 - DNA, 25 bp, Artificial Sequence
  Synthetic oligonucleotide
gcuggccugguuugauacugacctg

SEQ ID NO: 339 - DNA, 25 bp, Artificial Sequence
  Synthetic oligonucleotide
cuggccugguuugauacugaccugt

SEQ ID NO: 340 - DNA, 25 bp, Artificial Sequence
  Synthetic oligonucleotide
uggccugguuugauacugaccugta

SEQ ID NO: 341 - DNA, 25 bp, Artificial Sequence
  Synthetic oligonucleotide
ggccugguuugauacugaccuguaa

SEQ ID NO: 342 - DNA, 25 bp, Artificial Sequence
  Synthetic oligonucleotide
gccugguuugauacugaccuguaaa

SEQ ID NO: 343 - DNA, 25 bp, Artificial Sequence
  Synthetic oligonucleotide
ccugguuugauacugaccuguaaat

SEQ ID NO: 344 - DNA, 25 bp, Artificial Sequence
  Synthetic oligonucleotide
cugguuugauacugaccuguaaatc

SEQ ID NO: 345 - DNA, 25 bp, Artificial Sequence
  Synthetic oligonucleotide
ugguuugauacugaccuguaaauca

SEQ ID NO: 346 - DNA, 25 bp, Artificial Sequence
  Synthetic oligonucleotide
gguuugauacugaccuguaaaucat

SEQ ID NO: 347 - DNA, 25 bp, Artificial Sequence
  Synthetic oligonucleotide
guuugauacugaccuguaaaucatc

SEQ ID NO: 348 - DNA, 25 bp, Artificial Sequence
  Synthetic oligonucleotide
uuugauacugaccuguaaaucaucc

SEQ ID NO: 349 - DNA, 25 bp, Artificial Sequence
  Synthetic oligonucleotide
uugauacugaccuguaaaucaucct

SEQ ID NO: 350 - DNA, 25 bp, Artificial Sequence
  Synthetic oligonucleotide
ugauacugaccuguaaaucaucctt

SEQ ID NO: 351 - DNA, 25 bp, Artificial Sequence
  Synthetic oligonucleotide
uuuugccacagcuuuugcaacuuaa

SEQ ID NO: 352 - DNA, 25 bp, Artificial Sequence
  Synthetic oligonucleotide
ugaguaacauuugcuguuuuaaaca

SEQ ID NO: 353 - DNA, 25 bp, Artificial Sequence
  Synthetic oligonucleotide
aacauuaauagcagccuuucucuct

SEQ ID NO: 354 - DNA, 25 bp, Artificial Sequence
  Synthetic oligonucleotide
cauuaauagcagccuuucucucutt

SEQ ID NO: 355 - DNA, 25 bp, Artificial Sequence
  Synthetic oligonucleotide
uuaauagcagccuuucucucuuuat

SEQ ID NO: 356 - DNA, 25 bp, Artificial Sequence
  Synthetic oligonucleotide
aauagcagccuuucucucuuuauac

SEQ ID NO: 357 - DNA, 25 bp, Artificial Sequence
  Synthetic oligonucleotide
gcauugugauuggccuguagagutg

SEQ ID NO: 358 - DNA, 25 bp, Artificial Sequence
  Synthetic oligonucleotide
auugugauuggccuguagaguugct

SEQ ID NO: 359 - DNA, 25 bp, Artificial Sequence
  Synthetic oligonucleotide
ugugauuggccuguagaguugcuga

SEQ ID NO: 360 - DNA, 25 bp, Artificial Sequence
  Synthetic oligonucleotide
ugauuggccuguagaguugcugaga

SEQ ID NO: 361 - DNA, 25 bp, Artificial Sequence
  Synthetic oligonucleotide
auuggccuguagaguugcugagagg

SEQ ID NO: 362 - DNA, 25 bp, Artificial Sequence
  Synthetic oligonucleotide
uggccuguagaguugcugagagggc

SEQ ID NO: 363 - DNA, 25 bp, Artificial Sequence
  Synthetic oligonucleotide
gccuguagaguugcugagagggctc

SEQ ID NO: 364 - DNA, 25 bp, Artificial Sequence
  Synthetic oligonucleotide
cuguagaguugcugagagggcucga

SEQ ID NO: 365 - DNA, 25 bp, Artificial Sequence
  Synthetic oligonucleotide
guagaguugcugagagggcucgagg

SEQ ID NO: 366 - DNA, 25 bp, Artificial Sequence
  Synthetic oligonucleotide
gugggcugguaucucagaaagugcc

SEQ ID NO: 367 - DNA, 25 bp, Artificial Sequence
  Synthetic oligonucleotide
gggcugguaucucagaaagugcctg

SEQ ID NO: 368 - DNA, 25 bp, Artificial Sequence
  Synthetic oligonucleotide
gcugguaucucagaaagugccugac

SEQ ID NO: 369 - DNA, 25 bp, Artificial Sequence
  Synthetic oligonucleotide
ugguaucucagaaagugccugacac

SEQ ID NO: 370 - DNA, 25 bp, Artificial Sequence
  Synthetic oligonucleotide
acuaaccaagcugaguuuccuaugg

SEQ ID NO: 371 - DNA, 25 bp, Artificial Sequence
  Synthetic oligonucleotide
uaaccaagcugaguuuccuauggga

SEQ ID NO: 372 - DNA, 25 bp, Artificial Sequence
  Synthetic oligonucleotide
accaagcugaguuuccuaugggaac

SEQ ID NO: 373 - DNA, 25 bp, Artificial Sequence
  Synthetic oligonucleotide
caagcugaguuuccuaugggaacaa

SEQ ID NO: 374 - DNA, 25 bp, Artificial Sequence
  Synthetic oligonucleotide
agcugaguuuccuaugggaacaatt

SEQ ID NO: 375 - DNA, 25 bp, Artificial Sequence
  Synthetic oligonucleotide
cugaguuuccuaugggaacaauuga

SEQ ID NO: 376 - DNA, 25 bp, Artificial Sequence
  Synthetic oligonucleotide
cuuuuuguucugguccuuuuuggtc

SEQ ID NO: 377 - DNA, 25 bp, Artificial Sequence
  Synthetic oligonucleotide
uuuuguucugguccuuuuuggucga

SEQ ID NO: 378 - DNA, 25 bp, Artificial Sequence
  Synthetic oligonucleotide
uuguucugguccuuuuuggucgagg

SEQ ID NO: 379 - DNA, 25 bp, Artificial Sequence
  Synthetic oligonucleotide
guucugguccuuuuuggucgaggag

SEQ ID NO: 380 - DNA, 25 bp, Artificial Sequence
  Synthetic oligonucleotide
ucugguccuuuuuggucgaggagta

SEQ ID NO: 381 - DNA, 25 bp, Artificial Sequence
  Synthetic oligonucleotide
ugguccuuuuuggucgaggaguaac

SEQ ID NO: 382 - DNA, 25 bp, Artificial Sequence
  Synthetic oligonucleotide
guccuuuuuggucgaggaguaacaa

SEQ ID NO: 383 - DNA, 25 bp, Artificial Sequence
  Synthetic oligonucleotide
ccuuuuuggucgaggaguaacaata

SEQ ID NO: 384 - DNA, 25 bp, Artificial Sequence
  Synthetic oligonucleotide
uuuuuggucgaggaguaacaauaca

SEQ ID NO: 385 - DNA, 25 bp, Artificial Sequence
  Synthetic oligonucleotide
uuuggucgaggaguaacaauacaaa

SEQ ID NO: 386 - DNA, 25 bp, Artificial Sequence
  Synthetic oligonucleotide
uggucgaggaguaacaauacaaatg

SEQ ID NO: 387 - DNA, 25 bp, Artificial Sequence
  Synthetic oligonucleotide
gucgaggaguaacaauacaaaugga

SEQ ID NO: 388 - DNA, 25 bp, Artificial Sequence
  Synthetic oligonucleotide
cgaggaguaacaauacaaauggatt

SEQ ID NO: 389 - DNA, 25 bp, Artificial Sequence
  Synthetic oligonucleotide
aggaguaacaauacaaauggauutt

SEQ ID NO: 390 - DNA, 25 bp, Artificial Sequence
  Synthetic oligonucleotide
gaguaacaauacaaauggauuuugg

SEQ ID NO: 391 - DNA, 25 bp, Artificial Sequence
  Synthetic oligonucleotide
uaucaaacccuagccuugcuuguta

SEQ ID NO: 392 - DNA, 25 bp, Artificial Sequence
  Synthetic oligonucleotide
ucaaacccuagccuugcuuguuaaa

SEQ ID NO: 393 - DNA, 25 bp, Artificial Sequence
  Synthetic oligonucleotide
aaacccuagccuugcuuguuaaatt

SEQ ID NO: 394 - DNA, 25 bp, Artificial Sequence
  Synthetic oligonucleotide
gaguaaugguguagaacacuaautc

SEQ ID NO: 395 - DNA, 25 bp, Artificial Sequence
  Synthetic oligonucleotide
guaaugguguagaacacuaauucat

SEQ ID NO: 396 - DNA, 25 bp, Artificial Sequence
  Synthetic oligonucleotide
aaugguguagaacacuaauucauaa

SEQ ID NO: 397 - DNA, 25 bp, Artificial Sequence
  Synthetic oligonucleotide
ugguguagaacacuaauucauaatc

SEQ ID NO: 398 - DNA, 25 bp, Artificial Sequence
  Synthetic oligonucleotide
guguagaacacuaauucauaaucac

SEQ ID NO: 399 - DNA, 25 bp, Artificial Sequence
  Synthetic oligonucleotide
guagaacacuaauucauaaucactc

SEQ ID NO: 400 - DNA, 25 bp, Artificial Sequence
  Synthetic oligonucleotide
agaacacuaauucauaaucacucta

SEQ ID NO: 401 - DNA, 25 bp, Artificial Sequence
  Synthetic oligonucleotide
aacacuaauucauaaucacucuaat

SEQ ID NO: 402 - DNA, 25 bp, Artificial Sequence
  Synthetic oligonucleotide
uuaguuuccuuuuuaauaugcuuaa

SEQ ID NO: 403 - DNA, 25 bp, Artificial Sequence
  Synthetic oligonucleotide
aguuuccuuuuuaauaugcuuaaaa

SEQ ID NO: 404 - DNA, 25 bp, Artificial Sequence
  Synthetic oligonucleotide
uuuccuuuuuaauaugcuuaaaata

SEQ ID NO: 405 - DNA, 25 bp, Artificial Sequence
  Synthetic oligonucleotide
uccuuuuuaauaugcuuaaaauaag

SEQ ID NO: 406 - DNA, 25 bp, Artificial Sequence
  Synthetic oligonucleotide
cuuuuuaauaugcuuaaaauaagca

SEQ ID NO: 407 - DNA, 25 bp, Artificial Sequence
  Synthetic oligonucleotide
uuuuuaauaugcuuaaaauaagcag

SEQ ID NO: 408 - DNA, 25 bp, Artificial Sequence
  Synthetic oligonucleotide
uuuuaauaugcuuaaaauaagcagg

SEQ ID NO: 409 - DNA, 25 bp, Artificial Sequence
  Synthetic oligonucleotide
uuaauaugcuuaaaauaagcaggtg

SEQ ID NO: 410 - DNA, 25 bp, Artificial Sequence
  Synthetic oligonucleotide
aauaugcuuaaaauaagcaggugga

SEQ ID NO: 411 - DNA, 25 bp, Artificial Sequence
  Synthetic oligonucleotide
uaugcuuaaaauaagcagguggatc

SEQ ID NO: 412 - DNA, 25 bp, Artificial Sequence
  Synthetic oligonucleotide
ugcuuaaaauaagcagguggaucta

SEQ ID NO: 413 - DNA, 25 bp, Artificial Sequence
  Synthetic oligonucleotide
cuuaaaauaagcagguggaucuatt

SEQ ID NO: 414 - DNA, 25 bp, Artificial Sequence
  Synthetic oligonucleotide
uaaaauaagcagguggaucuauutc

SEQ ID NO: 415 - DNA, 25 bp, Artificial Sequence
  Synthetic oligonucleotide
aaauaagcagguggaucuauuucat

SEQ ID NO: 416 - DNA, 25 bp, Artificial Sequence
  Synthetic oligonucleotide
auaagcagguggaucuauuucaugt

SEQ ID NO: 417 - DNA, 25 bp, Artificial Sequence
  Synthetic oligonucleotide
aagcagguggaucuauuucaugutt

SEQ ID NO: 418 - DNA, 25 bp, Artificial Sequence
  Synthetic oligonucleotide
gcagguggaucuauuucauguuutt

SEQ ID NO: 419 - DNA, 25 bp, Artificial Sequence
  Synthetic oligonucleotide
agguggaucuauuucauguuuuuga

SEQ ID NO: 420 - DNA, 25 bp, Artificial Sequence
  Synthetic oligonucleotide
guggaucuauuucauguuuuugatc

SEQ ID NO: 421 - DNA, 25 bp, Artificial Sequence
  Synthetic oligonucleotide
ggaucuauuucauguuuuugaucaa

SEQ ID NO: 422 - DNA, 25 bp, Artificial Sequence
  Synthetic oligonucleotide
aucuauuucauguuuuugaucaaaa

SEQ ID NO: 423 - DNA, 25 bp, Artificial Sequence
  Synthetic oligonucleotide
guaggguaaaucaguaagaggugtt

SEQ ID NO: 424 - DNA, 25 bp, Artificial Sequence
  Synthetic oligonucleotide
aggguaaaucaguaagagguguuat

SEQ ID NO: 425 - DNA, 25 bp, Artificial Sequence
  Synthetic oligonucleotide
gguaaaucaguaagagguguuautt

SEQ ID NO: 426 - DNA, 25 bp, Artificial Sequence
  Synthetic oligonucleotide
uaaaucaguaagagguguuauuugg

SEQ ID NO: 427 - DNA, 25 bp, Artificial Sequence
  Synthetic oligonucleotide
aaucaguaagagguguuauuuggaa

SEQ ID NO: 428 - DNA, 25 bp, Artificial Sequence
  Synthetic oligonucleotide
ucaguaagagguguuauuuggaacc

SEQ ID NO: 429 - DNA, 25 bp, Artificial Sequence
  Synthetic oligonucleotide
uaccaguugccuuuuaucccaaagt

SEQ ID NO: 430 - DNA, 25 bp, Artificial Sequence
  Synthetic oligonucleotide
ccaguugccuuuuaucccaaagutg

SEQ ID NO: 431 - DNA, 25 bp, Artificial Sequence
  Synthetic oligonucleotide
aguugccuuuuaucccaaaguugtt

SEQ ID NO: 432 - DNA, 25 bp, Artificial Sequence
  Synthetic oligonucleotide
uugccuuuuaucccaaaguuguugt

SEQ ID NO: 433 - DNA, 25 bp, Artificial Sequence
  Synthetic oligonucleotide
gccuuuuaucccaaaguuguuguaa

SEQ ID NO: 434 - DNA, 25 bp, Artificial Sequence
  Synthetic oligonucleotide
cuuuuaucccaaaguuguuguaacc

SEQ ID NO: 435 - DNA, 25 bp, Artificial Sequence
  Synthetic oligonucleotide
uuuaucccaaaguuguuguaacctg

SEQ ID NO: 436 - DNA, 25 bp, Artificial Sequence
  Synthetic oligonucleotide
uaucccaaaguuguuguaaccugct

SEQ ID NO: 437 - DNA, 25 bp, Artificial Sequence
  Synthetic oligonucleotide
ucccaaaguuguuguaaccugcugt

SEQ ID NO: 438 - DNA, 25 bp, Artificial Sequence
  Synthetic oligonucleotide
ccaaaguuguuguaaccugcuguga

SEQ ID NO: 439 - DNA, 25 bp, Artificial Sequence
  Synthetic oligonucleotide
aaaguuguuguaaccugcugugata

SEQ ID NO: 440 - DNA, 25 bp, Artificial Sequence
  Synthetic oligonucleotide
aguuguuguaaccugcugugauacg

SEQ ID NO: 441 - DNA, 25 bp, Artificial Sequence
  Synthetic oligonucleotide
uuguuguaaccugcugugauacgat

SEQ ID NO: 442 - DNA, 25 bp, Artificial Sequence
  Synthetic oligonucleotide
guuguaaccugcugugauacgaugc

SEQ ID NO: 443 - DNA, 25 bp, Artificial Sequence
  Synthetic oligonucleotide
aaaugguucagaauuaaacuuuuaa

SEQ ID NO: 444 - DNA, 25 bp, Artificial Sequence
  Synthetic oligonucleotide
augguucagaauuaaacuuuuaatt

SEQ ID NO: 445 - DNA, 25 bp, Artificial Sequence
  Synthetic oligonucleotide
gguucagaauuaaacuuuuaauuca

SEQ ID NO: 446 - DNA, 25 bp, Artificial Sequence
  Synthetic oligonucleotide
uucagaauuaaacuuuuaauucatt

SEQ ID NO: 447 - DNA, 25 bp, Artificial Sequence
  Synthetic oligonucleotide
cagaauuaaacuuuuaauucauucg

SEQ ID NO: 448 - DNA, 25 bp, Artificial Sequence
  Synthetic oligonucleotide
gcagcagucuuacuuggauucugga

SEQ ID NO: 449 - DNA, 25 bp, Artificial Sequence
  Synthetic oligonucleotide
acuuggauucuggaauccauucugg

SEQ ID NO: 450 - DNA, 25 bp, Artificial Sequence
  Synthetic oligonucleotide
gacaccucccaaguccuuuaugaat

SEQ ID NO: 451 - DNA, 25 bp, Artificial Sequence
  Synthetic oligonucleotide
cgcaagagcaaguagcugauauuga

SEQ ID NO: 452 - DNA, 25 bp, Artificial Sequence
  Synthetic oligonucleotide
ccauguucccugagacgcuagauga

SEQ ID NO: 453 - DNA, 25 bp, Artificial Sequence
  Synthetic oligonucleotide
ugaaacaugcaguugucaauuugat

SEQ ID NO: 454 - DNA, 25 bp, Artificial Sequence
  Synthetic oligonucleotide
caugcaguugucaauuugauuaact

SEQ ID NO: 455 - DNA, 25 bp, Artificial Sequence
  Synthetic oligonucleotide
guugucaauuugauuaacuaucagg

SEQ ID NO: 456 - DNA, 25 bp, Artificial Sequence
  Synthetic oligonucleotide
gaggaccaggugguaguuaauaaag

SEQ ID NO: 457 - DNA, 25 bp, Artificial Sequence
  Synthetic oligonucleotide
ggucaccaguggauucuguacugtt

SEQ ID NO: 458 - DNA, 25 bp, Artificial Sequence
  Synthetic oligonucleotide
caguggauucuguacuguucuacgc

SEQ ID NO: 459 - DNA, 25 bp, Artificial Sequence
  Synthetic oligonucleotide
gauucuguacuguucuacgccauca

SEQ ID NO: 460 - DNA, 25 bp, Artificial Sequence
  Synthetic oligonucleotide
guggacugcagaaaaugguugcutt

SEQ ID NO: 461 - DNA, 25 bp, Artificial Sequence
  Synthetic oligonucleotide
cgugaaauucuuggcuauuacaaca

SEQ ID NO: 462 - DNA, 25 bp, Artificial Sequence
  Synthetic oligonucleotide
caagucagcgacuuguucaaaactg

SEQ ID NO: 463 - DNA, 25 bp, Artificial Sequence
  Synthetic oligonucleotide
gacuuguucaaaacugucuuuggac

SEQ ID NO: 464 - DNA, 25 bp, Artificial Sequence
  Synthetic oligonucleotide
aaacugucuuuggacucucagaaac

SEQ ID NO: 465 - DNA, 25 bp, Artificial Sequence
  Synthetic oligonucleotide
cucuaaccucacuugcaauaauuac

SEQ ID NO: 466 - DNA, 25 bp, Artificial Sequence
  Synthetic oligonucleotide
cucacuugcaauaauuacaaaaaca

SEQ ID NO: 467 - DNA, 25 bp, Artificial Sequence
  Synthetic oligonucleotide
gaaugccguucgccuucauuaugga

SEQ ID NO: 468 - DNA, 25 bp, Artificial Sequence
  Synthetic oligonucleotide
gccuucauuauggacugccuguugt

SEQ ID NO: 469 - DNA, 25 bp, Artificial Sequence
  Synthetic oligonucleotide
cauuauggacugccuguugugguta

SEQ ID NO: 470 - DNA, 25 bp, Artificial Sequence
  Synthetic oligonucleotide
gacugccuguugugguuaaacucct

SEQ ID NO: 471 - DNA, 25 bp, Artificial Sequence
  Synthetic oligonucleotide
aacuguuggauugauucgaaacctt

SEQ ID NO: 472 - DNA, 25 bp, Artificial Sequence
  Synthetic oligonucleotide
gaggacucaauaccauuccauugtt

SEQ ID NO: 473 - DNA, 25 bp, Artificial Sequence
  Synthetic oligonucleotide
gaggacaagccacaggauuacaaga

SEQ ID NO: 474 - DNA, 25 bp, Artificial Sequence
  Synthetic oligonucleotide
auggacccuaugauggagcaugaga

SEQ ID NO: 475 - DNA, 25 bp, Artificial Sequence
  Synthetic oligonucleotide
gauacugaccuguaaaucguccutt

SEQ ID NO: 476 - DNA, 25 bp, Artificial Sequence
  Synthetic oligonucleotide
ccagugugggugaauacuuuacuct

SEQ ID NO: 477 - DNA, 25 bp, Artificial Sequence
  Synthetic oligonucleotide
ccacagcuuuugcagcguuauactc

SEQ ID NO: 478 - DNA, 25 bp, Artificial Sequence
  Synthetic oligonucleotide
uuuugcagcguuauacucagaugag

SEQ ID NO: 479 - DNA, 25 bp, Artificial Sequence
  Synthetic oligonucleotide
gcguuauacucagaugaguaacatt

SEQ ID NO: 480 - DNA, 25 bp, Artificial Sequence
  Synthetic oligonucleotide
auuugcuguuuucaacauuaauagc

SEQ ID NO: 481 - DNA, 25 bp, Artificial Sequence
  Synthetic oligonucleotide
cuguagugucugaacgugcauugtg

SEQ ID NO: 482 - DNA, 25 bp, Artificial Sequence
  Synthetic oligonucleotide
gaacagucgaaguacgcuuuuugtt

SEQ ID NO: 483 - DNA, 25 bp, Artificial Sequence
  Synthetic oligonucleotide
gucgaaguacgcuuuuuguucuggt

SEQ ID NO: 484 - DNA, 25 bp, Artificial Sequence
  Synthetic oligonucleotide
guacgcuuuuuguucugguccuutt

SEQ ID NO: 485 - DNA, 25 bp, Artificial Sequence
  Synthetic oligonucleotide
ccuagccuugcuuguucuuuguutt

SEQ ID NO: 486 - DNA, 25 bp, Artificial Sequence
  Synthetic oligonucleotide
ccuugcuuguucuuuguuuuaauat

SEQ ID NO: 487 - DNA, 25 bp, Artificial Sequence
  Synthetic oligonucleotide
aaccugcuacagcaauuucugautt

SEQ ID NO: 488 - DNA, 25 bp, Artificial Sequence
  Synthetic oligonucleotide
cagcaauuucugauuucuaagaacc

SEQ ID NO: 489 - DNA, 25 bp, Artificial Sequence
  Synthetic oligonucleotide
guaagagguguuauuugagccuugt

SEQ ID NO: 490 - DNA, 25 bp, Artificial Sequence
  Synthetic oligonucleotide
gguguuauuugagccuuguuuugga

SEQ ID NO: 491 - DNA, 25 bp, Artificial Sequence
  Synthetic oligonucleotide
uauuugagccuuguuuuggacagta

SEQ ID NO: 492 - DNA, 25 bp, Artificial Sequence
  Synthetic oligonucleotide
gagccuuguuuuggacaguauacca

SEQ ID NO: 493 - DNA, 25 bp, Artificial Sequence
  Synthetic oligonucleotide
caacagaugcgguuauagaaauggt

SEQ ID NO: 494 - DNA, 25 bp, Artificial Sequence
  Synthetic oligonucleotide
guuauagaaaugguucagaauuaaa

SEQ ID NO: 495 - DNA, 25 bp, Artificial Sequence
  Synthetic oligonucleotide
agaaaugguucagaauuaaacuutt

SEQ ID NO: 496 - DNA, 25 bp, Artificial Sequence
  Synthetic oligonucleotide
uguaugguauacuucaaauaccctc

SEQ ID NO: 497 - DNA, 25 bp, Artificial Sequence
  Synthetic oligonucleotide
aaacaguuguaugguauacuucaaa

SEQ ID NO: 498 - DNA, 25 bp, Artificial Sequence
  Synthetic oligonucleotide
aaaacaguuguaugguauacuucaa

SEQ ID NO: 499 - DNA, 25 bp, Artificial Sequence
  Synthetic oligonucleotide
ucaaaacaguuguaugguauacutc

SEQ ID NO: 500 - DNA, 25 bp, Artificial Sequence
  Synthetic oligonucleotide
uucaaaacaguuguaugguauactt

SEQ ID NO: 501 - DNA, 25 bp, Artificial Sequence
  Synthetic oligonucleotide
uuucaaaacaguuguaugguauact

SEQ ID NO: 502 - DNA, 25 bp, Artificial Sequence
  Synthetic oligonucleotide
guccacgcuggauuuucaaaacagt

SEQ ID NO: 503 - DNA, 25 bp, Artificial Sequence
  Synthetic oligonucleotide
uguccacgcuggauuuucaaaacag

SEQ ID NO: 504 - DNA, 25 bp, Artificial Sequence
  Synthetic oligonucleotide
aucaaaucagcuugaguagccautg

SEQ ID NO: 505 - DNA, 25 bp, Artificial Sequence
  Synthetic oligonucleotide
uccaacuccaucaaaucagcuugag

SEQ ID NO: 506 - DNA, 25 bp, Artificial Sequence
  Synthetic oligonucleotide
uccucaggauugccuuuaccacuca

SEQ ID NO: 507 - DNA, 25 bp, Artificial Sequence
  Synthetic oligonucleotide
uuccucaggauugccuuuaccactc

SEQ ID NO: 508 - DNA, 25 bp, Artificial Sequence
  Synthetic oligonucleotide
ucaauaucagcuacuuguucuugag

SEQ ID NO: 509 - DNA, 25 bp, Artificial Sequence
  Synthetic oligonucleotide
aucaauaucagcuacuuguucuuga

SEQ ID NO: 510 - DNA, 25 bp, Artificial Sequence
  Synthetic oligonucleotide
uguccaucaauaucagcuacuugtt

SEQ ID NO: 511 - DNA, 25 bp, Artificial Sequence
  Synthetic oligonucleotide
ugcauacuguccaucaauaucagct

SEQ ID NO: 512 - DNA, 25 bp, Artificial Sequence
  Synthetic oligonucleotide
agucauugcauacuguccaucaata

SEQ ID NO: 513 - DNA, 25 bp, Artificial Sequence
  Synthetic oligonucleotide
ucaucuaaugucucagggaacauag

SEQ ID NO: 514 - DNA, 25 bp, Artificial Sequence
  Synthetic oligonucleotide
acaacugcauguuucagcaucugtg

SEQ ID NO: 515 - DNA, 25 bp, Artificial Sequence
  Synthetic oligonucleotide
uuacaacugcauguuucagcauctg

SEQ ID NO: 516 - DNA, 25 bp, Artificial Sequence
  Synthetic oligonucleotide
uuaaucaaguuuacaacugcaugtt

SEQ ID NO: 517 - DNA, 25 bp, Artificial Sequence
  Synthetic oligonucleotide
ugauaguuaaucaaguuuacaactg

SEQ ID NO: 518 - DNA, 25 bp, Artificial Sequence
  Synthetic oligonucleotide
gcaucaucuugauaguuaaucaagt

SEQ ID NO: 519 - DNA, 25 bp, Artificial Sequence
  Synthetic oligonucleotide
ugcaucaucuugauaguuaaucaag

SEQ ID NO: 520 - DNA, 25 bp, Artificial Sequence
  Synthetic oligonucleotide
gguccucgucauuuagcaguuuugt

SEQ ID NO: 521 - DNA, 25 bp, Artificial Sequence
  Synthetic oligonucleotide
uaacugcagccuuauuaaccaccac

SEQ ID NO: 522 - DNA, 25 bp, Artificial Sequence
  Synthetic oligonucleotide
auaacugcagccuuauuaaccacca

SEQ ID NO: 523 - DNA, 25 bp, Artificial Sequence
  Synthetic oligonucleotide
accauaacugcagccuuauuaacca

SEQ ID NO: 524 - DNA, 25 bp, Artificial Sequence
  Synthetic oligonucleotide
uuuuuagaaagcugauggaccauaa

SEQ ID NO: 525 - DNA, 25 bp, Artificial Sequence
  Synthetic oligonucleotide
gguacguacaauagcagacaccatc

SEQ ID NO: 526 - DNA, 25 bp, Artificial Sequence
  Synthetic oligonucleotide
ucauuuguauucugcaugguacgta

SEQ ID NO: 527 - DNA, 25 bp, Artificial Sequence
  Synthetic oligonucleotide
guuucuacaucauuuguauucugca

SEQ ID NO: 528 - DNA, 25 bp, Artificial Sequence
  Synthetic oligonucleotide
uguuucuacaucauuuguauucugc

SEQ ID NO: 529 - DNA, 25 bp, Artificial Sequence
  Synthetic oligonucleotide
acaacgagcuguuucuacaucautt

SEQ ID NO: 530 - DNA, 25 bp, Artificial Sequence
  Synthetic oligonucleotide
guacaacgagcuguuucuacaucat

SEQ ID NO: 531 - DNA, 25 bp, Artificial Sequence
  Synthetic oligonucleotide
gguacaacgagcuguuucuacauca

SEQ ID NO: 532 - DNA, 25 bp, Artificial Sequence
  Synthetic oligonucleotide
auaaaacaacacagaauccacuggt

SEQ ID NO: 533 - DNA, 25 bp, Artificial Sequence
  Synthetic oligonucleotide
gcauaaaacaacacagaauccactg

SEQ ID NO: 534 - DNA, 25 bp, Artificial Sequence
  Synthetic oligonucleotide
ggcauaaaacaacacagaauccact

SEQ ID NO: 535 - DNA, 25 bp, Artificial Sequence
  Synthetic oligonucleotide
gcuccuucuugauguaauaaaaggt

SEQ ID NO: 536 - DNA, 25 bp, Artificial Sequence
  Synthetic oligonucleotide
agcuccuucuugauguaauaaaagg

SEQ ID NO: 537 - DNA, 25 bp, Artificial Sequence
  Synthetic oligonucleotide
uaacauuuguuuuguugagcaaggc

SEQ ID NO: 538 - DNA, 25 bp, Artificial Sequence
  Synthetic oligonucleotide
gccaagaauuuaacauuuguuuugt

SEQ ID NO: 539 - DNA, 25 bp, Artificial Sequence
  Synthetic oligonucleotide
uaauagccaagaauuuaacauuugt

SEQ ID NO: 540 - DNA, 25 bp, Artificial Sequence
  Synthetic oligonucleotide
guaauagccaagaauuuaacauutg

SEQ ID NO: 541 - DNA, 25 bp, Artificial Sequence
  Synthetic oligonucleotide
agcuaaaauuugaaggcagucugtc

SEQ ID NO: 542 - DNA, 25 bp, Artificial Sequence
  Synthetic oligonucleotide
gguccucauuauauuuacuaaagct

SEQ ID NO: 543 - DNA, 25 bp, Artificial Sequence
  Synthetic oligonucleotide
guauagguccucauuauauuuacta

SEQ ID NO: 544 - DNA, 25 bp, Artificial Sequence
  Synthetic oligonucleotide
aguauagguccucauuauauuuact

SEQ ID NO: 545 - DNA, 25 bp, Artificial Sequence
  Synthetic oligonucleotide
uuuucguaaguauagguccucauta

SEQ ID NO: 546 - DNA, 25 bp, Artificial Sequence
  Synthetic oligonucleotide
uuuuucguaaguauagguccucatt

SEQ ID NO: 547 - DNA, 25 bp, Artificial Sequence
  Synthetic oligonucleotide
guuuuucguaaguauagguccucat

SEQ ID NO: 548 - DNA, 25 bp, Artificial Sequence
  Synthetic oligonucleotide
aguuuuucguaaguauagguccuca

SEQ ID NO: 549 - DNA, 25 bp, Artificial Sequence
  Synthetic oligonucleotide
gguccacaguaguuuuucguaagta

SEQ ID NO: 550 - DNA, 25 bp, Artificial Sequence
  Synthetic oligonucleotide
uacaauagccggcuuauuacuagag

SEQ ID NO: 551 - DNA, 25 bp, Artificial Sequence
  Synthetic oligonucleotide
ucuacaauagccggcuuauuacuag

SEQ ID NO: 552 - DNA, 25 bp, Artificial Sequence
  Synthetic oligonucleotide
uccuaaagcuugcauuccaccagct

SEQ ID NO: 553 - DNA, 25 bp, Artificial Sequence
  Synthetic oligonucleotide
guccuaaagcuugcauuccaccagc

SEQ ID NO: 554 - DNA, 25 bp, Artificial Sequence
  Synthetic oligonucleotide
aguccuaaagcuugcauuccaccag

SEQ ID NO: 555 - DNA, 25 bp, Artificial Sequence
  Synthetic oligonucleotide
guucugaacaagacguugacuugga

SEQ ID NO: 556 - DNA, 25 bp, Artificial Sequence
  Synthetic oligonucleotide
aguucugaacaagacguugacuugg

SEQ ID NO: 557 - DNA, 25 bp, Artificial Sequence
  Synthetic oligonucleotide
guccaaagacaguucugaacaagac

SEQ ID NO: 558 - DNA, 25 bp, Artificial Sequence
  Synthetic oligonucleotide
uuccuguuuaguugcagcaucugaa

SEQ ID NO: 559 - DNA, 25 bp, Artificial Sequence
  Synthetic oligonucleotide
acauuuauaucaucugaacccagaa

SEQ ID NO: 560 - DNA, 25 bp, Artificial Sequence
  Synthetic oligonucleotide
accacauuuauaucaucugaaccca

SEQ ID NO: 561 - DNA, 25 bp, Artificial Sequence
  Synthetic oligonucleotide
gcacaggugaccacauuuauaucat

SEQ ID NO: 562 - DNA, 25 bp, Artificial Sequence
  Synthetic oligonucleotide
ugcacaggugaccacauuuauauca

SEQ ID NO: 563 - DNA, 25 bp, Artificial Sequence
  Synthetic oligonucleotide
ugcaagugagguuagaaagaauucc

SEQ ID NO: 564 - DNA, 25 bp, Artificial Sequence
  Synthetic oligonucleotide
auaauuauugcaagugagguuagaa

SEQ ID NO: 565 - DNA, 25 bp, Artificial Sequence
  Synthetic oligonucleotide
ucaucuuguucuuauaauuauugca

SEQ ID NO: 566 - DNA, 25 bp, Artificial Sequence
  Synthetic oligonucleotide
aucaucuuguucuuauaauuauugc

SEQ ID NO: 567 - DNA, 25 bp, Artificial Sequence
  Synthetic oligonucleotide
accaucaucuuguucuuauaauuat

SEQ ID NO: 568 - DNA, 25 bp, Artificial Sequence
  Synthetic oligonucleotide
agaccaucaucuuguucuuauaatt

SEQ ID NO: 569 - DNA, 25 bp, Artificial Sequence
  Synthetic oligonucleotide
aauccaacaguagccuuuaucagag

SEQ ID NO: 570 - DNA, 25 bp, Artificial Sequence
  Synthetic oligonucleotide
gaaucaauccaacaguagccuuuat

SEQ ID NO: 571 - DNA, 25 bp, Artificial Sequence
  Synthetic oligonucleotide
uccacaaauugcugcugugucccac

SEQ ID NO: 572 - DNA, 25 bp, Artificial Sequence
  Synthetic oligonucleotide
acaaccuucaacuauuucuuccatg

SEQ ID NO: 573 - DNA, 25 bp, Artificial Sequence
  Synthetic oligonucleotide
uacaaccuucaacuauuucuuccat

SEQ ID NO: 574 - DNA, 25 bp, Artificial Sequence
  Synthetic oligonucleotide
guacaaccuucaacuauuucuucca

SEQ ID NO: 575 - DNA, 25 bp, Artificial Sequence
  Synthetic oligonucleotide
gguacaaccuucaacuauuucuucc

SEQ ID NO: 576 - DNA, 25 bp, Artificial Sequence
  Synthetic oligonucleotide
gcuccgguacaaccuucaacuautt

SEQ ID NO: 577 - DNA, 25 bp, Artificial Sequence
  Synthetic oligonucleotide
acaauucgguugugaacaucccgag

SEQ ID NO: 578 - DNA, 25 bp, Artificial Sequence
  Synthetic oligonucleotide
aacaauucgguugugaacaucccga

SEQ ID NO: 579 - DNA, 25 bp, Artificial Sequence
  Synthetic oligonucleotide
uaacaauucgguugugaacaucccg

SEQ ID NO: 580 - DNA, 25 bp, Artificial Sequence
  Synthetic oligonucleotide
auaacaauucgguugugaacauccc

SEQ ID NO: 581 - DNA, 25 bp, Artificial Sequence
  Synthetic oligonucleotide
gauaacaauucgguugugaacaucc

SEQ ID NO: 582 - DNA, 25 bp, Artificial Sequence
  Synthetic oligonucleotide
ugauaacaauucgguugugaacatc

SEQ ID NO: 583 - DNA, 25 bp, Artificial Sequence
  Synthetic oligonucleotide
auuuaguccucugauaacaauucgg

SEQ ID NO: 584 - DNA, 25 bp, Artificial Sequence
  Synthetic oligonucleotide
uauuuaguccucugauaacaauucg

SEQ ID NO: 585 - DNA, 25 bp, Artificial Sequence
  Synthetic oligonucleotide
guauuuaguccucugauaacaautc

SEQ ID NO: 586 - DNA, 25 bp, Artificial Sequence
  Synthetic oligonucleotide
gguauuuaguccucugauaacaatt

SEQ ID NO: 587 - DNA, 25 bp, Artificial Sequence
  Synthetic oligonucleotide
acaauggaaugguauuuaguccuct

SEQ ID NO: 588 - DNA, 25 bp, Artificial Sequence
  Synthetic oligonucleotide
acaaacaauggaaugguauuuagtc

SEQ ID NO: 589 - DNA, 25 bp, Artificial Sequence
  Synthetic oligonucleotide
gcacaaacaauggaaugguauuuag

SEQ ID NO: 590 - DNA, 25 bp, Artificial Sequence
  Synthetic oligonucleotide
ugcacaaacaauggaaugguauuta

SEQ ID NO: 591 - DNA, 25 bp, Artificial Sequence
  Synthetic oligonucleotide
gcuacucuuuggauguuuucaaugg

SEQ ID NO: 592 - DNA, 25 bp, Artificial Sequence
  Synthetic oligonucleotide
agcuacucuuuggauguuuucaatg

SEQ ID NO: 593 - DNA, 25 bp, Artificial Sequence
  Synthetic oligonucleotide
gcuucaauagcuucugcagcuucct

SEQ ID NO: 594 - DNA, 25 bp, Artificial Sequence
  Synthetic oligonucleotide
ucccucagcuucaauagcuucugca

SEQ ID NO: 595 - DNA, 25 bp, Artificial Sequence
  Synthetic oligonucleotide
gcucccucagcuucaauagcuuctg

SEQ ID NO: 596 - DNA, 25 bp, Artificial Sequence
  Synthetic oligonucleotide
auuccuagagugaaguaacucugtc

SEQ ID NO: 597 - DNA, 25 bp, Artificial Sequence
  Synthetic oligonucleotide
ucauuccuagagugaaguaacuctg

SEQ ID NO: 598 - DNA, 25 bp, Artificial Sequence
  Synthetic oligonucleotide
uucauuccuagagugaaguaacuct

SEQ ID NO: 599 - DNA, 25 bp, Artificial Sequence
  Synthetic oligonucleotide
uccucagacauucggaacaaaacag

SEQ ID NO: 600 - DNA, 25 bp, Artificial Sequence
  Synthetic oligonucleotide
uguccucagacauucggaacaaaac

SEQ ID NO: 601 - DNA, 25 bp, Artificial Sequence
  Synthetic oligonucleotide
guuucuuguaaucuuguggcuugtc

SEQ ID NO: 602 - DNA, 25 bp, Artificial Sequence
  Synthetic oligonucleotide
ugaaagccguuucuuguaaucuugt

SEQ ID NO: 603 - DNA, 25 bp, Artificial Sequence
  Synthetic oligonucleotide
gcucaacugaaagccguuucuugta

SEQ ID NO: 604 - DNA, 25 bp, Artificial Sequence
  Synthetic oligonucleotide
aguccaagaucagcagucucauucc

SEQ ID NO: 605 - DNA, 25 bp, Artificial Sequence
  Synthetic oligonucleotide
accaauaucaaguccaagaucagca

SEQ ID NO: 606 - DNA, 25 bp, Artificial Sequence
  Synthetic oligonucleotide
agaacgauagcuaggaucauccugg

SEQ ID NO: 607 - DNA, 25 bp, Artificial Sequence
  Synthetic oligonucleotide
uauccaccagagugaaaagaacgat

SEQ ID NO: 608 - DNA, 25 bp, Artificial Sequence
  Synthetic oligonucleotide
auuuacaggucaguaucaaaccagg

SEQ ID NO: 609 - DNA, 25 bp, Artificial Sequence
  Synthetic oligonucleotide
gauuuacaggucaguaucaaaccag

SEQ ID NO: 610 - DNA, 25 bp, Artificial Sequence
  Synthetic oligonucleotide
ugauuuacaggucaguaucaaacca

SEQ ID NO: 611 - DNA, 25 bp, Artificial Sequence
  Synthetic oligonucleotide
ucuuaccuaaaggaugauuuacagg

SEQ ID NO: 612 - DNA, 25 bp, Artificial Sequence
  Synthetic oligonucleotide
uucuuaccuaaaggaugauuuacag

SEQ ID NO: 613 - DNA, 25 bp, Artificial Sequence
  Synthetic oligonucleotide
acuucuuaccuaaaggaugauuuac

SEQ ID NO: 614 - DNA, 25 bp, Artificial Sequence
  Synthetic oligonucleotide
uuuuuaaaacuucuuaccuaaagga

SEQ ID NO: 615 - DNA, 25 bp, Artificial Sequence
  Synthetic oligonucleotide
gcuuuuuaaaacuucuuaccuaaag

SEQ ID NO: 616 - DNA, 25 bp, Artificial Sequence
  Synthetic oligonucleotide
aaacuggcuuuuuaaaacuucuuac

SEQ ID NO: 617 - DNA, 25 bp, Artificial Sequence
  Synthetic oligonucleotide
acccaaacuggcuuuuuaaaacutc

SEQ ID NO: 618 - DNA, 25 bp, Artificial Sequence
  Synthetic oligonucleotide
uacccaaacuggcuuuuuaaaactt

SEQ ID NO: 619 - DNA, 25 bp, Artificial Sequence
  Synthetic oligonucleotide
uuacccaaacuggcuuuuuaaaact

SEQ ID NO: 620 - DNA, 25 bp, Artificial Sequence
  Synthetic oligonucleotide
uuuacccaaacuggcuuuuuaaaac

SEQ ID NO: 621 - DNA, 25 bp, Artificial Sequence
  Synthetic oligonucleotide
aaccaagucuuucugaaguucugta

SEQ ID NO: 622 - DNA, 25 bp, Artificial Sequence
  Synthetic oligonucleotide
acccuaccaaccaagucuuucugaa

SEQ ID NO: 623 - DNA, 25 bp, Artificial Sequence
  Synthetic oligonucleotide
uuacaaauagccuaaaccacuccca

SEQ ID NO: 624 - DNA, 25 bp, Artificial Sequence
  Synthetic oligonucleotide
uuuacaaauagccuaaaccacuccc

SEQ ID NO: 625 - DNA, 25 bp, Artificial Sequence
  Synthetic oligonucleotide
auuuacaaauagccuaaaccacucc

SEQ ID NO: 626 - DNA, 25 bp, Artificial Sequence
  Synthetic oligonucleotide
gauuuacaaauagccuaaaccactc

SEQ ID NO: 627 - DNA, 25 bp, Artificial Sequence
  Synthetic oligonucleotide
uuuuuguggcagauuuacaaauagc

SEQ ID NO: 628 - DNA, 25 bp, Artificial Sequence
  Synthetic oligonucleotide
guuuuuguggcagauuuacaaauag

SEQ ID NO: 629 - DNA, 25 bp, Artificial Sequence
  Synthetic oligonucleotide
uguuuuuguggcagauuuacaaata

SEQ ID NO: 630 - DNA, 25 bp, Artificial Sequence
  Synthetic oligonucleotide
auaccuguuuuuguggcagauuuac

SEQ ID NO: 631 - DNA, 25 bp, Artificial Sequence
  Synthetic oligonucleotide
uucaaaguauauaccuguuuuugtg

SEQ ID NO: 632 - DNA, 25 bp, Artificial Sequence
  Synthetic oligonucleotide
ucuccuuucaaaguauauaccugtt

SEQ ID NO: 633 - DNA, 25 bp, Artificial Sequence
  Synthetic oligonucleotide
aucuccuuucaaaguauauaccugt

SEQ ID NO: 634 - DNA, 25 bp, Artificial Sequence
  Synthetic oligonucleotide
acaucuccuuucaaaguauauacct

SEQ ID NO: 635 - DNA, 25 bp, Artificial Sequence
  Synthetic oligonucleotide
gacaucuccuuucaaaguauauacc

SEQ ID NO: 636 - DNA, 25 bp, Artificial Sequence
  Synthetic oligonucleotide
agacaucuccuuucaaaguauauac

SEQ ID NO: 637 - DNA, 25 bp, Artificial Sequence
  Synthetic oligonucleotide
uuccaagacaucuccuuucaaagta

SEQ ID NO: 638 - DNA, 25 bp, Artificial Sequence
  Synthetic oligonucleotide
uuccaauguuccaagacaucucctt

SEQ ID NO: 639 - DNA, 25 bp, Artificial Sequence
  Synthetic oligonucleotide
auuccaauguuccaagacaucucct

SEQ ID NO: 640 - DNA, 25 bp, Artificial Sequence
  Synthetic oligonucleotide
acauuccaauguuccaagacauctc

SEQ ID NO: 641 - DNA, 25 bp, Artificial Sequence
  Synthetic oligonucleotide
agaaaucugagaacauuccaaugtt

SEQ ID NO: 642 - DNA, 25 bp, Artificial Sequence
  Synthetic oligonucleotide
aaccagaaaucugagaacauuccaa

SEQ ID NO: 643 - DNA, 25 bp, Artificial Sequence
  Synthetic oligonucleotide
acaaccagaaaucugagaacauucc

SEQ ID NO: 644 - DNA, 25 bp, Artificial Sequence
  Synthetic oligonucleotide
aacaaccagaaaucugagaacautc

SEQ ID NO: 645 - DNA, 25 bp, Artificial Sequence
  Synthetic oligonucleotide
uaacaaccagaaaucugagaacatt

SEQ ID NO: 646 - DNA, 25 bp, Artificial Sequence
  Synthetic oligonucleotide
aucacauaacaaccagaaaucugag

SEQ ID NO: 647 - DNA, 25 bp, Artificial Sequence
  Synthetic oligonucleotide
gaucacauaacaaccagaaaucuga

SEQ ID NO: 648 - DNA, 25 bp, Artificial Sequence
  Synthetic oligonucleotide
acacaugaucacauaacaaccagaa

SEQ ID NO: 649 - DNA, 25 bp, Artificial Sequence
  Synthetic oligonucleotide
uccacacaugaucacauaacaacca

SEQ ID NO: 650 - DNA, 25 bp, Artificial Sequence
  Synthetic oligonucleotide
uaacuuccacacaugaucacauaac

SEQ ID NO: 651 - DNA, 25 bp, Artificial Sequence
  Synthetic oligonucleotide
auaacuuccacacaugaucacauaa

SEQ ID NO: 652 - DNA, 25 bp, Artificial Sequence
  Synthetic oligonucleotide
aauaacuuccacacaugaucacata

SEQ ID NO: 653 - DNA, 25 bp, Artificial Sequence
  Synthetic oligonucleotide
uaauaacuuccacacaugaucacat

SEQ ID NO: 654 - DNA, 25 bp, Artificial Sequence
  Synthetic oligonucleotide
uuaaaguuaauaacuuccacacatg

SEQ ID NO: 655 - DNA, 25 bp, Artificial Sequence
  Synthetic oligonucleotide
auuaaaguuaauaacuuccacacat

SEQ ID NO: 656 - DNA, 25 bp, Artificial Sequence
  Synthetic oligonucleotide
acauuaaaguuaauaacuuccacac

SEQ ID NO: 657 - DNA, 25 bp, Artificial Sequence
  Synthetic oligonucleotide
aacauuaaaguuaauaacuuccaca

SEQ ID NO: 658 - DNA, 25 bp, Artificial Sequence
  Synthetic oligonucleotide
aaacauuaaaguuaauaacuuccac

SEQ ID NO: 659 - DNA, 25 bp, Artificial Sequence
  Synthetic oligonucleotide
aaaacauuaaaguuaauaacuucca

SEQ ID NO: 660 - DNA, 25 bp, Artificial Sequence
  Synthetic oligonucleotide
aaaaacauuaaaguuaauaacuucc

SEQ ID NO: 661 - DNA, 25 bp, Artificial Sequence
  Synthetic oligonucleotide
aaaaaacauuaaaguuaauaacutc

SEQ ID NO: 662 - DNA, 25 bp, Artificial Sequence
  Synthetic oligonucleotide
gcaaaaaacauuaaaguuaauaact

SEQ ID NO: 663 - DNA, 25 bp, Artificial Sequence
  Synthetic oligonucleotide
ggcaaaaaacauuaaaguuaauaac

SEQ ID NO: 664 - DNA, 25 bp, Artificial Sequence
  Synthetic oligonucleotide
gcaaaagcuguggcaaaaaacauta

SEQ ID NO: 665 - DNA, 25 bp, Artificial Sequence
  Synthetic oligonucleotide
ugcaaaagcuguggcaaaaaacatt

SEQ ID NO: 666 - DNA, 25 bp, Artificial Sequence
  Synthetic oligonucleotide
ucauuugaguauuaaguugcaaaag

SEQ ID NO: 667 - DNA, 25 bp, Artificial Sequence
  Synthetic oligonucleotide
aaaacagcaaauguuacucauuuga

SEQ ID NO: 668 - DNA, 25 bp, Artificial Sequence
  Synthetic oligonucleotide
uaaaacagcaaauguuacucauutg

SEQ ID NO: 669 - DNA, 25 bp, Artificial Sequence
  Synthetic oligonucleotide
uuaaaacagcaaauguuacucautt

SEQ ID NO: 670 - DNA, 25 bp, Artificial Sequence
  Synthetic oligonucleotide
uuuaaaacagcaaauguuacucatt

SEQ ID NO: 671 - DNA, 25 bp, Artificial Sequence
  Synthetic oligonucleotide
guuuaaaacagcaaauguuacucat

SEQ ID NO: 672 - DNA, 25 bp, Artificial Sequence
  Synthetic oligonucleotide
uguuuaaaacagcaaauguuacuca

SEQ ID NO: 673 - DNA, 25 bp, Artificial Sequence
  Synthetic oligonucleotide
auuaauguuuaaaacagcaaaugtt

SEQ ID NO: 674 - DNA, 25 bp, Artificial Sequence
  Synthetic oligonucleotide
agaaaggcugcuauuaauguuuaaa

SEQ ID NO: 675 - DNA, 25 bp, Artificial Sequence
  Synthetic oligonucleotide
aguucagacaauacagcuguauaaa

SEQ ID NO: 676 - DNA, 25 bp, Artificial Sequence
  Synthetic oligonucleotide
acaaugcaaguucagacaauacagc

SEQ ID NO: 677 - DNA, 25 bp, Artificial Sequence
  Synthetic oligonucleotide
ucacaaugcaaguucagacaauaca

SEQ ID NO: 678 - DNA, 25 bp, Artificial Sequence
  Synthetic oligonucleotide
aaucacaaugcaaguucagacaata

SEQ ID NO: 679 - DNA, 25 bp, Artificial Sequence
  Synthetic oligonucleotide
ggccaaucacaaugcaaguucagac

SEQ ID NO: 680 - DNA, 25 bp, Artificial Sequence
  Synthetic oligonucleotide
guucccauaggaaacucagcuuggt

SEQ ID NO: 681 - DNA, 25 bp, Artificial Sequence
  Synthetic oligonucleotide
ucaauuguucccauaggaaacucag

SEQ ID NO: 682 - DNA, 25 bp, Artificial Sequence
  Synthetic oligonucleotide
uucaauuguucccauaggaaacuca

SEQ ID NO: 683 - DNA, 25 bp, Artificial Sequence
  Synthetic oligonucleotide
guuuacuucaauuguucccauagga

SEQ ID NO: 684 - DNA, 25 bp, Artificial Sequence
  Synthetic oligonucleotide
aguuuacuucaauuguucccauagg

SEQ ID NO: 685 - DNA, 25 bp, Artificial Sequence
  Synthetic oligonucleotide
aaaaaguuuacuucaauuguuccca

SEQ ID NO: 686 - DNA, 25 bp, Artificial Sequence
  Synthetic oligonucleotide
gaacaaaaaguuuacuucaauugtt

SEQ ID NO: 687 - DNA, 25 bp, Artificial Sequence
  Synthetic oligonucleotide
gaccagaacaaaaaguuuacuucaa

SEQ ID NO: 688 - DNA, 25 bp, Artificial Sequence
  Synthetic oligonucleotide
ggaccagaacaaaaaguuuacuuca

SEQ ID NO: 689 - DNA, 25 bp, Artificial Sequence
  Synthetic oligonucleotide
accaaaaaggaccagaacaaaaagt

SEQ ID NO: 690 - DNA, 25 bp, Artificial Sequence
  Synthetic oligonucleotide
gaccaaaaaggaccagaacaaaaag

SEQ ID NO: 691 - DNA, 25 bp, Artificial Sequence
  Synthetic oligonucleotide
acuccucgaccaaaaaggaccagaa

SEQ ID NO: 692 - DNA, 25 bp, Artificial Sequence
  Synthetic oligonucleotide
uccauuuguauuguuacuccucgac

SEQ ID NO: 693 - DNA, 25 bp, Artificial Sequence
  Synthetic oligonucleotide
auccauuuguauuguuacuccucga

SEQ ID NO: 694 - DNA, 25 bp, Artificial Sequence
  Synthetic oligonucleotide
aauccauuuguauuguuacuccucg

SEQ ID NO: 695 - DNA, 25 bp, Artificial Sequence
  Synthetic oligonucleotide
aaauccauuuguauuguuacucctc

SEQ ID NO: 696 - DNA, 25 bp, Artificial Sequence
  Synthetic oligonucleotide
aaaauccauuuguauuguuacucct

SEQ ID NO: 697 - DNA, 25 bp, Artificial Sequence
  Synthetic oligonucleotide
acucccaaaauccauuuguauugtt

SEQ ID NO: 698 - DNA, 25 bp, Artificial Sequence
  Synthetic oligonucleotide
uucacuucuugagucacucccaaaa

SEQ ID NO: 699 - DNA, 25 bp, Artificial Sequence
  Synthetic oligonucleotide
ucuucacuucuugagucacucccaa

SEQ ID NO: 700 - DNA, 25 bp, Artificial Sequence
  Synthetic oligonucleotide
uucuucacuucuugagucacuccca

SEQ ID NO: 701 - DNA, 25 bp, Artificial Sequence
  Synthetic oligonucleotide
auucuucacuucuugagucacuccc

SEQ ID NO: 702 - DNA, 25 bp, Artificial Sequence
  Synthetic oligonucleotide
gcauucuucacuucuugagucactc

SEQ ID NO: 703 - DNA, 25 bp, Artificial Sequence
  Synthetic oligonucleotide
auucuugugcauucuucacuucutg

SEQ ID NO: 704 - DNA, 25 bp, Artificial Sequence
  Synthetic oligonucleotide
uccauucuugugcauucuucacutc

SEQ ID NO: 705 - DNA, 25 bp, Artificial Sequence
  Synthetic oligonucleotide
auccauucuugugcauucuucactt

SEQ ID NO: 706 - DNA, 25 bp, Artificial Sequence
  Synthetic oligonucleotide
gauccauucuugugcauucuucact

SEQ ID NO: 707 - DNA, 25 bp, Artificial Sequence
  Synthetic oligonucleotide
aauuccaucuugugauccauucutg

SEQ ID NO: 708 - DNA, 25 bp, Artificial Sequence
  Synthetic oligonucleotide
uaaauuccaucuugugauccauuct

SEQ ID NO: 709 - DNA, 25 bp, Artificial Sequence
  Synthetic oligonucleotide
auaaauuccaucuugugauccautc

SEQ ID NO: 710 - DNA, 25 bp, Artificial Sequence
  Synthetic oligonucleotide
gauaaauuccaucuugugauccatt

SEQ ID NO: 711 - DNA, 25 bp, Artificial Sequence
  Synthetic oligonucleotide
ugauaaauuccaucuugugauccat

SEQ ID NO: 712 - DNA, 25 bp, Artificial Sequence
  Synthetic oligonucleotide
ggcuaggguuugauaaauuccauct

SEQ ID NO: 713 - DNA, 25 bp, Artificial Sequence
  Synthetic oligonucleotide
aaaaauuuaacaagcaaggcuaggg

SEQ ID NO: 714 - DNA, 25 bp, Artificial Sequence
  Synthetic oligonucleotide
aaaaaaaaaaaaaauuuaacaagca

SEQ ID NO: 715 - DNA, 25 bp, Artificial Sequence
  Synthetic oligonucleotide
aaaaaaaaaaaaaaauuuaacaagc

SEQ ID NO: 716 - DNA, 25 bp, Artificial Sequence
  Synthetic oligonucleotide
aaaaaaaaaaaaaaaauuuaacaag

SEQ ID NO: 717 - DNA, 25 bp, Artificial Sequence
  Synthetic oligonucleotide
aaaaaaaaaaaaaaaaauuuaacaa

SEQ ID NO: 718 - DNA, 25 bp, Artificial Sequence
  Synthetic oligonucleotide
aaaaaaaaaaaaaaaaaauuuaaca

SEQ ID NO: 719 - DNA, 25 bp, Artificial Sequence
  Synthetic oligonucleotide
aaaaaaaaaaaaaaaaaaauuuaac

SEQ ID NO: 720 - DNA, 25 bp, Artificial Sequence
  Synthetic oligonucleotide
uaaaaaaaaaaaaaaaaaaauuuaa

SEQ ID NO: 721 - DNA, 25 bp, Artificial Sequence
  Synthetic oligonucleotide
uuaaaaaaaaaaaaaaaaaaauuta

SEQ ID NO: 722 - DNA, 25 bp, Artificial Sequence
  Synthetic oligonucleotide
ucuuaaaaaaaaaaaaaaaaaaatt

SEQ ID NO: 723 - DNA, 25 bp, Artificial Sequence
  Synthetic oligonucleotide
uucuuaaaaaaaaaaaaaaaaaaat

SEQ ID NO: 724 - DNA, 25 bp, Artificial Sequence
  Synthetic oligonucleotide
auucuuaaaaaaaaaaaaaaaaaaa

SEQ ID NO: 725 - DNA, 25 bp, Artificial Sequence
  Synthetic oligonucleotide
uauucuuaaaaaaaaaaaaaaaaaa

SEQ ID NO: 726 - DNA, 25 bp, Artificial Sequence
  Synthetic oligonucleotide
auauucuuaaaaaaaaaaaaaaaaa

SEQ ID NO: 727 - DNA, 25 bp, Artificial Sequence
  Synthetic oligonucleotide
gauauucuuaaaaaaaaaaaaaaaa

SEQ ID NO: 728 - DNA, 25 bp, Artificial Sequence
  Synthetic oligonucleotide
agauauucuuaaaaaaaaaaaaaaa

SEQ ID NO: 729 - DNA, 25 bp, Artificial Sequence
  Synthetic oligonucleotide
uuacagauauucuuaaaaaaaaaaa

SEQ ID NO: 730 - DNA, 25 bp, Artificial Sequence
  Synthetic oligonucleotide
auuacagauauucuuaaaaaaaaaa

SEQ ID NO: 731 - DNA, 25 bp, Artificial Sequence
  Synthetic oligonucleotide
uaccauuacagauauucuuaaaaaa

SEQ ID NO: 732 - DNA, 25 bp, Artificial Sequence
  Synthetic oligonucleotide
guaccauuacagauauucuuaaaaa

SEQ ID NO: 733 - DNA, 25 bp, Artificial Sequence
  Synthetic oligonucleotide
aguaccauuacagauauucuuaaaa

SEQ ID NO: 734 - DNA, 25 bp, Artificial Sequence
  Synthetic oligonucleotide
agucaguaccauuacagauauuctt

SEQ ID NO: 735 - DNA, 25 bp, Artificial Sequence
  Synthetic oligonucleotide
uacuucaaagcaagcaaagucagta

SEQ ID NO: 736 - DNA, 25 bp, Artificial Sequence
  Synthetic oligonucleotide
aaaaagagcuacuucaaagcaagca

SEQ ID NO: 737 - DNA, 25 bp, Artificial Sequence
  Synthetic oligonucleotide
aaaaaaaaaagagcuacuucaaagc

SEQ ID NO: 738 - DNA, 25 bp, Artificial Sequence
  Synthetic oligonucleotide
aaaaaaaaaaagagcuacuucaaag

SEQ ID NO: 739 - DNA, 25 bp, Artificial Sequence
  Synthetic oligonucleotide
aaaaaaaaaaaaagagcuacuucaa

SEQ ID NO: 740 - DNA, 25 bp, Artificial Sequence
  Synthetic oligonucleotide
aaaaaaaaaaaaaagagcuacuuca

SEQ ID NO: 741 - DNA, 25 bp, Artificial Sequence
  Synthetic oligonucleotide
aaaaaaaaaaaaaaagagcuacutc

SEQ ID NO: 742 - DNA, 25 bp, Artificial Sequence
  Synthetic oligonucleotide
aaaaaaaaaaaaaaaagagcuactt

SEQ ID NO: 743 - DNA, 25 bp, Artificial Sequence
  Synthetic oligonucleotide
aaaaaaaaaaaaaaaaaaaaaagag

SEQ ID NO: 744 - DNA, 25 bp, Artificial Sequence
  Synthetic oligonucleotide
aaaaaaaaaaaaaaaaaaaaaaaga

SEQ ID NO: 745 - DNA, 25 bp, Artificial Sequence
  Synthetic oligonucleotide
aaaaaaaaaaaaaaaaaaaaaaaag

SEQ ID NO: 746 - DNA, 25 bp, Artificial Sequence
  Synthetic oligonucleotide
aaaaaaaaaaaaaaaaaaaaaaaaa

SEQ ID NO: 747 - DNA, 25 bp, Artificial Sequence
  Synthetic oligonucleotide
gcaaaaaaaaaaaaaaaaaaaaaaa

SEQ ID NO: 748 - DNA, 25 bp, Artificial Sequence
  Synthetic oligonucleotide
ugcaaaaaaaaaaaaaaaaaaaaaa

SEQ ID NO: 749 - DNA, 25 bp, Artificial Sequence
  Synthetic oligonucleotide
uuacugcaaaaaaaaaaaaaaaaaa

SEQ ID NO: 750 - DNA, 25 bp, Artificial Sequence
  Synthetic oligonucleotide
guuacugcaaaaaaaaaaaaaaaaa

SEQ ID NO: 751 - DNA, 25 bp, Artificial Sequence
  Synthetic oligonucleotide
aguuacugcaaaaaaaaaaaaaaaa

SEQ ID NO: 752 - DNA, 25 bp, Artificial Sequence
  Synthetic oligonucleotide
aaacaguuacugcaaaaaaaaaaaa

SEQ ID NO: 753 - DNA, 25 bp, Artificial Sequence
  Synthetic oligonucleotide
aaaacaguuacugcaaaaaaaaaaa

SEQ ID NO: 754 - DNA, 25 bp, Artificial Sequence
  Synthetic oligonucleotide
aaaaacaguuacugcaaaaaaaaaa

SEQ ID NO: 755 - DNA, 25 bp, Artificial Sequence
  Synthetic oligonucleotide
uaaaaaacaguuacugcaaaaaaaa

SEQ ID NO: 756 - DNA, 25 bp, Artificial Sequence
  Synthetic oligonucleotide
uuaaaaaacaguuacugcaaaaaaa

SEQ ID NO: 757 - DNA, 25 bp, Artificial Sequence
  Synthetic oligonucleotide
acuuaaaaaacaguuacugcaaaaa

SEQ ID NO: 758 - DNA, 25 bp, Artificial Sequence
  Synthetic oligonucleotide
acuacgagagacuuaaaaaacagtt

SEQ ID NO: 759 - DNA, 25 bp, Artificial Sequence
  Synthetic oligonucleotide
acacuacgagagacuuaaaaaacag

SEQ ID NO: 760 - DNA, 25 bp, Artificial Sequence
  Synthetic oligonucleotide
aacacuacgagagacuuaaaaaaca

SEQ ID NO: 761 - DNA, 25 bp, Artificial Sequence
  Synthetic oligonucleotide
uuaacacuacgagagacuuaaaaaa

SEQ ID NO: 762 - DNA, 25 bp, Artificial Sequence
  Synthetic oligonucleotide
aacuuaacacuacgagagacuuaaa

SEQ ID NO: 763 - DNA, 25 bp, Artificial Sequence
  Synthetic oligonucleotide
uaacuuaacacuacgagagacuuaa

SEQ ID NO: 764 - DNA, 25 bp, Artificial Sequence
  Synthetic oligonucleotide
auucacuauaacuuaacacuacgag

SEQ ID NO: 765 - DNA, 25 bp, Artificial Sequence
  Synthetic oligonucleotide
uauucacuauaacuuaacacuacga

SEQ ID NO: 766 - DNA, 25 bp, Artificial Sequence
  Synthetic oligonucleotide
guauucacuauaacuuaacacuacg

SEQ ID NO: 767 - DNA, 25 bp, Artificial Sequence
  Synthetic oligonucleotide
aguauucacuauaacuuaacacuac

SEQ ID NO: 768 - DNA, 25 bp, Artificial Sequence
  Synthetic oligonucleotide
aaauugcuguagcaguauucacuat

SEQ ID NO: 769 - DNA, 25 bp, Artificial Sequence
  Synthetic oligonucleotide
gaaauugcuguagcaguauucacta

SEQ ID NO: 770 - DNA, 25 bp, Artificial Sequence
  Synthetic oligonucleotide
agaaauugcuguagcaguauucact

SEQ ID NO: 771 - DNA, 25 bp, Artificial Sequence
  Synthetic oligonucleotide
ucaauucuuaaaaauuagaaauugc

SEQ ID NO: 772 - DNA, 25 bp, Artificial Sequence
  Synthetic oligonucleotide
auuacucaauucuuaaaaauuagaa

SEQ ID NO: 773 - DNA, 25 bp, Artificial Sequence
  Synthetic oligonucleotide
accauuacucaauucuuaaaaauta

SEQ ID NO: 774 - DNA, 25 bp, Artificial Sequence
  Synthetic oligonucleotide
acaccauuacucaauucuuaaaaat

SEQ ID NO: 775 - DNA, 25 bp, Artificial Sequence
  Synthetic oligonucleotide
uacaccauuacucaauucuuaaaaa

SEQ ID NO: 776 - DNA, 25 bp, Artificial Sequence
  Synthetic oligonucleotide
ucuacaccauuacucaauucuuaaa

SEQ ID NO: 777 - DNA, 25 bp, Artificial Sequence
  Synthetic oligonucleotide
guucuacaccauuacucaauucuta

SEQ ID NO: 778 - DNA, 25 bp, Artificial Sequence
  Synthetic oligonucleotide
gaauuaguguucuacaccauuactc

SEQ ID NO: 779 - DNA, 25 bp, Artificial Sequence
  Synthetic oligonucleotide
auuaugaauuaguguucuacaccat

SEQ ID NO: 780 - DNA, 25 bp, Artificial Sequence
  Synthetic oligonucleotide
gauuaugaauuaguguucuacacca

SEQ ID NO: 781 - DNA, 25 bp, Artificial Sequence
  Synthetic oligonucleotide
ugauuaugaauuaguguucuacacc

SEQ ID NO: 782 - DNA, 25 bp, Artificial Sequence
  Synthetic oligonucleotide
uaauuagagugauuaugaauuagtg

SEQ ID NO: 783 - DNA, 25 bp, Artificial Sequence
  Synthetic oligonucleotide
uuaauuagagugauuaugaauuagt

SEQ ID NO: 784 - DNA, 25 bp, Artificial Sequence
  Synthetic oligonucleotide
auuaauuagagugauuaugaauuag

SEQ ID NO: 785 - DNA, 25 bp, Artificial Sequence
  Synthetic oligonucleotide
uacaauuaauuagagugauuaugaa

SEQ ID NO: 786 - DNA, 25 bp, Artificial Sequence
  Synthetic oligonucleotide
uuacaauuaauuagagugauuauga

SEQ ID NO: 787 - DNA, 25 bp, Artificial Sequence
  Synthetic oligonucleotide
auuacaauuaauuagagugauuatg

SEQ ID NO: 788 - DNA, 25 bp, Artificial Sequence
  Synthetic oligonucleotide
uuauucagauuacaauuaauuagag

SEQ ID NO: 789 - DNA, 25 bp, Artificial Sequence
  Synthetic oligonucleotide
uuuauucagauuacaauuaauuaga

SEQ ID NO: 790 - DNA, 25 bp, Artificial Sequence
  Synthetic oligonucleotide
acacuuuauucagauuacaauuaat

SEQ ID NO: 791 - DNA, 25 bp, Artificial Sequence
  Synthetic oligonucleotide
uacacuuuauucagauuacaauuaa

SEQ ID NO: 792 - DNA, 25 bp, Artificial Sequence
  Synthetic oligonucleotide
uuacacuuuauucagauuacaauta

SEQ ID NO: 793 - DNA, 25 bp, Artificial Sequence
  Synthetic oligonucleotide
guuacacuuuauucagauuacaatt

SEQ ID NO: 794 - DNA, 25 bp, Artificial Sequence
  Synthetic oligonucleotide
uguuacacuuuauucagauuacaat

SEQ ID NO: 795 - DNA, 25 bp, Artificial Sequence
  Synthetic oligonucleotide
acacaauuguuacacuuuauucaga

SEQ ID NO: 796 - DNA, 25 bp, Artificial Sequence
  Synthetic oligonucleotide
ggcuacacaauuguuacacuuuatt

SEQ ID NO: 797 - DNA, 25 bp, Artificial Sequence
  Synthetic oligonucleotide
aaaaaggcuacacaauuguuacact

SEQ ID NO: 798 - DNA, 25 bp, Artificial Sequence
  Synthetic oligonucleotide
uuauacaaaaaggcuacacaauugt

SEQ ID NO: 799 - DNA, 25 bp, Artificial Sequence
  Synthetic oligonucleotide
uuuauacaaaaaggcuacacaautg

SEQ ID NO: 800 - DNA, 25 bp, Artificial Sequence
  Synthetic oligonucleotide
auuuuauacaaaaaggcuacacaat

SEQ ID NO: 801 - DNA, 25 bp, Artificial Sequence
  Synthetic oligonucleotide
uauuuuauacaaaaaggcuacacaa

SEQ ID NO: 802 - DNA, 25 bp, Artificial Sequence
  Synthetic oligonucleotide
ucuauuuuauacaaaaaggcuacac

SEQ ID NO: 803 - DNA, 25 bp, Artificial Sequence
  Synthetic oligonucleotide
uauuugucuauuuuauacaaaaagg

SEQ ID NO: 804 - DNA, 25 bp, Artificial Sequence
  Synthetic oligonucleotide
ucuauuugucuauuuuauacaaaaa

SEQ ID NO: 805 - DNA, 25 bp, Artificial Sequence
  Synthetic oligonucleotide
uucuauuugucuauuuuauacaaaa

SEQ ID NO: 806 - DNA, 25 bp, Artificial Sequence
  Synthetic oligonucleotide
uuucuauuugucuauuuuauacaaa

SEQ ID NO: 807 - DNA, 25 bp, Artificial Sequence
  Synthetic oligonucleotide
uuuucuauuugucuauuuuauacaa

SEQ ID NO: 808 - DNA, 25 bp, Artificial Sequence
  Synthetic oligonucleotide
auuuucuauuugucuauuuuauaca

SEQ ID NO: 809 - DNA, 25 bp, Artificial Sequence
  Synthetic oligonucleotide
accauuuucuauuugucuauuuuat

SEQ ID NO: 810 - DNA, 25 bp, Artificial Sequence
  Synthetic oligonucleotide
gaccauuuucuauuugucuauuuta

SEQ ID NO: 811 - DNA, 25 bp, Artificial Sequence
  Synthetic oligonucleotide
ggaccauuuucuauuugucuauutt

SEQ ID NO: 812 - DNA, 25 bp, Artificial Sequence
  Synthetic oligonucleotide
acuaauuggaccauuuucuauuugt

SEQ ID NO: 813 - DNA, 25 bp, Artificial Sequence
  Synthetic oligonucleotide
aacuaauuggaccauuuucuauutg

SEQ ID NO: 814 - DNA, 25 bp, Artificial Sequence
  Synthetic oligonucleotide
aaacuaauuggaccauuuucuautt

SEQ ID NO: 815 - DNA, 25 bp, Artificial Sequence
  Synthetic oligonucleotide
gaaacuaauuggaccauuuucuatt

SEQ ID NO: 816 - DNA, 25 bp, Artificial Sequence
  Synthetic oligonucleotide
aaaaaggaaacuaauuggaccautt

SEQ ID NO: 817 - DNA, 25 bp, Artificial Sequence
  Synthetic oligonucleotide
uaaaaaggaaacuaauuggaccatt

SEQ ID NO: 818 - DNA, 25 bp, Artificial Sequence
  Synthetic oligonucleotide
gcauauuaaaaaggaaacuaauugg

SEQ ID NO: 819 - DNA, 25 bp, Artificial Sequence
  Synthetic oligonucleotide
agcauauuaaaaaggaaacuaautg

SEQ ID NO: 820 - DNA, 25 bp, Artificial Sequence
  Synthetic oligonucleotide
uuuaagcauauuaaaaaggaaacta

SEQ ID NO: 821 - DNA, 25 bp, Artificial Sequence
  Synthetic oligonucleotide
gcuuauuuuaagcauauuaaaaagg

SEQ ID NO: 822 - DNA, 25 bp, Artificial Sequence
  Synthetic oligonucleotide
ugcuuauuuuaagcauauuaaaaag

SEQ ID NO: 823 - DNA, 25 bp, Artificial Sequence
  Synthetic oligonucleotide
uccaccugcuuauuuuaagcauatt

SEQ ID NO: 824 - DNA, 25 bp, Artificial Sequence
  Synthetic oligonucleotide
aaaacaugaaauagauccaccugct

SEQ ID NO: 825 - DNA, 25 bp, Artificial Sequence
  Synthetic oligonucleotide
aaaaacaugaaauagauccaccugc

SEQ ID NO: 826 - DNA, 25 bp, Artificial Sequence
  Synthetic oligonucleotide
ucaaaaacaugaaauagauccacct

SEQ ID NO: 827 - DNA, 25 bp, Artificial Sequence
  Synthetic oligonucleotide
aucaaaaacaugaaauagauccacc

SEQ ID NO: 828 - DNA, 25 bp, Artificial Sequence
  Synthetic oligonucleotide
gaucaaaaacaugaaauagauccac

SEQ ID NO: 829 - DNA, 25 bp, Artificial Sequence
  Synthetic oligonucleotide
uuuuugaucaaaaacaugaaauaga

SEQ ID NO: 830 - DNA, 25 bp, Artificial Sequence
  Synthetic oligonucleotide
aaauaguuuuugaucaaaaacauga

SEQ ID NO: 831 - DNA, 25 bp, Artificial Sequence
  Synthetic oligonucleotide
ucccaaauaguuuuugaucaaaaac

SEQ ID NO: 832 - DNA, 25 bp, Artificial Sequence
  Synthetic oligonucleotide
aucccaaauaguuuuugaucaaaaa

SEQ ID NO: 833 - DNA, 25 bp, Artificial Sequence
  Synthetic oligonucleotide
uaucccaaauaguuuuugaucaaaa

SEQ ID NO: 834 - DNA, 25 bp, Artificial Sequence
  Synthetic oligonucleotide
auaucccaaauaguuuuugaucaaa

SEQ ID NO: 835 - DNA, 25 bp, Artificial Sequence
  Synthetic oligonucleotide
auacauaucccaaauaguuuuugat

SEQ ID NO: 836 - DNA, 25 bp, Artificial Sequence
  Synthetic oligonucleotide
acccuacccauacauaucccaaata

SEQ ID NO: 837 - DNA, 25 bp, Artificial Sequence
  Synthetic oligonucleotide
uacccuacccauacauaucccaaat

SEQ ID NO: 838 - DNA, 25 bp, Artificial Sequence
  Synthetic oligonucleotide
uuacccuacccauacauaucccaaa

SEQ ID NO: 839 - DNA, 25 bp, Artificial Sequence
  Synthetic oligonucleotide
accucuuacugauuuacccuaccca

SEQ ID NO: 840 - DNA, 25 bp, Artificial Sequence
  Synthetic oligonucleotide
acaccucuuacugauuuacccuacc

SEQ ID NO: 841 - DNA, 25 bp, Artificial Sequence
  Synthetic oligonucleotide
aacaccucuuacugauuuacccuac

SEQ ID NO: 842 - DNA, 25 bp, Artificial Sequence
  Synthetic oligonucleotide
uaacaccucuuacugauuuacccta

SEQ ID NO: 843 - DNA, 25 bp, Artificial Sequence
  Synthetic oligonucleotide
auaacaccucuuacugauuuaccct

SEQ ID NO: 844 - DNA, 25 bp, Artificial Sequence
  Synthetic oligonucleotide
aauaacaccucuuacugauuuaccc

SEQ ID NO: 845 - DNA, 25 bp, Artificial Sequence
  Synthetic oligonucleotide
guuccaaauaacaccucuuacugat

SEQ ID NO: 846 - DNA, 25 bp, Artificial Sequence
  Synthetic oligonucleotide
aacaagguuccaaauaacaccuctt

SEQ ID NO: 847 - DNA, 25 bp, Artificial Sequence
  Synthetic oligonucleotide
aaacaagguuccaaauaacaccuct

SEQ ID NO: 848 - DNA, 25 bp, Artificial Sequence
  Synthetic oligonucleotide
aaaacaagguuccaaauaacacctc

SEQ ID NO: 849 - DNA, 25 bp, Artificial Sequence
  Synthetic oligonucleotide
uguccaaaacaagguuccaaauaac

SEQ ID NO: 850 - DNA, 25 bp, Artificial Sequence
  Synthetic oligonucleotide
aaacuguccaaaacaagguuccaaa

SEQ ID NO: 851 - DNA, 25 bp, Artificial Sequence
  Synthetic oligonucleotide
uaaacuguccaaaacaagguuccaa

SEQ ID NO: 852 - DNA, 25 bp, Artificial Sequence
  Synthetic oligonucleotide
gcaacugguaaacuguccaaaacaa

SEQ ID NO: 853 - DNA, 25 bp, Artificial Sequence
  Synthetic oligonucleotide
gauaaaaggcaacugguaaacugtc

SEQ ID NO: 854 - DNA, 25 bp, Artificial Sequence
  Synthetic oligonucleotide
ggauaaaaggcaacugguaaacugt

SEQ ID NO: 855 - DNA, 25 bp, Artificial Sequence
  Synthetic oligonucleotide
aacuuugggauaaaaggcaacuggt

SEQ ID NO: 856 - DNA, 25 bp, Artificial Sequence
  Synthetic oligonucleotide
acaacuuugggauaaaaggcaactg

SEQ ID NO: 857 - DNA, 25 bp, Artificial Sequence
  Synthetic oligonucleotide
uuacaacaacuuugggauaaaaggc

SEQ ID NO: 858 - DNA, 25 bp, Artificial Sequence
  Synthetic oligonucleotide
guuacaacaacuuugggauaaaagg

SEQ ID NO: 859 - DNA, 25 bp, Artificial Sequence
  Synthetic oligonucleotide
gguuacaacaacuuugggauaaaag

SEQ ID NO: 860 - DNA, 25 bp, Artificial Sequence
  Synthetic oligonucleotide
ucacagcagguuacaacaacuuugg

SEQ ID NO: 861 - DNA, 25 bp, Artificial Sequence
  Synthetic oligonucleotide
aucacagcagguuacaacaacuutg

SEQ ID NO: 862 - DNA, 25 bp, Artificial Sequence
  Synthetic oligonucleotide
guaucacagcagguuacaacaactt

SEQ ID NO: 863 - DNA, 25 bp, Artificial Sequence
  Synthetic oligonucleotide
ucucuugaagcaucguaucacagca

SEQ ID NO: 864 - DNA, 25 bp, Artificial Sequence
  Synthetic oligonucleotide
uucucuugaagcaucguaucacagc

SEQ ID NO: 865 - DNA, 25 bp, Artificial Sequence
  Synthetic oligonucleotide
uuuucucuugaagcaucguaucaca

SEQ ID NO: 866 - DNA, 25 bp, Artificial Sequence
  Synthetic oligonucleotide
uuuuauaaccgcauuuucucuugaa

SEQ ID NO: 867 - DNA, 25 bp, Artificial Sequence
  Synthetic oligonucleotide
uuuuuauaaccgcauuuucucuuga

SEQ ID NO: 868 - DNA, 25 bp, Artificial Sequence
  Synthetic oligonucleotide
uuuuuuauaaccgcauuuucucutg

SEQ ID NO: 869 - DNA, 25 bp, Artificial Sequence
  Synthetic oligonucleotide
auuuuuuauaaccgcauuuucuctt

SEQ ID NO: 870 - DNA, 25 bp, Artificial Sequence
  Synthetic oligonucleotide
gaaccauuuuuuauaaccgcauutt

SEQ ID NO: 871 - DNA, 25 bp, Artificial Sequence
  Synthetic oligonucleotide
auucugaaccauuuuuuauaaccgc

SEQ ID NO: 872 - DNA, 25 bp, Artificial Sequence
  Synthetic oligonucleotide
aauucugaaccauuuuuuauaaccg

SEQ ID NO: 873 - DNA, 25 bp, Artificial Sequence
  Synthetic oligonucleotide
uaauucugaaccauuuuuuauaacc

SEQ ID NO: 874 - DNA, 25 bp, Artificial Sequence
  Synthetic oligonucleotide
uuaauucugaaccauuuuuuauaac

SEQ ID NO: 875 - DNA, 25 bp, Artificial Sequence
  Synthetic oligonucleotide
uuuaauucugaaccauuuuuuauaa

SEQ ID NO: 876 - DNA, 25 bp, Artificial Sequence
  Synthetic oligonucleotide
guuuaauucugaaccauuuuuuata

SEQ ID NO: 877 - DNA, 25 bp, Artificial Sequence
  Synthetic oligonucleotide
uaaaaguuuaauucugaaccauutt

SEQ ID NO: 878 - DNA, 25 bp, Artificial Sequence
  Synthetic oligonucleotide
uuaaaaguuuaauucugaaccautt

SEQ ID NO: 879 - DNA, 25 bp, Artificial Sequence
  Synthetic oligonucleotide
aauuaaaaguuuaauucugaaccat

SEQ ID NO: 880 - DNA, 25 bp, Artificial Sequence
  Synthetic oligonucleotide
auacagcuaaaggaugauuuacagg

SEQ ID NO: 881 - DNA, 25 bp, Artificial Sequence
  Synthetic oligonucleotide
aauacagcuaaaggaugauuuacag

SEQ ID NO: 882 - DNA, 25 bp, Artificial Sequence
  Synthetic oligonucleotide
acaauacagcuaaaggaugauuuac

SEQ ID NO: 883 - DNA, 25 bp, Artificial Sequence
  Synthetic oligonucleotide
uacuccuaaaggaugauuuacaggt

SEQ ID NO: 884 - DNA, 25 bp, Artificial Sequence
  Synthetic oligonucleotide
uuacuccuaaaggaugauuuacagg

SEQ ID NO: 885 - DNA, 25 bp, Artificial Sequence
  Synthetic oligonucleotide
guuacuccuaaaggaugauuuacag

SEQ ID NO: 886 - DNA, 25 bp, Artificial Sequence
  Synthetic oligonucleotide
uguuacuccuaaaggaugauuuaca

SEQ ID NO: 887 - DNA, 25 bp, Artificial Sequence
  Synthetic oligonucleotide
auuccagaauccaaguaagacugct

SEQ ID NO: 888 - DNA, 25 bp, Artificial Sequence
  Synthetic oligonucleotide
ugcucccauucauaaaggacuuggg

SEQ ID NO: 889 - DNA, 25 bp, Artificial Sequence
  Synthetic oligonucleotide
ucaauaucagcuacuugcucuugcg

SEQ ID NO: 890 - DNA, 25 bp, Artificial Sequence
  Synthetic oligonucleotide
gucaauaucagcuacuugcucuugc

SEQ ID NO: 891 - DNA, 25 bp, Artificial Sequence
  Synthetic oligonucleotide
ugcccgucaauaucagcuacuugct

SEQ ID NO: 892 - DNA, 25 bp, Artificial Sequence
  Synthetic oligonucleotide
uuucaacaucugugaugguucagcc

SEQ ID NO: 893 - DNA, 25 bp, Artificial Sequence
  Synthetic oligonucleotide
guuucaacaucugugaugguucagc

SEQ ID NO: 894 - DNA, 25 bp, Artificial Sequence
  Synthetic oligonucleotide
acaacugcauguuucaacaucugtg

SEQ ID NO: 895 - DNA, 25 bp, Artificial Sequence
  Synthetic oligonucleotide
ugacaacugcauguuucaacauctg

SEQ ID NO: 896 - DNA, 25 bp, Artificial Sequence
  Synthetic oligonucleotide
aaauugacaacugcauguuucaaca

SEQ ID NO: 897 - DNA, 25 bp, Artificial Sequence
  Synthetic oligonucleotide
uuaaucaaauugacaacugcaugtt

SEQ ID NO: 898 - DNA, 25 bp, Artificial Sequence
  Synthetic oligonucleotide
ugauaguuaaucaaauugacaactg

SEQ ID NO: 899 - DNA, 25 bp, Artificial Sequence
  Synthetic oligonucleotide
ucauccugauaguuaaucaaauuga

SEQ ID NO: 900 - DNA, 25 bp, Artificial Sequence
  Synthetic oligonucleotide
gucauccugauaguuaaucaaautg

SEQ ID NO: 901 - DNA, 25 bp, Artificial Sequence
  Synthetic oligonucleotide
ucaucguuuagcaguuuugucagct

SEQ ID NO: 902 - DNA, 25 bp, Artificial Sequence
  Synthetic oligonucleotide
gguccucaucguuuagcaguuuugt

SEQ ID NO: 903 - DNA, 25 bp, Artificial Sequence
  Synthetic oligonucleotide
uaacagcagcuuuauuaacuaccac

SEQ ID NO: 904 - DNA, 25 bp, Artificial Sequence
  Synthetic oligonucleotide
auaacagcagcuuuauuaacuacca

SEQ ID NO: 905 - DNA, 25 bp, Artificial Sequence
  Synthetic oligonucleotide
accauaacagcagcuuuauuaacta

SEQ ID NO: 906 - DNA, 25 bp, Artificial Sequence
  Synthetic oligonucleotide
gaccauaacagcagcuuuauuaact

SEQ ID NO: 907 - DNA, 25 bp, Artificial Sequence
  Synthetic oligonucleotide
gucucuacaucauuuguauucugca

SEQ ID NO: 908 - DNA, 25 bp, Artificial Sequence
  Synthetic oligonucleotide
ugucucuacaucauuuguauucugc

SEQ ID NO: 909 - DNA, 25 bp, Artificial Sequence
  Synthetic oligonucleotide
aaccauuuucugcaguccaccagct

SEQ ID NO: 910 - DNA, 25 bp, Artificial Sequence
  Synthetic oligonucleotide
gcaaccauuuucugcaguccaccag

SEQ ID NO: 911 - DNA, 25 bp, Artificial Sequence
  Synthetic oligonucleotide
guuuuguugagcaaagcaaccautt

SEQ ID NO: 912 - DNA, 25 bp, Artificial Sequence
  Synthetic oligonucleotide
uguuuuguugagcaaagcaaccatt

SEQ ID NO: 913 - DNA, 25 bp, Artificial Sequence
  Synthetic oligonucleotide
gccaagaauuucacguuuguuuugt

SEQ ID NO: 914 - DNA, 25 bp, Artificial Sequence
  Synthetic oligonucleotide
ugauugccauaagcuaagaucugaa

SEQ ID NO: 915 - DNA, 25 bp, Artificial Sequence
  Synthetic oligonucleotide
ucucuugauugccauaagcuaagat

SEQ ID NO: 916 - DNA, 25 bp, Artificial Sequence
  Synthetic oligonucleotide
ucucauaaguguagguccucauuat

SEQ ID NO: 917 - DNA, 25 bp, Artificial Sequence
  Synthetic oligonucleotide
uucucauaaguguagguccucauta

SEQ ID NO: 918 - DNA, 25 bp, Artificial Sequence
  Synthetic oligonucleotide
gcuucucauaaguguagguccucat

SEQ ID NO: 919 - DNA, 25 bp, Artificial Sequence
  Synthetic oligonucleotide
agcuucucauaaguguagguccuca

SEQ ID NO: 920 - DNA, 25 bp, Artificial Sequence
  Synthetic oligonucleotide
guccaaagacaguuuugaacaagtc

SEQ ID NO: 921 - DNA, 25 bp, Artificial Sequence
  Synthetic oligonucleotide
aguccaaagacaguuuugaacaagt

SEQ ID NO: 922 - DNA, 25 bp, Artificial Sequence
  Synthetic oligonucleotide
acauuuauaucaucggaacccagaa

SEQ ID NO: 923 - DNA, 25 bp, Artificial Sequence
  Synthetic oligonucleotide
accacauuuauaucaucggaaccca

SEQ ID NO: 924 - DNA, 25 bp, Artificial Sequence
  Synthetic oligonucleotide
gcacaggugaccacauuuauaucat

SEQ ID NO: 925 - DNA, 25 bp, Artificial Sequence
  Synthetic oligonucleotide
ugcacaggugaccacauuuauauca

SEQ ID NO: 926 - DNA, 25 bp, Artificial Sequence
  Synthetic oligonucleotide
guaauuauugcaagugagguuagag

SEQ ID NO: 927 - DNA, 25 bp, Artificial Sequence
  Synthetic oligonucleotide
ucaucuuguuuuuguaauuauugca

SEQ ID NO: 928 - DNA, 25 bp, Artificial Sequence
  Synthetic oligonucleotide
aucaucuuguuuuuguaauuauugc

SEQ ID NO: 929 - DNA, 25 bp, Artificial Sequence
  Synthetic oligonucleotide
accaucaucuuguuuuuguaauuat

SEQ ID NO: 930 - DNA, 25 bp, Artificial Sequence
  Synthetic oligonucleotide
ggcacaccaucaucuuguuuuugta

SEQ ID NO: 931 - DNA, 25 bp, Artificial Sequence
  Synthetic oligonucleotide
aauccaacaguugccuuuaucagag

SEQ ID NO: 932 - DNA, 25 bp, Artificial Sequence
  Synthetic oligonucleotide
gaaucaauccaacaguugccuuuat

SEQ ID NO: 933 - DNA, 25 bp, Artificial Sequence
  Synthetic oligonucleotide
ugaacuagucguggaauagcaccct

SEQ ID NO: 934 - DNA, 25 bp, Artificial Sequence
  Synthetic oligonucleotide
uacacccuucuacuaucuccuccat

SEQ ID NO: 935 - DNA, 25 bp, Artificial Sequence
  Synthetic oligonucleotide
guacacccuucuacuaucuccucca

SEQ ID NO: 936 - DNA, 25 bp, Artificial Sequence
  Synthetic oligonucleotide
aguacacccuucuacuaucuccucc

SEQ ID NO: 937 - DNA, 25 bp, Artificial Sequence
  Synthetic oligonucleotide
gcuccaguacacccuucuacuauct

SEQ ID NO: 938 - DNA, 25 bp, Artificial Sequence
  Synthetic oligonucleotide
acaauggaaugguauugaguccucg

SEQ ID NO: 939 - DNA, 25 bp, Artificial Sequence
  Synthetic oligonucleotide
gcacaaacaauggaaugguauugag

SEQ ID NO: 940 - DNA, 25 bp, Artificial Sequence
  Synthetic oligonucleotide
ugcacaaacaauggaaugguauuga

SEQ ID NO: 941 - DNA, 25 bp, Artificial Sequence
  Synthetic oligonucleotide
gcaacugcacaaacaauggaauggt

SEQ ID NO: 942 - DNA, 25 bp, Artificial Sequence
  Synthetic oligonucleotide
gaauaaagcaacugcacaaacaatg

SEQ ID NO: 943 - DNA, 25 bp, Artificial Sequence
  Synthetic oligonucleotide
ucaaugggagaauaaagcaacugca

SEQ ID NO: 944 - DNA, 25 bp, Artificial Sequence
  Synthetic oligonucleotide
uucaaugggagaauaaagcaacugc

SEQ ID NO: 945 - DNA, 25 bp, Artificial Sequence
  Synthetic oligonucleotide
uuucaaugggagaauaaagcaactg

SEQ ID NO: 946 - DNA, 25 bp, Artificial Sequence
  Synthetic oligonucleotide
auauuuucaaugggagaauaaagca

SEQ ID NO: 947 - DNA, 25 bp, Artificial Sequence
  Synthetic oligonucleotide
gauauuuucaaugggagaauaaagc

SEQ ID NO: 948 - DNA, 25 bp, Artificial Sequence
  Synthetic oligonucleotide
ggauauuuucaaugggagaauaaag

SEQ ID NO: 949 - DNA, 25 bp, Artificial Sequence
  Synthetic oligonucleotide
gcuacucuuuggauauuuucaaugg

SEQ ID NO: 950 - DNA, 25 bp, Artificial Sequence
  Synthetic oligonucleotide
agcuacucuuuggauauuuucaatg

SEQ ID NO: 951 - DNA, 25 bp, Artificial Sequence
  Synthetic oligonucleotide
gcuucuuguaauccuguggcuugtc

SEQ ID NO: 952 - DNA, 25 bp, Artificial Sequence
  Synthetic oligonucleotide
aguccaagaucugcagucucauucc

SEQ ID NO: 953 - DNA, 25 bp, Artificial Sequence
  Synthetic oligonucleotide
uauccaccagagugaaaagaacggt

SEQ ID NO: 954 - DNA, 25 bp, Artificial Sequence
  Synthetic oligonucleotide
ggccagcugauugcuaucaccuggg

SEQ ID NO: 955 - DNA, 25 bp, Artificial Sequence
  Synthetic oligonucleotide
auuuacaggucaguaucaaaccagg

SEQ ID NO: 956 - DNA, 25 bp, Artificial Sequence
  Synthetic oligonucleotide
gauuuacaggucaguaucaaaccag

SEQ ID NO: 957 - DNA, 25 bp, Artificial Sequence
  Synthetic oligonucleotide
ucuuaccuaaaggacgauuuacagg

SEQ ID NO: 958 - DNA, 25 bp, Artificial Sequence
  Synthetic oligonucleotide
uuucuuaccuaaaggacgauuuaca

SEQ ID NO: 959 - DNA, 25 bp, Artificial Sequence
  Synthetic oligonucleotide
uuuauaagcuuucuuaccuaaagga

SEQ ID NO: 960 - DNA, 25 bp, Artificial Sequence
  Synthetic oligonucleotide
uuuuauaagcuuucuuaccuaaagg

SEQ ID NO: 961 - DNA, 25 bp, Artificial Sequence
  Synthetic oligonucleotide
ggcuuuuauaagcuuucuuaccuaa

SEQ ID NO: 962 - DNA, 25 bp, Artificial Sequence
  Synthetic oligonucleotide
acacuggcuuuuauaagcuuucuta

SEQ ID NO: 963 - DNA, 25 bp, Artificial Sequence
  Synthetic oligonucleotide
ucacccacacuggcuuuuauaagct

SEQ ID NO: 964 - DNA, 25 bp, Artificial Sequence
  Synthetic oligonucleotide
uaccaagucuuucuggaguucugca

SEQ ID NO: 965 - DNA, 25 bp, Artificial Sequence
  Synthetic oligonucleotide
uuacaaacaggccuaaaaccauucc

SEQ ID NO: 966 - DNA, 25 bp, Artificial Sequence
  Synthetic oligonucleotide
uuuacaaacaggccuaaaaccautc

SEQ ID NO: 967 - DNA, 25 bp, Artificial Sequence
  Synthetic oligonucleotide
auuuacaaacaggccuaaaaccatt

SEQ ID NO: 968 - DNA, 25 bp, Artificial Sequence
  Synthetic oligonucleotide
ucuccuuccaagguauguaucugtt

SEQ ID NO: 969 - DNA, 25 bp, Artificial Sequence
  Synthetic oligonucleotide
aucuccuuccaagguauguaucugt

SEQ ID NO: 970 - DNA, 25 bp, Artificial Sequence
  Synthetic oligonucleotide
uuccacacaugaacaucuccuucca

SEQ ID NO: 971 - DNA, 25 bp, Artificial Sequence
  Synthetic oligonucleotide
aacuuccacacaugaacaucucctt

SEQ ID NO: 972 - DNA, 25 bp, Artificial Sequence
  Synthetic oligonucleotide
aaacuuccacacaugaacaucucct

SEQ ID NO: 973 - DNA, 25 bp, Artificial Sequence
  Synthetic oligonucleotide
gaaacuuccacacaugaacaucucc

SEQ ID NO: 974 - DNA, 25 bp, Artificial Sequence
  Synthetic oligonucleotide
agaaacuuccacacaugaacauctc

SEQ ID NO: 975 - DNA, 25 bp, Artificial Sequence
  Synthetic oligonucleotide
ucaacgugagaaacuuccacacatg

SEQ ID NO: 976 - DNA, 25 bp, Artificial Sequence
  Synthetic oligonucleotide
acaucaacgugagaaacuuccacac

SEQ ID NO: 977 - DNA, 25 bp, Artificial Sequence
  Synthetic oligonucleotide
aacaucaacgugagaaacuuccaca

SEQ ID NO: 978 - DNA, 25 bp, Artificial Sequence
  Synthetic oligonucleotide
aaacaucaacgugagaaacuuccac

SEQ ID NO: 979 - DNA, 25 bp, Artificial Sequence
  Synthetic oligonucleotide
aaaacaucaacgugagaaacuucca

SEQ ID NO: 980 - DNA, 25 bp, Artificial Sequence
  Synthetic oligonucleotide
aaaaacaucaacgugagaaacuucc

SEQ ID NO: 981 - DNA, 25 bp, Artificial Sequence
  Synthetic oligonucleotide
gcaaaaacaucaacgugagaaactt

SEQ ID NO: 982 - DNA, 25 bp, Artificial Sequence
  Synthetic oligonucleotide
gcaaaagcuguggcaaaaacaucaa

SEQ ID NO: 983 - DNA, 25 bp, Artificial Sequence
  Synthetic oligonucleotide
ugcaaaagcuguggcaaaaacauca

SEQ ID NO: 984 - DNA, 25 bp, Artificial Sequence
  Synthetic oligonucleotide
ucaucugaguauaacgcugcaaaag

SEQ ID NO: 985 - DNA, 25 bp, Artificial Sequence
  Synthetic oligonucleotide
aaaacagcaaauguuacucaucuga

SEQ ID NO: 986 - DNA, 25 bp, Artificial Sequence
  Synthetic oligonucleotide
gaaaacagcaaauguuacucauctg

SEQ ID NO: 987 - DNA, 25 bp, Artificial Sequence
  Synthetic oligonucleotide
ugaaaacagcaaauguuacucauct

SEQ ID NO: 988 - DNA, 25 bp, Artificial Sequence
  Synthetic oligonucleotide
auuaauguugaaaacagcaaaugtt

SEQ ID NO: 989 - DNA, 25 bp, Artificial Sequence
  Synthetic oligonucleotide
acuacagcuguauagagagaaaggc

SEQ ID NO: 990 - DNA, 25 bp, Artificial Sequence
  Synthetic oligonucleotide
ggccaaucacaaugcacguucagac

SEQ ID NO: 991 - DNA, 25 bp, Artificial Sequence
  Synthetic oligonucleotide
guucccauaggaaacucagcuuggt

SEQ ID NO: 992 - DNA, 25 bp, Artificial Sequence
  Synthetic oligonucleotide
gaacaaaaagcguacuucgacugtt

SEQ ID NO: 993 - DNA, 25 bp, Artificial Sequence
  Synthetic oligonucleotide
ggaccagaacaaaaagcguacuucg

SEQ ID NO: 994 - DNA, 25 bp, Artificial Sequence
  Synthetic oligonucleotide
accaaaaaggaccagaacaaaaagc

SEQ ID NO: 995 - DNA, 25 bp, Artificial Sequence
  Synthetic oligonucleotide
gaccaaaaaggaccagaacaaaaag

SEQ ID NO: 996 - DNA, 25 bp, Artificial Sequence
  Synthetic oligonucleotide
acuccucgaccaaaaaggaccagaa

SEQ ID NO: 997 - DNA, 25 bp, Artificial Sequence
  Synthetic oligonucleotide
uccauuuguauuguuacuccucgac

SEQ ID NO: 998 - DNA, 25 bp, Artificial Sequence
  Synthetic oligonucleotide
auccauuuguauuguuacuccucga

SEQ ID NO: 999 - DNA, 25 bp, Artificial Sequence
  Synthetic oligonucleotide
aauccauuuguauuguuacuccucg

SEQ ID NO: 1000 - DNA, 25 bp, Artificial Sequence
  Synthetic oligonucleotide
aaauccauuuguauuguuacucctc

SEQ ID NO: 1001 - DNA, 25 bp, Artificial Sequence
  Synthetic oligonucleotide
acuccccaaauccauuuguauugtt

SEQ ID NO: 1002 - DNA, 25 bp, Artificial Sequence
  Synthetic oligonucleotide
uccauucgugugcauucuucacugc

SEQ ID NO: 1003 - DNA, 25 bp, Artificial Sequence
  Synthetic oligonucleotide
auccauucgugugcauucuucactg

SEQ ID NO: 1004 - DNA, 25 bp, Artificial Sequence
  Synthetic oligonucleotide
gauccauucgugugcauucuucact

SEQ ID NO: 1005 - DNA, 25 bp, Artificial Sequence
  Synthetic oligonucleotide
aaacaaagaacaagcaaggcuaggg

SEQ ID NO: 1006 - DNA, 25 bp, Artificial Sequence
  Synthetic oligonucleotide
accacuacagauauuaaaacaaaga

SEQ ID NO: 1007 - DNA, 25 bp, Artificial Sequence
  Synthetic oligonucleotide
gcaccacuacagauauuaaaacaaa

SEQ ID NO: 1008 - DNA, 25 bp, Artificial Sequence
  Synthetic oligonucleotide
agcaccacuacagauauuaaaacaa

SEQ ID NO: 1009 - DNA, 25 bp, Artificial Sequence
  Synthetic oligonucleotide
aaaauaaaagcaagcaaagucagca

SEQ ID NO: 1010 - DNA, 25 bp, Artificial Sequence
  Synthetic oligonucleotide
gcaaaaaauaaaagcaagcaaagtc

SEQ ID NO: 1011 - DNA, 25 bp, Artificial Sequence
  Synthetic oligonucleotide
uuacugcaaaaaauaaaagcaagca

SEQ ID NO: 1012 - DNA, 25 bp, Artificial Sequence
  Synthetic oligonucleotide
uaacaguuacugcaaaaaauaaaag

SEQ ID NO: 1013 - DNA, 25 bp, Artificial Sequence
  Synthetic oligonucleotide
acuaacaguuacugcaaaaaauaaa

SEQ ID NO: 1014 - DNA, 25 bp, Artificial Sequence
  Synthetic oligonucleotide
aaacuaacaguuacugcaaaaaata

SEQ ID NO: 1015 - DNA, 25 bp, Artificial Sequence
  Synthetic oligonucleotide
aaaacuaacaguuacugcaaaaaat

SEQ ID NO: 1016 - DNA, 25 bp, Artificial Sequence
  Synthetic oligonucleotide
uaaaaacuaacaguuacugcaaaaa

SEQ ID NO: 1017 - DNA, 25 bp, Artificial Sequence
  Synthetic oligonucleotide
uacuuaaaaacuaacaguuacugca

SEQ ID NO: 1018 - DNA, 25 bp, Artificial Sequence
  Synthetic oligonucleotide
acuacuuaaaaacuaacaguuactg

SEQ ID NO: 1019 - DNA, 25 bp, Artificial Sequence
  Synthetic oligonucleotide
uaacacuacuuaaaaacuaacagtt

SEQ ID NO: 1020 - DNA, 25 bp, Artificial Sequence
  Synthetic oligonucleotide
auaacacuacuuaaaaacuaacagt

SEQ ID NO: 1021 - DNA, 25 bp, Artificial Sequence
  Synthetic oligonucleotide
acauaacacuacuuaaaaacuaaca

SEQ ID NO: 1022 - DNA, 25 bp, Artificial Sequence
  Synthetic oligonucleotide
aacauaacacuacuuaaaaacuaac

SEQ ID NO: 1023 - DNA, 25 bp, Artificial Sequence
  Synthetic oligonucleotide
gaacauaacacuacuuaaaaacuaa

SEQ ID NO: 1024 - DNA, 25 bp, Artificial Sequence
  Synthetic oligonucleotide
agaacauaacacuacuuaaaaacta

SEQ ID NO: 1025 - DNA, 25 bp, Artificial Sequence
  Synthetic oligonucleotide
ucacuagaacauaacacuacuuaaa

SEQ ID NO: 1026 - DNA, 25 bp, Artificial Sequence
  Synthetic oligonucleotide
guucacuagaacauaacacuacuta

SEQ ID NO: 1027 - DNA, 25 bp, Artificial Sequence
  Synthetic oligonucleotide
gguucacuagaacauaacacuactt

SEQ ID NO: 1028 - DNA, 25 bp, Artificial Sequence
  Synthetic oligonucleotide
auuacucgguucuuagaaaucagaa

SEQ ID NO: 1029 - DNA, 25 bp, Artificial Sequence
  Synthetic oligonucleotide
accauuacucgguucuuagaaauca

SEQ ID NO: 1030 - DNA, 25 bp, Artificial Sequence
  Synthetic oligonucleotide
ucuacaccauuacucgguucuuaga

SEQ ID NO: 1031 - DNA, 25 bp, Artificial Sequence
  Synthetic oligonucleotide
gaauuaguguucuacaccauuactc

SEQ ID NO: 1032 - DNA, 25 bp, Artificial Sequence
  Synthetic oligonucleotide
auuaugaauuaguguucuacaccat

SEQ ID NO: 1033 - DNA, 25 bp, Artificial Sequence
  Synthetic oligonucleotide
gauuaugaauuaguguucuacacca

SEQ ID NO: 1034 - DNA, 25 bp, Artificial Sequence
  Synthetic oligonucleotide
ugauuaugaauuaguguucuacacc

SEQ ID NO: 1035 - DNA, 25 bp, Artificial Sequence
  Synthetic oligonucleotide
acaauuagcgugauuaugaauuagt

SEQ ID NO: 1036 - DNA, 25 bp, Artificial Sequence
  Synthetic oligonucleotide
uacaauuagcgugauuaugaauuag

SEQ ID NO: 1037 - DNA, 25 bp, Artificial Sequence
  Synthetic oligonucleotide
agauuacaauuagcgugauuaugaa

SEQ ID NO: 1038 - DNA, 25 bp, Artificial Sequence
  Synthetic oligonucleotide
uacacgucuccagauuacaauuagc

SEQ ID NO: 1039 - DNA, 25 bp, Artificial Sequence
  Synthetic oligonucleotide
guuacacgucuccagauuacaauta

SEQ ID NO: 1040 - DNA, 25 bp, Artificial Sequence
  Synthetic oligonucleotide
uacacaauguuacacgucuccagat

SEQ ID NO: 1041 - DNA, 25 bp, Artificial Sequence
  Synthetic oligonucleotide
gcuacacaauguuacacgucuccag

SEQ ID NO: 1042 - DNA, 25 bp, Artificial Sequence
  Synthetic oligonucleotide
acaaaaggcuacacaauguuacacg

SEQ ID NO: 1043 - DNA, 25 bp, Artificial Sequence
  Synthetic oligonucleotide
uacaaaaggcuacacaauguuacac

SEQ ID NO: 1044 - DNA, 25 bp, Artificial Sequence
  Synthetic oligonucleotide
uuuauacaaaaggcuacacaaugtt

SEQ ID NO: 1045 - DNA, 25 bp, Artificial Sequence
  Synthetic oligonucleotide
auuuauacaaaaggcuacacaaugt

SEQ ID NO: 1046 - DNA, 25 bp, Artificial Sequence
  Synthetic oligonucleotide
ucuauuuauacaaaaggcuacacaa

SEQ ID NO: 1047 - DNA, 25 bp, Artificial Sequence
  Synthetic oligonucleotide
gucuauuuauacaaaaggcuacaca

SEQ ID NO: 1048 - DNA, 25 bp, Artificial Sequence
  Synthetic oligonucleotide
ugucuauuuauacaaaaggcuacac

SEQ ID NO: 1049 - DNA, 25 bp, Artificial Sequence
  Synthetic oligonucleotide
ucuaucugucuauuuauacaaaagg

SEQ ID NO: 1050 - DNA, 25 bp, Artificial Sequence
  Synthetic oligonucleotide
uucuaucugucuauuuauacaaaag

SEQ ID NO: 1051 - DNA, 25 bp, Artificial Sequence
  Synthetic oligonucleotide
uuucuaucugucuauuuauacaaaa

SEQ ID NO: 1052 - DNA, 25 bp, Artificial Sequence
  Synthetic oligonucleotide
auuucuaucugucuauuuauacaaa

SEQ ID NO: 1053 - DNA, 25 bp, Artificial Sequence
  Synthetic oligonucleotide
gaccauuucuaucugucuauuuata

SEQ ID NO: 1054 - DNA, 25 bp, Artificial Sequence
  Synthetic oligonucleotide
ggaccauuucuaucugucuauuuat

SEQ ID NO: 1055 - DNA, 25 bp, Artificial Sequence
  Synthetic oligonucleotide
acuaaucggaccauuucuaucugtc

SEQ ID NO: 1056 - DNA, 25 bp, Artificial Sequence
  Synthetic oligonucleotide
aacuaaucggaccauuucuaucugt

SEQ ID NO: 1057 - DNA, 25 bp, Artificial Sequence
  Synthetic oligonucleotide
aaacuaaucggaccauuucuauctg

SEQ ID NO: 1058 - DNA, 25 bp, Artificial Sequence
  Synthetic oligonucleotide
gaaacuaaucggaccauuucuauct

SEQ ID NO: 1059 - DNA, 25 bp, Artificial Sequence
  Synthetic oligonucleotide
uaaaaaggaaacuaaucggaccatt

SEQ ID NO: 1060 - DNA, 25 bp, Artificial Sequence
  Synthetic oligonucleotide
gcauauuaaaaaggaaacuaaucgg

SEQ ID NO: 1061 - DNA, 25 bp, Artificial Sequence
  Synthetic oligonucleotide
agcauauuaaaaaggaaacuaaucg

SEQ ID NO: 1062 - DNA, 25 bp, Artificial Sequence
  Synthetic oligonucleotide
uuuaagcauauuaaaaaggaaacta

SEQ ID NO: 1063 - DNA, 25 bp, Artificial Sequence
  Synthetic oligonucleotide
gcuuauuuuaagcauauuaaaaagg

SEQ ID NO: 1064 - DNA, 25 bp, Artificial Sequence
  Synthetic oligonucleotide
ugcuuauuuuaagcauauuaaaaag

SEQ ID NO: 1065 - DNA, 25 bp, Artificial Sequence
  Synthetic oligonucleotide
uccaccugcuuauuuuaagcauatt

SEQ ID NO: 1066 - DNA, 25 bp, Artificial Sequence
  Synthetic oligonucleotide
aaaacaugaaauagauccaccugct

SEQ ID NO: 1067 - DNA, 25 bp, Artificial Sequence
  Synthetic oligonucleotide
aaaaacaugaaauagauccaccugc

SEQ ID NO: 1068 - DNA, 25 bp, Artificial Sequence
  Synthetic oligonucleotide
ucaaaaacaugaaauagauccacct

SEQ ID NO: 1069 - DNA, 25 bp, Artificial Sequence
  Synthetic oligonucleotide
uucaaaaacaugaaauagauccacc

SEQ ID NO: 1070 - DNA, 25 bp, Artificial Sequence
  Synthetic oligonucleotide
guucaaaaacaugaaauagauccac

SEQ ID NO: 1071 - DNA, 25 bp, Artificial Sequence
  Synthetic oligonucleotide
uuuuuguucaaaaacaugaaauaga

SEQ ID NO: 1072 - DNA, 25 bp, Artificial Sequence
  Synthetic oligonucleotide
auaaaguuuuuguucaaaaacauga

SEQ ID NO: 1073 - DNA, 25 bp, Artificial Sequence
  Synthetic oligonucleotide
uccccgauaaaguuuuuguucaaaa

SEQ ID NO: 1074 - DNA, 25 bp, Artificial Sequence
  Synthetic oligonucleotide
auccccgauaaaguuuuuguucaaa

SEQ ID NO: 1075 - DNA, 25 bp, Artificial Sequence
  Synthetic oligonucleotide
accucuuacugauuuacccuaccgc

SEQ ID NO: 1076 - DNA, 25 bp, Artificial Sequence
  Synthetic oligonucleotide
acaccucuuacugauuuacccuacc

SEQ ID NO: 1077 - DNA, 25 bp, Artificial Sequence
  Synthetic oligonucleotide
aacaccucuuacugauuuacccuac

SEQ ID NO: 1078 - DNA, 25 bp, Artificial Sequence
  Synthetic oligonucleotide
uaacaccucuuacugauuuacccta

SEQ ID NO: 1079 - DNA, 25 bp, Artificial Sequence
  Synthetic oligonucleotide
auaacaccucuuacugauuuaccct

SEQ ID NO: 1080 - DNA, 25 bp, Artificial Sequence
  Synthetic oligonucleotide
aauaacaccucuuacugauuuaccc

SEQ ID NO: 1081 - DNA, 25 bp, Artificial Sequence
  Synthetic oligonucleotide
ggcucaaauaacaccucuuacugat

SEQ ID NO: 1082 - DNA, 25 bp, Artificial Sequence
  Synthetic oligonucleotide
aacaaggcucaaauaacaccucuta

SEQ ID NO: 1083 - DNA, 25 bp, Artificial Sequence
  Synthetic oligonucleotide
aaacaaggcucaaauaacaccuctt

SEQ ID NO: 1084 - DNA, 25 bp, Artificial Sequence
  Synthetic oligonucleotide
aaaacaaggcucaaauaacaccuct

SEQ ID NO: 1085 - DNA, 25 bp, Artificial Sequence
  Synthetic oligonucleotide
uccaaaacaaggcucaaauaacacc

SEQ ID NO: 1086 - DNA, 25 bp, Artificial Sequence
  Synthetic oligonucleotide
uguccaaaacaaggcucaaauaaca

SEQ ID NO: 1087 - DNA, 25 bp, Artificial Sequence
  Synthetic oligonucleotide
uauacuguccaaaacaaggcucaaa

SEQ ID NO: 1088 - DNA, 25 bp, Artificial Sequence
  Synthetic oligonucleotide
gcaacugguauacuguccaaaacaa

SEQ ID NO: 1089 - DNA, 25 bp, Artificial Sequence
  Synthetic oligonucleotide
gauaaaaggcaacugguauacugtc

SEQ ID NO: 1090 - DNA, 25 bp, Artificial Sequence
  Synthetic oligonucleotide
ggauaaaaggcaacugguauacugt

SEQ ID NO: 1091 - DNA, 25 bp, Artificial Sequence
  Synthetic oligonucleotide
aacuuugggauaaaaggcaacuggt

SEQ ID NO: 1092 - DNA, 25 bp, Artificial Sequence
  Synthetic oligonucleotide
acaacuuugggauaaaaggcaactg

SEQ ID NO: 1093 - DNA, 25 bp, Artificial Sequence
  Synthetic oligonucleotide
uuacaacaacuuugggauaaaaggc

SEQ ID NO: 1094 - DNA, 25 bp, Artificial Sequence
  Synthetic oligonucleotide
guuacaacaacuuugggauaaaagg

SEQ ID NO: 1095 - DNA, 25 bp, Artificial Sequence
  Synthetic oligonucleotide
gguuacaacaacuuugggauaaaag

SEQ ID NO: 1096 - DNA, 25 bp, Artificial Sequence
  Synthetic oligonucleotide
ucacagcagguuacaacaacuuugg

SEQ ID NO: 1097 - DNA, 25 bp, Artificial Sequence
  Synthetic oligonucleotide
aucacagcagguuacaacaacuutg

SEQ ID NO: 1098 - DNA, 25 bp, Artificial Sequence
  Synthetic oligonucleotide
guaucacagcagguuacaacaactt

SEQ ID NO: 1099 - DNA, 25 bp, Artificial Sequence
  Synthetic oligonucleotide
gcaucuguugaagcauuguaucaca

SEQ ID NO: 1100 - DNA, 25 bp, Artificial Sequence
  Synthetic oligonucleotide
ugaaccauuucuauaaccgcauctg

SEQ ID NO: 1101 - DNA, 25 bp, Artificial Sequence
  Synthetic oligonucleotide
auucugaaccauuucuauaaccgca

SEQ ID NO: 1102 - DNA, 25 bp, Artificial Sequence
  Synthetic oligonucleotide
uaauucugaaccauuucuauaaccg

SEQ ID NO: 1103 - DNA, 25 bp, Artificial Sequence
  Synthetic oligonucleotide
uuaauucugaaccauuucuauaacc

SEQ ID NO: 1104 - DNA, 25 bp, Artificial Sequence
  Synthetic oligonucleotide
uuuaauucugaaccauuucuauaac

SEQ ID NO: 1105 - DNA, 25 bp, Artificial Sequence
  Synthetic oligonucleotide
guuuaauucugaaccauuucuauaa

SEQ ID NO: 1106 - DNA, 25 bp, Artificial Sequence
  Synthetic oligonucleotide
uaaaaguuuaauucugaaccauutc

SEQ ID NO: 1107 - DNA, 25 bp, Artificial Sequence
  Synthetic oligonucleotide
uuaaaaguuuaauucugaaccautt

SEQ ID NO: 1108 - DNA, 25 bp, Artificial Sequence
  Synthetic oligonucleotide
aauuaaaaguuuaauucugaaccat

SEQ ID NO: 1109 - DNA, 25 bp, Artificial Sequence
  Synthetic oligonucleotide
ugaaugaauuaaaaguuuaauuctg

SEQ ID NO: 1110 - DNA, 25 bp, Artificial Sequence
  Synthetic oligonucleotide
uuuuugaaugaauuaaaaguuuaat

SEQ ID NO: 1111 - DNA, 25 bp, Artificial Sequence
  Synthetic oligonucleotide
uuuuuuuuugaaugaauuaaaagtt

SEQ ID NO: 1112 - DNA, 25 bp, Artificial Sequence
  Synthetic oligonucleotide
uuuuuuuuuugaaugaauuaaaagt

SEQ ID NO: 1113 - DNA, 25 bp, Artificial Sequence
  Synthetic oligonucleotide
uuuuuuuuuuugaaugaauuaaaag

SEQ ID NO: 1114 - DNA, 25 bp, Artificial Sequence
  Synthetic oligonucleotide
uuuuuuuuuuuugaaugaauuaaaa

SEQ ID NO: 1115 - DNA, 25 bp, Artificial Sequence
  Synthetic oligonucleotide
uuuuuuuuuuuuugaaugaauuaaa

SEQ ID NO: 1116 - DNA, 25 bp, Artificial Sequence
  Synthetic oligonucleotide
uuuuuuuuuuuuuugaaugaauuaa

SEQ ID NO: 1117 - RNA, 27 nt, Artificial Sequence
  Synthetic oligonucleotide
uaugguauacuucaaauacccucaggg

SEQ ID NO: 1118 - RNA, 27 nt, Artificial Sequence
  Synthetic oligonucleotide
guuguaugguauacuucaaauacccuc

SEQ ID NO: 1119 - RNA, 27 nt, Artificial Sequence
  Synthetic oligonucleotide
uucaaaacaguuguaugguauacuuca

SEQ ID NO: 1120 - RNA, 27 nt, Artificial Sequence
  Synthetic oligonucleotide
uggauuuucaaaacaguuguaugguau

SEQ ID NO: 1121 - RNA, 27 nt, Artificial Sequence
  Synthetic oligonucleotide
cacgcuggauuuucaaaacaguuguau

SEQ ID NO: 1122 - RNA, 27 nt, Artificial Sequence
  Synthetic oligonucleotide
uugagugaaggacugagaaaaucccug

SEQ ID NO: 1123 - RNA, 27 nt, Artificial Sequence
  Synthetic oligonucleotide
ucaauaucagcuacuuguucuugagug

SEQ ID NO: 1124 - RNA, 27 nt, Artificial Sequence
  Synthetic oligonucleotide
uguccaucaauaucagcuacuuguucu

SEQ ID NO: 1125 - RNA, 27 nt, Artificial Sequence
  Synthetic oligonucleotide
acuguccaucaauaucagcuacuuguu

SEQ ID NO: 1126 - RNA, 27 nt, Artificial Sequence
  Synthetic oligonucleotide
gcucgagucauugcauacuguccauca

SEQ ID NO: 1127 - RNA, 27 nt, Artificial Sequence
  Synthetic oligonucleotide
ucaucuaaugucucagggaacauagca

SEQ ID NO: 1128 - RNA, 27 nt, Artificial Sequence
  Synthetic oligonucleotide
ucaaguuuacaacugcauguuucagca

SEQ ID NO: 1129 - RNA, 27 nt, Artificial Sequence
  Synthetic oligonucleotide
aguuaaucaaguuuacaacugcauguu

SEQ ID NO: 1130 - RNA, 27 nt, Artificial Sequence
  Synthetic oligonucleotide
uugauaguuaaucaaguuuacaacugc

SEQ ID NO: 1131 - RNA, 27 nt, Artificial Sequence
  Synthetic oligonucleotide
cugcaucaucuugauaguuaaucaagu

SEQ ID NO: 1132 - RNA, 27 nt, Artificial Sequence
  Synthetic oligonucleotide
ucauuuagcaguuuugucaguucaggg

SEQ ID NO: 1133 - RNA, 27 nt, Artificial Sequence
  Synthetic oligonucleotide
guacguacaauagcagacaccaucuga

SEQ ID NO: 1134 - RNA, 27 nt, Artificial Sequence
  Synthetic oligonucleotide
aucauuuguauucugcaugguacguac

SEQ ID NO: 1135 - RNA, 27 nt, Artificial Sequence
  Synthetic oligonucleotide
uaauaaaagguuguggagaguuguaau

SEQ ID NO: 1136 - RNA, 27 nt, Artificial Sequence
  Synthetic oligonucleotide
ugauguaauaaaagguuguggagaguu

SEQ ID NO: 1137 - RNA, 27 nt, Artificial Sequence
  Synthetic oligonucleotide
cuucuugauguaauaaaagguugugga

SEQ ID NO: 1138 - RNA, 27 nt, Artificial Sequence
  Synthetic oligonucleotide
uagcuccuucuugauguaauaaaaggu

SEQ ID NO: 1139 - RNA, 27 nt, Artificial Sequence
  Synthetic oligonucleotide
uagccaagaauuuaacauuuguuuugu

SEQ ID NO: 1140 - RNA, 27 nt, Artificial Sequence
  Synthetic oligonucleotide
uaaaauuugaaggcagucugucguaau

SEQ ID NO: 1141 - RNA, 27 nt, Artificial Sequence
  Synthetic oligonucleotide
uaagcuaaaauuugaaggcagucuguc

SEQ ID NO: 1142 - RNA, 27 nt, Artificial Sequence
  Synthetic oligonucleotide
uagguccucauuauauuuacuaaagcu

SEQ ID NO: 1143 - RNA, 27 nt, Artificial Sequence
  Synthetic oligonucleotide
ucugcuugugguccacaguaguuuuuc

SEQ ID NO: 1144 - RNA, 27 nt, Artificial Sequence
  Synthetic oligonucleotide
gacaguucugaacaagacguugacuug

SEQ ID NO: 1145 - RNA, 27 nt, Artificial Sequence
  Synthetic oligonucleotide
uccaaagacaguucugaacaagacguu

SEQ ID NO: 1146 - RNA, 27 nt, Artificial Sequence
  Synthetic oligonucleotide
gagaguccaaagacaguucugaacaag

SEQ ID NO: 1147 - RNA, 27 nt, Artificial Sequence
  Synthetic oligonucleotide
ugaccacauuuauaucaucugaaccca

SEQ ID NO: 1148 - RNA, 27 nt, Artificial Sequence
  Synthetic oligonucleotide
auuauugcaagugagguuagaaagaau

SEQ ID NO: 1149 - RNA, 27 nt, Artificial Sequence
  Synthetic oligonucleotide
uguucuuauaauuauugcaagugaggu

SEQ ID NO: 1150 - RNA, 27 nt, Artificial Sequence
  Synthetic oligonucleotide
caucaucuuguucuuauaauuauugca

SEQ ID NO: 1151 - RNA, 27 nt, Artificial Sequence
  Synthetic oligonucleotide
acaguacgcacaagagccucuauacca

SEQ ID NO: 1152 - RNA, 27 nt, Artificial Sequence
  Synthetic oligonucleotide
auuucgaaucaauccaacaguagccuu

SEQ ID NO: 1153 - RNA, 27 nt, Artificial Sequence
  Synthetic oligonucleotide
acaaccuucaacuauuucuuccaugcg

SEQ ID NO: 1154 - RNA, 27 nt, Artificial Sequence
  Synthetic oligonucleotide
guacaaccuucaacuauuucuuccaug

SEQ ID NO: 1155 - RNA, 27 nt, Artificial Sequence
  Synthetic oligonucleotide
cagcuacucuuuggauguuuucaaugg

SEQ ID NO: 1156 - RNA, 27 nt, Artificial Sequence
  Synthetic oligonucleotide
ucuuguaaucuuguggcuuguccucag

SEQ ID NO: 1157 - RNA, 27 nt, Artificial Sequence
  Synthetic oligonucleotide
aaaggaugauuuacaggucaguaucaa

SEQ ID NO: 1158 - RNA, 27 nt, Artificial Sequence
  Synthetic oligonucleotide
uggcuuuuuaaaacuucuuaccuaaag

SEQ ID NO: 1159 - RNA, 27 nt, Artificial Sequence
  Synthetic oligonucleotide
caucuccuuucaaaguauauaccuguu

SEQ ID NO: 1160 - RNA, 27 nt, Artificial Sequence
  Synthetic oligonucleotide
aaaaaacauuaaaguuaauaacuucca

SEQ ID NO: 1161 - RNA, 27 nt, Artificial Sequence
  Synthetic oligonucleotide
gaguauuaaguugcaaaagcuguggca

SEQ ID NO: 1162 - RNA, 27 nt, Artificial Sequence
  Synthetic oligonucleotide
cuauuaauguuuaaaacagcaaauguu

SEQ ID NO: 1163 - RNA, 27 nt, Artificial Sequence
  Synthetic oligonucleotide
cagaacaaaaaguuuacuucaauuguu

SEQ ID NO: 1164 - RNA, 27 nt, Artificial Sequence
  Synthetic oligonucleotide
aaaauuuaacaagcaaggcuaggguuu

SEQ ID NO: 1165 - RNA, 27 nt, Artificial Sequence
  Synthetic oligonucleotide
aaaaaaaaaauuuaacaagcaaggcua

SEQ ID NO: 1166 - RNA, 27 nt, Artificial Sequence
  Synthetic oligonucleotide
aaaaaaaaaaaaaaagagcuacuucaa

SEQ ID NO: 1167 - RNA, 27 nt, Artificial Sequence
  Synthetic oligonucleotide
aguauucacuauaacuuaacacuacga

SEQ ID NO: 1168 - RNA, 27 nt, Artificial Sequence
  Synthetic oligonucleotide
uagaaauugcuguagcaguauucacua

SEQ ID NO: 1169 - RNA, 27 nt, Artificial Sequence
  Synthetic oligonucleotide
aaaauuagaaauugcuguagcaguauu

SEQ ID NO: 1170 - RNA, 27 nt, Artificial Sequence
  Synthetic oligonucleotide
ccauuacucaauucuuaaaaauuagaa

SEQ ID NO: 1171 - RNA, 27 nt, Artificial Sequence
  Synthetic oligonucleotide
cuacaccauuacucaauucuuaaaaau

SEQ ID NO: 1172 - RNA, 27 nt, Artificial Sequence
  Synthetic oligonucleotide
auuacaauuaauuagagugauuaugaa

SEQ ID NO: 1173 - RNA, 27 nt, Artificial Sequence
  Synthetic oligonucleotide
uuacacuuuauucagauuacaauuaau

SEQ ID NO: 1174 - RNA, 27 nt, Artificial Sequence
  Synthetic oligonucleotide
aauuguuacacuuuauucagauuacaa

SEQ ID NO: 1175 - RNA, 27 nt, Artificial Sequence
  Synthetic oligonucleotide
cuacacaauuguuacacuuuauucaga

SEQ ID NO: 1176 - RNA, 27 nt, Artificial Sequence
  Synthetic oligonucleotide
ugucuauuuuauacaaaaaggcuacac

SEQ ID NO: 1177 - RNA, 27 nt, Artificial Sequence
  Synthetic oligonucleotide
auuuucuauuugucuauuuuauacaaa

SEQ ID NO: 1178 - RNA, 27 nt, Artificial Sequence
  Synthetic oligonucleotide
aaaaggaaacuaauuggaccauuuucu

SEQ ID NO: 1179 - RNA, 27 nt, Artificial Sequence
  Synthetic oligonucleotide
gcauauuaaaaaggaaacuaauuggac

SEQ ID NO: 1180 - RNA, 27 nt, Artificial Sequence
  Synthetic oligonucleotide
auaucccaaauaguuuuugaucaaaaa

SEQ ID NO: 1181 - RNA, 27 nt, Artificial Sequence
  Synthetic oligonucleotide
aaaacaagguuccaaauaacaccucuu

SEQ ID NO: 1182 - RNA, 27 nt, Artificial Sequence
  Synthetic oligonucleotide
uguccaaaacaagguuccaaauaacac

SEQ ID NO: 1183 - RNA, 27 nt, Artificial Sequence
  Synthetic oligonucleotide
acugguaaacuguccaaaacaagguuc

SEQ ID NO: 1184 - RNA, 27 nt, Artificial Sequence
  Synthetic oligonucleotide
gcauuuucucuugaagcaucguaucac

SEQ ID NO: 1185 - RNA, 27 nt, Artificial Sequence
  Synthetic oligonucleotide
uuuuuuauaaccgcauuuucucuugaa

SEQ ID NO: 1186 - RNA, 27 nt, Artificial Sequence
  Synthetic oligonucleotide
aaccauuuuuuauaaccgcauuuucuc

SEQ ID NO: 1187 - RNA, 27 nt, Artificial Sequence
  Synthetic oligonucleotide
uuaauucugaaccauuuuuuauaaccg

SEQ ID NO: 1188 - RNA, 27 nt, Artificial Sequence
  Synthetic oligonucleotide
uaaaaguuuaauucugaaccauuuuuu

SEQ ID NO: 1189 - RNA, 27 nt, Artificial Sequence
  Synthetic oligonucleotide
cagcuugaguagccauuguccacgcug

SEQ ID NO: 1190 - RNA, 27 nt, Artificial Sequence
  Synthetic oligonucleotide
ucagcuugaguagccauuguccacgcu

SEQ ID NO: 1191 - RNA, 27 nt, Artificial Sequence
  Synthetic oligonucleotide
aucagcuugaguagccauuguccacgc

SEQ ID NO: 1192 - RNA, 27 nt, Artificial Sequence
  Synthetic oligonucleotide
aaucagcuugaguagccauuguccacg

SEQ ID NO: 1193 - RNA, 27 nt, Artificial Sequence
  Synthetic oligonucleotide
aaaucagcuugaguagccauuguccac

SEQ ID NO: 1194 - RNA, 27 nt, Artificial Sequence
  Synthetic oligonucleotide
caaaucagcuugaguagccauugucca

SEQ ID NO: 1195 - RNA, 27 nt, Artificial Sequence
  Synthetic oligonucleotide
ucaaaucagcuugaguagccauugucc

SEQ ID NO: 1196 - RNA, 27 nt, Artificial Sequence
  Synthetic oligonucleotide
aucaaaucagcuugaguagccauuguc

SEQ ID NO: 1197 - RNA, 27 nt, Artificial Sequence
  Synthetic oligonucleotide
uccauggccauguccaacuccaucaaa

SEQ ID NO: 1198 - RNA, 27 nt, Artificial Sequence
  Synthetic oligonucleotide
uuccauggccauguccaacuccaucaa

SEQ ID NO: 1199 - RNA, 27 nt, Artificial Sequence
  Synthetic oligonucleotide
guuccauggccauguccaacuccauca

SEQ ID NO: 1200 - RNA, 27 nt, Artificial Sequence
  Synthetic oligonucleotide
gguuccauggccauguccaacuccauc

SEQ ID NO: 1201 - RNA, 27 nt, Artificial Sequence
  Synthetic oligonucleotide
ugguuccauggccauguccaacuccau

SEQ ID NO: 1202 - RNA, 27 nt, Artificial Sequence
  Synthetic oligonucleotide
cugguuccauggccauguccaacucca

SEQ ID NO: 1203 - RNA, 27 nt, Artificial Sequence
  Synthetic oligonucleotide
ucugguuccauggccauguccaacucc

SEQ ID NO: 1204 - RNA, 27 nt, Artificial Sequence
  Synthetic oligonucleotide
uaguggcaccagaauggauuccagagu

SEQ ID NO: 1205 - RNA, 27 nt, Artificial Sequence
  Synthetic oligonucleotide
guaguggcaccagaauggauuccagag

SEQ ID NO: 1206 - RNA, 27 nt, Artificial Sequence
  Synthetic oligonucleotide
gguaguggcaccagaauggauuccaga

SEQ ID NO: 1207 - RNA, 27 nt, Artificial Sequence
  Synthetic oligonucleotide
ugguaguggcaccagaauggauuccag

SEQ ID NO: 1208 - RNA, 27 nt, Artificial Sequence
  Synthetic oligonucleotide
gugguaguggcaccagaauggauucca

SEQ ID NO: 1209 - RNA, 27 nt, Artificial Sequence
  Synthetic oligonucleotide
gaugggaucugcaugcccucaucuaau

SEQ ID NO: 1210 - RNA, 27 nt, Artificial Sequence
  Synthetic oligonucleotide
agaugggaucugcaugcccucaucuaa

SEQ ID NO: 1211 - RNA, 27 nt, Artificial Sequence
  Synthetic oligonucleotide
uagaugggaucugcaugcccucaucua

SEQ ID NO: 1212 - RNA, 27 nt, Artificial Sequence
  Synthetic oligonucleotide
guagaugggaucugcaugcccucaucu

SEQ ID NO: 1213 - RNA, 27 nt, Artificial Sequence
  Synthetic oligonucleotide
uguagaugggaucugcaugcccucauc

SEQ ID NO: 1214 - RNA, 27 nt, Artificial Sequence
  Synthetic oligonucleotide
guguagaugggaucugcaugcccucau

SEQ ID NO: 1215 - RNA, 27 nt, Artificial Sequence
  Synthetic oligonucleotide
gcuggacauuagugggaugagcagcau

SEQ ID NO: 1216 - RNA, 27 nt, Artificial Sequence
  Synthetic oligonucleotide
cgcuggacauuagugggaugagcagca

SEQ ID NO: 1217 - RNA, 27 nt, Artificial Sequence
  Synthetic oligonucleotide
acgcuggacauuagugggaugagcagc

SEQ ID NO: 1218 - RNA, 27 nt, Artificial Sequence
  Synthetic oligonucleotide
aacgcuggacauuagugggaugagcag

SEQ ID NO: 1219 - RNA, 27 nt, Artificial Sequence
  Synthetic oligonucleotide
aaacgcuggacauuagugggaugagca

SEQ ID NO: 1220 - RNA, 27 nt, Artificial Sequence
  Synthetic oligonucleotide
caaacgcuggacauuagugggaugagc

SEQ ID NO: 1221 - RNA, 27 nt, Artificial Sequence
  Synthetic oligonucleotide
ccaaacgcuggacauuagugggaugag

SEQ ID NO: 1222 - RNA, 27 nt, Artificial Sequence
  Synthetic oligonucleotide
gccaaacgcuggacauuagugggauga

SEQ ID NO: 1223 - RNA, 27 nt, Artificial Sequence
  Synthetic oligonucleotide
ucagcaucugugaugguucagccaaac

SEQ ID NO: 1224 - RNA, 27 nt, Artificial Sequence
  Synthetic oligonucleotide
uucagcaucugugaugguucagccaaa

SEQ ID NO: 1225 - RNA, 27 nt, Artificial Sequence
  Synthetic oligonucleotide
uuucagcaucugugaugguucagccaa

SEQ ID NO: 1226 - RNA, 27 nt, Artificial Sequence
  Synthetic oligonucleotide
cagggauugcacguguggcaaguucug

SEQ ID NO: 1227 - RNA, 27 nt, Artificial Sequence
  Synthetic oligonucleotide
ucagggauugcacguguggcaaguucu

SEQ ID NO: 1228 - RNA, 27 nt, Artificial Sequence
  Synthetic oligonucleotide
uuuuagaaagcugauggaccauaacug

SEQ ID NO: 1229 - RNA, 27 nt, Artificial Sequence
  Synthetic oligonucleotide
uuuuuagaaagcugauggaccauaacu

SEQ ID NO: 1230 - RNA, 27 nt, Artificial Sequence
  Synthetic oligonucleotide
uagcgugucuggaagcuuccuuuuuag

SEQ ID NO: 1231 - RNA, 27 nt, Artificial Sequence
  Synthetic oligonucleotide
auagcgugucuggaagcuuccuuuuua

SEQ ID NO: 1232 - RNA, 27 nt, Artificial Sequence
  Synthetic oligonucleotide
cuacaucauuuguauucugcaugguac

SEQ ID NO: 1233 - RNA, 27 nt, Artificial Sequence
  Synthetic oligonucleotide
ucuacaucauuuguauucugcauggua

SEQ ID NO: 1234 - RNA, 27 nt, Artificial Sequence
  Synthetic oligonucleotide
uucuacaucauuuguauucugcauggu

SEQ ID NO: 1235 - RNA, 27 nt, Artificial Sequence
  Synthetic oligonucleotide
uuucuacaucauuuguauucugcaugg

SEQ ID NO: 1236 - RNA, 27 nt, Artificial Sequence
  Synthetic oligonucleotide
guuucuacaucauuuguauucugcaug

SEQ ID NO: 1237 - RNA, 27 nt, Artificial Sequence
  Synthetic oligonucleotide
uguuucuacaucauuuguauucugcau

SEQ ID NO: 1238 - RNA, 27 nt, Artificial Sequence
  Synthetic oligonucleotide
cuguuucuacaucauuuguauucugca

SEQ ID NO: 1239 - RNA, 27 nt, Artificial Sequence
  Synthetic oligonucleotide
gcuguuucuacaucauuuguauucugc

SEQ ID NO: 1240 - RNA, 27 nt, Artificial Sequence
  Synthetic oligonucleotide
ugccuccagacuuaaagauggccagua

SEQ ID NO: 1241 - RNA, 27 nt, Artificial Sequence
  Synthetic oligonucleotide
augccuccagacuuaaagauggccagu

SEQ ID NO: 1242 - RNA, 27 nt, Artificial Sequence
  Synthetic oligonucleotide
aacgcacugccauuuuagcuccuucuu

SEQ ID NO: 1243 - RNA, 27 nt, Artificial Sequence
  Synthetic oligonucleotide
aaacgcacugccauuuuagcuccuucu

SEQ ID NO: 1244 - RNA, 27 nt, Artificial Sequence
  Synthetic oligonucleotide
uaaacgcacugccauuuuagcuccuuc

SEQ ID NO: 1245 - RNA, 27 nt, Artificial Sequence
  Synthetic oligonucleotide
cuaaacgcacugccauuuuagcuccuu

SEQ ID NO: 1246 - RNA, 27 nt, Artificial Sequence
  Synthetic oligonucleotide
gcuaaacgcacugccauuuuagcuccu

SEQ ID NO: 1247 - RNA, 27 nt, Artificial Sequence
  Synthetic oligonucleotide
ucagcacucugcuugugguccacagua

SEQ ID NO: 1248 - RNA, 27 nt, Artificial Sequence
  Synthetic oligonucleotide
uucagcacucugcuugugguccacagu

SEQ ID NO: 1249 - RNA, 27 nt, Artificial Sequence
  Synthetic oligonucleotide
cuucagcacucugcuugugguccacag

SEQ ID NO: 1250 - RNA, 27 nt, Artificial Sequence
  Synthetic oligonucleotide
ccuucagcacucugcuugugguccaca

SEQ ID NO: 1251 - RNA, 27 nt, Artificial Sequence
  Synthetic oligonucleotide
accuucagcacucugcuugugguccac

SEQ ID NO: 1252 - RNA, 27 nt, Artificial Sequence
  Synthetic oligonucleotide
caccuucagcacucugcuuguggucca

SEQ ID NO: 1253 - RNA, 27 nt, Artificial Sequence
  Synthetic oligonucleotide
gcaccuucagcacucugcuuguggucc

SEQ ID NO: 1254 - RNA, 27 nt, Artificial Sequence
  Synthetic oligonucleotide
agcaccuucagcacucugcuugugguc

SEQ ID NO: 1255 - RNA, 27 nt, Artificial Sequence
  Synthetic oligonucleotide
uagcaccuucagcacucugcuuguggu

SEQ ID NO: 1256 - RNA, 27 nt, Artificial Sequence
  Synthetic oligonucleotide
auagcaccuucagcacucugcuugugg

SEQ ID NO: 1257 - RNA, 27 nt, Artificial Sequence
  Synthetic oligonucleotide
gauagcaccuucagcacucugcuugug

SEQ ID NO: 1258 - RNA, 27 nt, Artificial Sequence
  Synthetic oligonucleotide
agauagcaccuucagcacucugcuugu

SEQ ID NO: 1259 - RNA, 27 nt, Artificial Sequence
  Synthetic oligonucleotide
cagauagcaccuucagcacucugcuug

SEQ ID NO: 1260 - RNA, 27 nt, Artificial Sequence
  Synthetic oligonucleotide
acagauagcaccuucagcacucugcuu

SEQ ID NO: 1261 - RNA, 27 nt, Artificial Sequence
  Synthetic oligonucleotide
gauuccugagaguccaaagacaguucu

SEQ ID NO: 1262 - RNA, 27 nt, Artificial Sequence
  Synthetic oligonucleotide
agauuccugagaguccaaagacaguuc

SEQ ID NO: 1263 - RNA, 27 nt, Artificial Sequence
  Synthetic oligonucleotide
cacaggugaccacauuuauaucaucug

SEQ ID NO: 1264 - RNA, 27 nt, Artificial Sequence
  Synthetic oligonucleotide
gcacaggugaccacauuuauaucaucu

SEQ ID NO: 1265 - RNA, 27 nt, Artificial Sequence
  Synthetic oligonucleotide
ugcacaggugaccacauuuauaucauc

SEQ ID NO: 1266 - RNA, 27 nt, Artificial Sequence
  Synthetic oligonucleotide
cugcacaggugaccacauuuauaucau

SEQ ID NO: 1267 - RNA, 27 nt, Artificial Sequence
  Synthetic oligonucleotide
gcugcacaggugaccacauuuauauca

SEQ ID NO: 1268 - RNA, 27 nt, Artificial Sequence
  Synthetic oligonucleotide
agcugcacaggugaccacauuuauauc

SEQ ID NO: 1269 - RNA, 27 nt, Artificial Sequence
  Synthetic oligonucleotide
cagcugcacaggugaccacauuuauau

SEQ ID NO: 1270 - RNA, 27 nt, Artificial Sequence
  Synthetic oligonucleotide
ccagcugcacaggugaccacauuuaua

SEQ ID NO: 1271 - RNA, 27 nt, Artificial Sequence
  Synthetic oligonucleotide
uccagcugcacaggugaccacauuuau

SEQ ID NO: 1272 - RNA, 27 nt, Artificial Sequence
  Synthetic oligonucleotide
uuccagcugcacaggugaccacauuua

SEQ ID NO: 1273 - RNA, 27 nt, Artificial Sequence
  Synthetic oligonucleotide
auuccagcugcacaggugaccacauuu

SEQ ID NO: 1274 - RNA, 27 nt, Artificial Sequence
  Synthetic oligonucleotide
aauuccagcugcacaggugaccacauu

SEQ ID NO: 1275 - RNA, 27 nt, Artificial Sequence
  Synthetic oligonucleotide
gaauuccagcugcacaggugaccacau

SEQ ID NO: 1276 - RNA, 27 nt, Artificial Sequence
  Synthetic oligonucleotide
agaauuccagcugcacaggugaccaca

SEQ ID NO: 1277 - RNA, 27 nt, Artificial Sequence
  Synthetic oligonucleotide
aagaauuccagcugcacaggugaccac

SEQ ID NO: 1278 - RNA, 27 nt, Artificial Sequence
  Synthetic oligonucleotide
aaagaauuccagcugcacaggugacca

SEQ ID NO: 1279 - RNA, 27 nt, Artificial Sequence
  Synthetic oligonucleotide
gaaagaauuccagcugcacaggugacc

SEQ ID NO: 1280 - RNA, 27 nt, Artificial Sequence
  Synthetic oligonucleotide
agaaagaauuccagcugcacaggugac

SEQ ID NO: 1281 - RNA, 27 nt, Artificial Sequence
  Synthetic oligonucleotide
uagaaagaauuccagcugcacagguga

SEQ ID NO: 1282 - RNA, 27 nt, Artificial Sequence
  Synthetic oligonucleotide
uuagaaagaauuccagcugcacaggug

SEQ ID NO: 1283 - RNA, 27 nt, Artificial Sequence
  Synthetic oligonucleotide
uauaauuauugcaagugagguuagaaa

SEQ ID NO: 1284 - RNA, 27 nt, Artificial Sequence
  Synthetic oligonucleotide
uuauaauuauugcaagugagguuagaa

SEQ ID NO: 1285 - RNA, 27 nt, Artificial Sequence
  Synthetic oligonucleotide
cuuauaauuauugcaagugagguuaga

SEQ ID NO: 1286 - RNA, 27 nt, Artificial Sequence
  Synthetic oligonucleotide
ucuuauaauuauugcaagugagguuag

SEQ ID NO: 1287 - RNA, 27 nt, Artificial Sequence
  Synthetic oligonucleotide
uucuuauaauuauugcaagugagguua

SEQ ID NO: 1288 - RNA, 27 nt, Artificial Sequence
  Synthetic oligonucleotide
cagugaugucuucccugucaccagccc

SEQ ID NO: 1289 - RNA, 27 nt, Artificial Sequence
  Synthetic oligonucleotide
ucagugaugucuucccugucaccagcc

SEQ ID NO: 1290 - RNA, 27 nt, Artificial Sequence
  Synthetic oligonucleotide
cucagugaugucuucccugucaccagc

SEQ ID NO: 1291 - RNA, 27 nt, Artificial Sequence
  Synthetic oligonucleotide
gcucagugaugucuucccugucaccag

SEQ ID NO: 1292 - RNA, 27 nt, Artificial Sequence
  Synthetic oligonucleotide
ggcucagugaugucuucccugucacca

SEQ ID NO: 1293 - RNA, 27 nt, Artificial Sequence
  Synthetic oligonucleotide
aggcucagugaugucuucccugucacc

SEQ ID NO: 1294 - RNA, 27 nt, Artificial Sequence
  Synthetic oligonucleotide
caggcucagugaugucuucccugucac

SEQ ID NO: 1295 - RNA, 27 nt, Artificial Sequence
  Synthetic oligonucleotide
gcaggcucagugaugucuucccuguca

SEQ ID NO: 1296 - RNA, 27 nt, Artificial Sequence
  Synthetic oligonucleotide
ggcaggcucagugaugucuucccuguc

SEQ ID NO: 1297 - RNA, 27 nt, Artificial Sequence
  Synthetic oligonucleotide
uggcaggcucagugaugucuucccugu

SEQ ID NO: 1298 - RNA, 27 nt, Artificial Sequence
  Synthetic oligonucleotide
auggcaggcucagugaugucuucccug

SEQ ID NO: 1299 - RNA, 27 nt, Artificial Sequence
  Synthetic oligonucleotide
gauggcaggcucagugaugucuucccu

SEQ ID NO: 1300 - RNA, 27 nt, Artificial Sequence
  Synthetic oligonucleotide
agauggcaggcucagugaugucuuccc

SEQ ID NO: 1301 - RNA, 27 nt, Artificial Sequence
  Synthetic oligonucleotide
cagauggcaggcucagugaugucuucc

SEQ ID NO: 1302 - RNA, 27 nt, Artificial Sequence
  Synthetic oligonucleotide
acagauggcaggcucagugaugucuuc

SEQ ID NO: 1303 - RNA, 27 nt, Artificial Sequence
  Synthetic oligonucleotide
cacagauggcaggcucagugaugucuu

SEQ ID NO: 1304 - RNA, 27 nt, Artificial Sequence
  Synthetic oligonucleotide
gcacagauggcaggcucagugaugucu

SEQ ID NO: 1305 - RNA, 27 nt, Artificial Sequence
  Synthetic oligonucleotide
agcacagauggcaggcucagugauguc

SEQ ID NO: 1306 - RNA, 27 nt, Artificial Sequence
  Synthetic oligonucleotide
gagcacagauggcaggcucagugaugu

SEQ ID NO: 1307 - RNA, 27 nt, Artificial Sequence
  Synthetic oligonucleotide
agagcacagauggcaggcucagugaug

SEQ ID NO: 1308 - RNA, 27 nt, Artificial Sequence
  Synthetic oligonucleotide
aagagcacagauggcaggcucagugau

SEQ ID NO: 1309 - RNA, 27 nt, Artificial Sequence
  Synthetic oligonucleotide
gaagagcacagauggcaggcucaguga

SEQ ID NO: 1310 - RNA, 27 nt, Artificial Sequence
  Synthetic oligonucleotide
cgaagagcacagauggcaggcucagug

SEQ ID NO: 1311 - RNA, 27 nt, Artificial Sequence
  Synthetic oligonucleotide
acgaagagcacagauggcaggcucagu

SEQ ID NO: 1312 - RNA, 27 nt, Artificial Sequence
  Synthetic oligonucleotide
gacgaagagcacagauggcaggcucag

SEQ ID NO: 1313 - RNA, 27 nt, Artificial Sequence
  Synthetic oligonucleotide
ugacgaagagcacagauggcaggcuca

SEQ ID NO: 1314 - RNA, 27 nt, Artificial Sequence
  Synthetic oligonucleotide
augacgaagagcacagauggcaggcuc

SEQ ID NO: 1315 - RNA, 27 nt, Artificial Sequence
  Synthetic oligonucleotide
gaugacgaagagcacagauggcaggcu

SEQ ID NO: 1316 - RNA, 27 nt, Artificial Sequence
  Synthetic oligonucleotide
agaugacgaagagcacagauggcaggc

SEQ ID NO: 1317 - RNA, 27 nt, Artificial Sequence
  Synthetic oligonucleotide
cagaugacgaagagcacagauggcagg

SEQ ID NO: 1318 - RNA, 27 nt, Artificial Sequence
  Synthetic oligonucleotide
ucagaugacgaagagcacagauggcag

SEQ ID NO: 1319 - RNA, 27 nt, Artificial Sequence
  Synthetic oligonucleotide
gucagaugacgaagagcacagauggca

SEQ ID NO: 1320 - RNA, 27 nt, Artificial Sequence
  Synthetic oligonucleotide
ggucagaugacgaagagcacagauggc

SEQ ID NO: 1321 - RNA, 27 nt, Artificial Sequence
  Synthetic oligonucleotide
uggucagaugacgaagagcacagaugg

SEQ ID NO: 1322 - RNA, 27 nt, Artificial Sequence
  Synthetic oligonucleotide
cuggucagaugacgaagagcacagaug

SEQ ID NO: 1323 - RNA, 27 nt, Artificial Sequence
  Synthetic oligonucleotide
gcuggucagaugacgaagagcacagau

SEQ ID NO: 1324 - RNA, 27 nt, Artificial Sequence
  Synthetic oligonucleotide
ggcuggucagaugacgaagagcacaga

SEQ ID NO: 1325 - RNA, 27 nt, Artificial Sequence
  Synthetic oligonucleotide
cggcuggucagaugacgaagagcacag

SEQ ID NO: 1326 - RNA, 27 nt, Artificial Sequence
  Synthetic oligonucleotide
ucggcuggucagaugacgaagagcaca

SEQ ID NO: 1327 - RNA, 27 nt, Artificial Sequence
  Synthetic oligonucleotide
gucggcuggucagaugacgaagagcac

SEQ ID NO: 1328 - RNA, 27 nt, Artificial Sequence
  Synthetic oligonucleotide
ugucggcuggucagaugacgaagagca

SEQ ID NO: 1329 - RNA, 27 nt, Artificial Sequence
  Synthetic oligonucleotide
gugucggcuggucagaugacgaagagc

SEQ ID NO: 1330 - RNA, 27 nt, Artificial Sequence
  Synthetic oligonucleotide
ggugucggcuggucagaugacgaagag

SEQ ID NO: 1331 - RNA, 27 nt, Artificial Sequence
  Synthetic oligonucleotide
uggugucggcuggucagaugacgaaga

SEQ ID NO: 1332 - RNA, 27 nt, Artificial Sequence
  Synthetic oligonucleotide
ucagaggccagugggauggugggugua

SEQ ID NO: 1333 - RNA, 27 nt, Artificial Sequence
  Synthetic oligonucleotide
aucagaggccagugggauggugggugu

SEQ ID NO: 1334 - RNA, 27 nt, Artificial Sequence
  Synthetic oligonucleotide
uaucagaggccagugggauggugggug

SEQ ID NO: 1335 - RNA, 27 nt, Artificial Sequence
  Synthetic oligonucleotide
uuaucagaggccagugggauggugggu

SEQ ID NO: 1336 - RNA, 27 nt, Artificial Sequence
  Synthetic oligonucleotide
uuuaucagaggccagugggaugguggg

SEQ ID NO: 1337 - RNA, 27 nt, Artificial Sequence
  Synthetic oligonucleotide
cuuuaucagaggccagugggauggugg

SEQ ID NO: 1338 - RNA, 27 nt, Artificial Sequence
  Synthetic oligonucleotide
ccuuuaucagaggccagugggauggug

SEQ ID NO: 1339 - RNA, 27 nt, Artificial Sequence
  Synthetic oligonucleotide
gccuuuaucagaggccagugggauggu

SEQ ID NO: 1340 - RNA, 27 nt, Artificial Sequence
  Synthetic oligonucleotide
agccuuuaucagaggccagugggaugg

SEQ ID NO: 1341 - RNA, 27 nt, Artificial Sequence
  Synthetic oligonucleotide
uagccuuuaucagaggccagugggaug

SEQ ID NO: 1342 - RNA, 27 nt, Artificial Sequence
  Synthetic oligonucleotide
guagccuuuaucagaggccagugggau

SEQ ID NO: 1343 - RNA, 27 nt, Artificial Sequence
  Synthetic oligonucleotide
aguagccuuuaucagaggccaguggga

SEQ ID NO: 1344 - RNA, 27 nt, Artificial Sequence
  Synthetic oligonucleotide
caguagccuuuaucagaggccaguggg

SEQ ID NO: 1345 - RNA, 27 nt, Artificial Sequence
  Synthetic oligonucleotide
acaguagccuuuaucagaggccagugg

SEQ ID NO: 1346 - RNA, 27 nt, Artificial Sequence
  Synthetic oligonucleotide
caagauuucgaaucaauccaacaguag

SEQ ID NO: 1347 - RNA, 27 nt, Artificial Sequence
  Synthetic oligonucleotide
gcaagauuucgaaucaauccaacagua

SEQ ID NO: 1348 - RNA, 27 nt, Artificial Sequence
  Synthetic oligonucleotide
gcugcacaaacaauggaaugguauuua

SEQ ID NO: 1349 - RNA, 27 nt, Artificial Sequence
  Synthetic oligonucleotide
agcugcacaaacaauggaaugguauuu

SEQ ID NO: 1350 - RNA, 27 nt, Artificial Sequence
  Synthetic oligonucleotide
cagcugcacaaacaauggaaugguauu

SEQ ID NO: 1351 - RNA, 27 nt, Artificial Sequence
  Synthetic oligonucleotide
gcagcugcacaaacaauggaaugguau

SEQ ID NO: 1352 - RNA, 27 nt, Artificial Sequence
  Synthetic oligonucleotide
agcagcugcacaaacaauggaauggua

SEQ ID NO: 1353 - RNA, 27 nt, Artificial Sequence
  Synthetic oligonucleotide
aagcagcugcacaaacaauggaauggu

SEQ ID NO: 1354 - RNA, 27 nt, Artificial Sequence
  Synthetic oligonucleotide
auguuuucaaugggagaauaaagcagc

SEQ ID NO: 1355 - RNA, 27 nt, Artificial Sequence
  Synthetic oligonucleotide
gauguuuucaaugggagaauaaagcag

SEQ ID NO: 1356 - RNA, 27 nt, Artificial Sequence
  Synthetic oligonucleotide
ggauguuuucaaugggagaauaaagca

SEQ ID NO: 1357 - RNA, 27 nt, Artificial Sequence
  Synthetic oligonucleotide
uggauguuuucaaugggagaauaaagc

SEQ ID NO: 1358 - RNA, 27 nt, Artificial Sequence
  Synthetic oligonucleotide
uguccugagcaaguucacagaggaccc

SEQ ID NO: 1359 - RNA, 27 nt, Artificial Sequence
  Synthetic oligonucleotide
uuguccugagcaaguucacagaggacc

SEQ ID NO: 1360 - RNA, 27 nt, Artificial Sequence
  Synthetic oligonucleotide
cuuguccugagcaaguucacagaggac

SEQ ID NO: 1361 - RNA, 27 nt, Artificial Sequence
  Synthetic oligonucleotide
ccuuguccugagcaaguucacagagga

SEQ ID NO: 1362 - RNA, 27 nt, Artificial Sequence
  Synthetic oligonucleotide
uccuuguccugagcaaguucacagagg

SEQ ID NO: 1363 - RNA, 27 nt, Artificial Sequence
  Synthetic oligonucleotide
uuccuuguccugagcaaguucacagag

SEQ ID NO: 1364 - RNA, 27 nt, Artificial Sequence
  Synthetic oligonucleotide
cuuccuuguccugagcaaguucacaga

SEQ ID NO: 1365 - RNA, 27 nt, Artificial Sequence
  Synthetic oligonucleotide
gcuuccuuguccugagcaaguucacag

SEQ ID NO: 1366 - RNA, 27 nt, Artificial Sequence
  Synthetic oligonucleotide
agcuuccuuguccugagcaaguucaca

SEQ ID NO: 1367 - RNA, 27 nt, Artificial Sequence
  Synthetic oligonucleotide
cagcuuccuuguccugagcaaguucac

SEQ ID NO: 1368 - RNA, 27 nt, Artificial Sequence
  Synthetic oligonucleotide
gcagcuuccuuguccugagcaaguuca

SEQ ID NO: 1369 - RNA, 27 nt, Artificial Sequence
  Synthetic oligonucleotide
gagcuguggcucccucagcuucaauag

SEQ ID NO: 1370 - RNA, 27 nt, Artificial Sequence
  Synthetic oligonucleotide
ggagcuguggcucccucagcuucaaua

SEQ ID NO: 1371 - RNA, 27 nt, Artificial Sequence
  Synthetic oligonucleotide
aggagcuguggcucccucagcuucaau

SEQ ID NO: 1372 - RNA, 27 nt, Artificial Sequence
  Synthetic oligonucleotide
guggcuuguccucagacauucggaaca

SEQ ID NO: 1373 - RNA, 27 nt, Artificial Sequence
  Synthetic oligonucleotide
uguggcuuguccucagacauucggaac

SEQ ID NO: 1374 - RNA, 27 nt, Artificial Sequence
  Synthetic oligonucleotide
uuguggcuuguccucagacauucggaa

SEQ ID NO: 1375 - RNA, 27 nt, Artificial Sequence
  Synthetic oligonucleotide
cuuguggcuuguccucagacauucgga

SEQ ID NO: 1376 - RNA, 27 nt, Artificial Sequence
  Synthetic oligonucleotide
ucuuguggcuuguccucagacauucgg

SEQ ID NO: 1377 - RNA, 27 nt, Artificial Sequence
  Synthetic oligonucleotide
aucuuguggcuuguccucagacauucg

SEQ ID NO: 1378 - RNA, 27 nt, Artificial Sequence
  Synthetic oligonucleotide
aaucuuguggcuuguccucagacauuc

SEQ ID NO: 1379 - RNA, 27 nt, Artificial Sequence
  Synthetic oligonucleotide
uaaucuuguggcuuguccucagacauu

SEQ ID NO: 1380 - RNA, 27 nt, Artificial Sequence
  Synthetic oligonucleotide
ucucauuccaagccauuggcucuguuc

SEQ ID NO: 1381 - RNA, 27 nt, Artificial Sequence
  Synthetic oligonucleotide
gucucauuccaagccauuggcucuguu

SEQ ID NO: 1382 - RNA, 27 nt, Artificial Sequence
  Synthetic oligonucleotide
agucucauuccaagccauuggcucugu

SEQ ID NO: 1383 - RNA, 27 nt, Artificial Sequence
  Synthetic oligonucleotide
cagucucauuccaagccauuggcucug

SEQ ID NO: 1384 - RNA, 27 nt, Artificial Sequence
  Synthetic oligonucleotide
gcagucucauuccaagccauuggcucu

SEQ ID NO: 1385 - RNA, 27 nt, Artificial Sequence
  Synthetic oligonucleotide
agcagucucauuccaagccauuggcuc

SEQ ID NO: 1386 - RNA, 27 nt, Artificial Sequence
  Synthetic oligonucleotide
cagcagucucauuccaagccauuggcu

SEQ ID NO: 1387 - RNA, 27 nt, Artificial Sequence
  Synthetic oligonucleotide
ucagcagucucauuccaagccauuggc

SEQ ID NO: 1388 - RNA, 27 nt, Artificial Sequence
  Synthetic oligonucleotide
aucagcagucucauuccaagccauugg

SEQ ID NO: 1389 - RNA, 27 nt, Artificial Sequence
  Synthetic oligonucleotide
gaucagcagucucauuccaagccauug

SEQ ID NO: 1390 - RNA, 27 nt, Artificial Sequence
  Synthetic oligonucleotide
agaucagcagucucauuccaagccauu

SEQ ID NO: 1391 - RNA, 27 nt, Artificial Sequence
  Synthetic oligonucleotide
uaggaucauccuggcgauauccaaggg

SEQ ID NO: 1392 - RNA, 27 nt, Artificial Sequence
  Synthetic oligonucleotide
cuaggaucauccuggcgauauccaagg

SEQ ID NO: 1393 - RNA, 27 nt, Artificial Sequence
  Synthetic oligonucleotide
gcuaggaucauccuggcgauauccaag

SEQ ID NO: 1394 - RNA, 27 nt, Artificial Sequence
  Synthetic oligonucleotide
agcuaggaucauccuggcgauauccaa

SEQ ID NO: 1395 - RNA, 27 nt, Artificial Sequence
  Synthetic oligonucleotide
uagcuaggaucauccuggcgauaucca

SEQ ID NO: 1396 - RNA, 27 nt, Artificial Sequence
  Synthetic oligonucleotide
cauauccaccagagugaaaagaacgau

SEQ ID NO: 1397 - RNA, 27 nt, Artificial Sequence
  Synthetic oligonucleotide
ccauauccaccagagugaaaagaacga

SEQ ID NO: 1398 - RNA, 27 nt, Artificial Sequence
  Synthetic oligonucleotide
gccauauccaccagagugaaaagaacg

SEQ ID NO: 1399 - RNA, 27 nt, Artificial Sequence
  Synthetic oligonucleotide
ggccauauccaccagagugaaaagaac

SEQ ID NO: 1400 - RNA, 27 nt, Artificial Sequence
  Synthetic oligonucleotide
uggccauauccaccagagugaaaagaa

SEQ ID NO: 1401 - RNA, 27 nt, Artificial Sequence
  Synthetic oligonucleotide
cagggugguggccacccaucucauguu

SEQ ID NO: 1402 - RNA, 27 nt, Artificial Sequence
  Synthetic oligonucleotide
ccagggugguggccacccaucucaugu

SEQ ID NO: 1403 - RNA, 27 nt, Artificial Sequence
  Synthetic oligonucleotide
accagggugguggccacccaucucaug

SEQ ID NO: 1404 - RNA, 27 nt, Artificial Sequence
  Synthetic oligonucleotide
caccagggugguggccacccaucucau

SEQ ID NO: 1405 - RNA, 27 nt, Artificial Sequence
  Synthetic oligonucleotide
gcaccagggugguggccacccaucuca

SEQ ID NO: 1406 - RNA, 27 nt, Artificial Sequence
  Synthetic oligonucleotide
agcaccagggugguggccacccaucuc

SEQ ID NO: 1407 - RNA, 27 nt, Artificial Sequence
  Synthetic oligonucleotide
cagcaccagggugguggccacccaucu

SEQ ID NO: 1408 - RNA, 27 nt, Artificial Sequence
  Synthetic oligonucleotide
ucagcaccagggugguggccacccauc

SEQ ID NO: 1409 - RNA, 27 nt, Artificial Sequence
  Synthetic oligonucleotide
gucagcaccagggugguggccacccau

SEQ ID NO: 1410 - RNA, 27 nt, Artificial Sequence
  Synthetic oligonucleotide
agucagcaccagggugguggccaccca

SEQ ID NO: 1411 - RNA, 27 nt, Artificial Sequence
  Synthetic oligonucleotide
uagucagcaccagggugguggccaccc

SEQ ID NO: 1412 - RNA, 27 nt, Artificial Sequence
  Synthetic oligonucleotide
auagucagcaccagggugguggccacc

SEQ ID NO: 1413 - RNA, 27 nt, Artificial Sequence
  Synthetic oligonucleotide
gauagucagcaccagggugguggccac

SEQ ID NO: 1414 - RNA, 27 nt, Artificial Sequence
  Synthetic oligonucleotide
ggauagucagcaccagggugguggcca

SEQ ID NO: 1415 - RNA, 27 nt, Artificial Sequence
  Synthetic oligonucleotide
uggauagucagcaccagggugguggcc

SEQ ID NO: 1416 - RNA, 27 nt, Artificial Sequence
  Synthetic oligonucleotide
cuggauagucagcaccagggugguggc

SEQ ID NO: 1417 - RNA, 27 nt, Artificial Sequence
  Synthetic oligonucleotide
acuggauagucagcaccaggguggugg

SEQ ID NO: 1418 - RNA, 27 nt, Artificial Sequence
  Synthetic oligonucleotide
aacuggauagucagcaccaggguggug

SEQ ID NO: 1419 - RNA, 27 nt, Artificial Sequence
  Synthetic oligonucleotide
caacuggauagucagcaccaggguggu

SEQ ID NO: 1420 - RNA, 27 nt, Artificial Sequence
  Synthetic oligonucleotide
ucaacuggauagucagcaccagggugg

SEQ ID NO: 1421 - RNA, 27 nt, Artificial Sequence
  Synthetic oligonucleotide
aucaacuggauagucagcaccagggug

SEQ ID NO: 1422 - RNA, 27 nt, Artificial Sequence
  Synthetic oligonucleotide
caucaacuggauagucagcaccagggu

SEQ ID NO: 1423 - RNA, 27 nt, Artificial Sequence
  Synthetic oligonucleotide
ccaucaacuggauagucagcaccaggg

SEQ ID NO: 1424 - RNA, 27 nt, Artificial Sequence
  Synthetic oligonucleotide
cccaucaacuggauagucagcaccagg

SEQ ID NO: 1425 - RNA, 27 nt, Artificial Sequence
  Synthetic oligonucleotide
gcccaucaacuggauagucagcaccag

SEQ ID NO: 1426 - RNA, 27 nt, Artificial Sequence
  Synthetic oligonucleotide
agcccaucaacuggauagucagcacca

SEQ ID NO: 1427 - RNA, 27 nt, Artificial Sequence
  Synthetic oligonucleotide
cagcccaucaacuggauagucagcacc

SEQ ID NO: 1428 - RNA, 27 nt, Artificial Sequence
  Synthetic oligonucleotide
gcagcccaucaacuggauagucagcac

SEQ ID NO: 1429 - RNA, 27 nt, Artificial Sequence
  Synthetic oligonucleotide
ggcagcccaucaacuggauagucagca

SEQ ID NO: 1430 - RNA, 27 nt, Artificial Sequence
  Synthetic oligonucleotide
uggcagcccaucaacuggauagucagc

SEQ ID NO: 1431 - RNA, 27 nt, Artificial Sequence
  Synthetic oligonucleotide
cuggcagcccaucaacuggauagucag

SEQ ID NO: 1432 - RNA, 27 nt, Artificial Sequence
  Synthetic oligonucleotide
ucuggcagcccaucaacuggauaguca

SEQ ID NO: 1433 - RNA, 27 nt, Artificial Sequence
  Synthetic oligonucleotide
aucuggcagcccaucaacuggauaguc

SEQ ID NO: 1434 - RNA, 27 nt, Artificial Sequence
  Synthetic oligonucleotide
gaucuggcagcccaucaacuggauagu

SEQ ID NO: 1435 - RNA, 27 nt, Artificial Sequence
  Synthetic oligonucleotide
agaucuggcagcccaucaacuggauag

SEQ ID NO: 1436 - RNA, 27 nt, Artificial Sequence
  Synthetic oligonucleotide
gcagcccauccaugagguccugggcau

SEQ ID NO: 1437 - RNA, 27 nt, Artificial Sequence
  Synthetic oligonucleotide
ggcagcccauccaugagguccugggca

SEQ ID NO: 1438 - RNA, 27 nt, Artificial Sequence
  Synthetic oligonucleotide
aggcagcccauccaugagguccugggc

SEQ ID NO: 1439 - RNA, 27 nt, Artificial Sequence
  Synthetic oligonucleotide
uaucaaaccaggccagcugauugcugu

SEQ ID NO: 1440 - RNA, 27 nt, Artificial Sequence
  Synthetic oligonucleotide
guaucaaaccaggccagcugauugcug

SEQ ID NO: 1441 - RNA, 27 nt, Artificial Sequence
  Synthetic oligonucleotide
aguaucaaaccaggccagcugauugcu

SEQ ID NO: 1442 - RNA, 27 nt, Artificial Sequence
  Synthetic oligonucleotide
caguaucaaaccaggccagcugauugc

SEQ ID NO: 1443 - RNA, 27 nt, Artificial Sequence
  Synthetic oligonucleotide
ucaguaucaaaccaggccagcugauug

SEQ ID NO: 1444 - RNA, 27 nt, Artificial Sequence
  Synthetic oligonucleotide
gucaguaucaaaccaggccagcugauu

SEQ ID NO: 1445 - RNA, 27 nt, Artificial Sequence
  Synthetic oligonucleotide
ggucaguaucaaaccaggccagcugau

SEQ ID NO: 1446 - RNA, 27 nt, Artificial Sequence
  Synthetic oligonucleotide
aggucaguaucaaaccaggccagcuga

SEQ ID NO: 1447 - RNA, 27 nt, Artificial Sequence
  Synthetic oligonucleotide
caggucaguaucaaaccaggccagcug

SEQ ID NO: 1448 - RNA, 27 nt, Artificial Sequence
  Synthetic oligonucleotide
acaggucaguaucaaaccaggccagcu

SEQ ID NO: 1449 - RNA, 27 nt, Artificial Sequence
  Synthetic oligonucleotide
uacaggucaguaucaaaccaggccagc

SEQ ID NO: 1450 - RNA, 27 nt, Artificial Sequence
  Synthetic oligonucleotide
uuacaggucaguaucaaaccaggccag

SEQ ID NO: 1451 - RNA, 27 nt, Artificial Sequence
  Synthetic oligonucleotide
uuuacaggucaguaucaaaccaggcca

SEQ ID NO: 1452 - RNA, 27 nt, Artificial Sequence
  Synthetic oligonucleotide
auuuacaggucaguaucaaaccaggcc

SEQ ID NO: 1453 - RNA, 27 nt, Artificial Sequence
  Synthetic oligonucleotide
gauuuacaggucaguaucaaaccaggc

SEQ ID NO: 1454 - RNA, 27 nt, Artificial Sequence
  Synthetic oligonucleotide
ugauuuacaggucaguaucaaaccagg

SEQ ID NO: 1455 - RNA, 27 nt, Artificial Sequence
  Synthetic oligonucleotide
augauuuacaggucaguaucaaaccag

SEQ ID NO: 1456 - RNA, 27 nt, Artificial Sequence
  Synthetic oligonucleotide
gaugauuuacaggucaguaucaaacca

SEQ ID NO: 1457 - RNA, 27 nt, Artificial Sequence
  Synthetic oligonucleotide
ggaugauuuacaggucaguaucaaacc

SEQ ID NO: 1458 - RNA, 27 nt, Artificial Sequence
  Synthetic oligonucleotide
aggaugauuuacaggucaguaucaaac

SEQ ID NO: 1459 - RNA, 27 nt, Artificial Sequence
  Synthetic oligonucleotide
aaggaugauuuacaggucaguaucaaa

SEQ ID NO: 1460 - RNA, 27 nt, Artificial Sequence
  Synthetic oligonucleotide
uuaaguugcaaaagcuguggcaaaaaa

SEQ ID NO: 1461 - RNA, 27 nt, Artificial Sequence
  Synthetic oligonucleotide
uguuuaaaacagcaaauguuacucauu

SEQ ID NO: 1462 - RNA, 27 nt, Artificial Sequence
  Synthetic oligonucleotide
agagagaaaggcugcuauuaauguuua

SEQ ID NO: 1463 - RNA, 27 nt, Artificial Sequence
  Synthetic oligonucleotide
aaagagagaaaggcugcuauuaauguu

SEQ ID NO: 1464 - RNA, 27 nt, Artificial Sequence
  Synthetic oligonucleotide
auaaagagagaaaggcugcuauuaaug

SEQ ID NO: 1465 - RNA, 27 nt, Artificial Sequence
  Synthetic oligonucleotide
guauaaagagagaaaggcugcuauuaa

SEQ ID NO: 1466 - RNA, 27 nt, Artificial Sequence
  Synthetic oligonucleotide
caacucuacaggccaaucacaaugcaa

SEQ ID NO: 1467 - RNA, 27 nt, Artificial Sequence
  Synthetic oligonucleotide
agcaacucuacaggccaaucacaaugc

SEQ ID NO: 1468 - RNA, 27 nt, Artificial Sequence
  Synthetic oligonucleotide
ucagcaacucuacaggccaaucacaau

SEQ ID NO: 1469 - RNA, 27 nt, Artificial Sequence
  Synthetic oligonucleotide
ucucagcaacucuacaggccaaucaca

SEQ ID NO: 1470 - RNA, 27 nt, Artificial Sequence
  Synthetic oligonucleotide
ccucucagcaacucuacaggccaauca

SEQ ID NO: 1471 - RNA, 27 nt, Artificial Sequence
  Synthetic oligonucleotide
gcccucucagcaacucuacaggccaau

SEQ ID NO: 1472 - RNA, 27 nt, Artificial Sequence
  Synthetic oligonucleotide
gagcccucucagcaacucuacaggcca

SEQ ID NO: 1473 - RNA, 27 nt, Artificial Sequence
  Synthetic oligonucleotide
ucgagcccucucagcaacucuacaggc

SEQ ID NO: 1474 - RNA, 27 nt, Artificial Sequence
  Synthetic oligonucleotide
ccucgagcccucucagcaacucuacag

SEQ ID NO: 1475 - RNA, 27 nt, Artificial Sequence
  Synthetic oligonucleotide
ggcacuuucugagauaccagcccaccc

SEQ ID NO: 1476 - RNA, 27 nt, Artificial Sequence
  Synthetic oligonucleotide
caggcacuuucugagauaccagcccac

SEQ ID NO: 1477 - RNA, 27 nt, Artificial Sequence
  Synthetic oligonucleotide
gucaggcacuuucugagauaccagccc

SEQ ID NO: 1478 - RNA, 27 nt, Artificial Sequence
  Synthetic oligonucleotide
gugucaggcacuuucugagauaccagc

SEQ ID NO: 1479 - RNA, 27 nt, Artificial Sequence
  Synthetic oligonucleotide
ccauaggaaacucagcuugguuagugu

SEQ ID NO: 1480 - RNA, 27 nt, Artificial Sequence
  Synthetic oligonucleotide
ucccauaggaaacucagcuugguuagu

SEQ ID NO: 1481 - RNA, 27 nt, Artificial Sequence
  Synthetic oligonucleotide
guucccauaggaaacucagcuugguua

SEQ ID NO: 1482 - RNA, 27 nt, Artificial Sequence
  Synthetic oligonucleotide
uuguucccauaggaaacucagcuuggu

SEQ ID NO: 1483 - RNA, 27 nt, Artificial Sequence
  Synthetic oligonucleotide
aauuguucccauaggaaacucagcuug

SEQ ID NO: 1484 - RNA, 27 nt, Artificial Sequence
  Synthetic oligonucleotide
ucaauuguucccauaggaaacucagcu

SEQ ID NO: 1485 - RNA, 27 nt, Artificial Sequence
  Synthetic oligonucleotide
gaccaaaaaggaccagaacaaaaaguu

SEQ ID NO: 1486 - RNA, 27 nt, Artificial Sequence
  Synthetic oligonucleotide
ucgaccaaaaaggaccagaacaaaaag

SEQ ID NO: 1487 - RNA, 27 nt, Artificial Sequence
  Synthetic oligonucleotide
ccucgaccaaaaaggaccagaacaaaa

SEQ ID NO: 1488 - RNA, 27 nt, Artificial Sequence
  Synthetic oligonucleotide
cuccucgaccaaaaaggaccagaacaa

SEQ ID NO: 1489 - RNA, 27 nt, Artificial Sequence
  Synthetic oligonucleotide
uacuccucgaccaaaaaggaccagaac

SEQ ID NO: 1490 - RNA, 27 nt, Artificial Sequence
  Synthetic oligonucleotide
guuacuccucgaccaaaaaggaccaga

SEQ ID NO: 1491 - RNA, 27 nt, Artificial Sequence
  Synthetic oligonucleotide
uuguuacuccucgaccaaaaaggacca

SEQ ID NO: 1492 - RNA, 27 nt, Artificial Sequence
  Synthetic oligonucleotide
uauuguuacuccucgaccaaaaaggac

SEQ ID NO: 1493 - RNA, 27 nt, Artificial Sequence
  Synthetic oligonucleotide
uguauuguuacuccucgaccaaaaagg

SEQ ID NO: 1494 - RNA, 27 nt, Artificial Sequence
  Synthetic oligonucleotide
uuuguauuguuacuccucgaccaaaaa

SEQ ID NO: 1495 - RNA, 27 nt, Artificial Sequence
  Synthetic oligonucleotide
cauuuguauuguuacuccucgaccaaa

SEQ ID NO: 1496 - RNA, 27 nt, Artificial Sequence
  Synthetic oligonucleotide
uccauuuguauuguuacuccucgacca

SEQ ID NO: 1497 - RNA, 27 nt, Artificial Sequence
  Synthetic oligonucleotide
aauccauuuguauuguuacuccucgac

SEQ ID NO: 1498 - RNA, 27 nt, Artificial Sequence
  Synthetic oligonucleotide
aaaauccauuuguauuguuacuccucg

SEQ ID NO: 1499 - RNA, 27 nt, Artificial Sequence
  Synthetic oligonucleotide
ccaaaauccauuuguauuguuacuccu

SEQ ID NO: 1500 - RNA, 27 nt, Artificial Sequence
  Synthetic oligonucleotide
uaacaagcaaggcuaggguuugauaaa

SEQ ID NO: 1501 - RNA, 27 nt, Artificial Sequence
  Synthetic oligonucleotide
uuuaacaagcaaggcuaggguuugaua

SEQ ID NO: 1502 - RNA, 27 nt, Artificial Sequence
  Synthetic oligonucleotide
aauuuaacaagcaaggcuaggguuuga

SEQ ID NO: 1503 - RNA, 27 nt, Artificial Sequence
  Synthetic oligonucleotide
gaauuaguguucuacaccauuacucaa

SEQ ID NO: 1504 - RNA, 27 nt, Artificial Sequence
  Synthetic oligonucleotide
augaauuaguguucuacaccauuacuc

SEQ ID NO: 1505 - RNA, 27 nt, Artificial Sequence
  Synthetic oligonucleotide
uuaugaauuaguguucuacaccauuac

SEQ ID NO: 1506 - RNA, 27 nt, Artificial Sequence
  Synthetic oligonucleotide
gauuaugaauuaguguucuacaccauu

SEQ ID NO: 1507 - RNA, 27 nt, Artificial Sequence
  Synthetic oligonucleotide
gugauuaugaauuaguguucuacacca

SEQ ID NO: 1508 - RNA, 27 nt, Artificial Sequence
  Synthetic oligonucleotide
gagugauuaugaauuaguguucuacac

SEQ ID NO: 1509 - RNA, 27 nt, Artificial Sequence
  Synthetic oligonucleotide
uagagugauuaugaauuaguguucuac

SEQ ID NO: 1510 - RNA, 27 nt, Artificial Sequence
  Synthetic oligonucleotide
auuagagugauuaugaauuaguguucu

SEQ ID NO: 1511 - RNA, 27 nt, Artificial Sequence
  Synthetic oligonucleotide
uuaagcauauuaaaaaggaaacuaauu

SEQ ID NO: 1512 - RNA, 27 nt, Artificial Sequence
  Synthetic oligonucleotide
uuuuaagcauauuaaaaaggaaacuaa

SEQ ID NO: 1513 - RNA, 27 nt, Artificial Sequence
  Synthetic oligonucleotide
uauuuuaagcauauuaaaaaggaaacu

SEQ ID NO: 1514 - RNA, 27 nt, Artificial Sequence
  Synthetic oligonucleotide
cuuauuuuaagcauauuaaaaaggaaa

SEQ ID NO: 1515 - RNA, 27 nt, Artificial Sequence
  Synthetic oligonucleotide
ugcuuauuuuaagcauauuaaaaagga

SEQ ID NO: 1516 - RNA, 27 nt, Artificial Sequence
  Synthetic oligonucleotide
cugcuuauuuuaagcauauuaaaaagg

SEQ ID NO: 1517 - RNA, 27 nt, Artificial Sequence
  Synthetic oligonucleotide
ccugcuuauuuuaagcauauuaaaaag

SEQ ID NO: 1518 - RNA, 27 nt, Artificial Sequence
  Synthetic oligonucleotide
caccugcuuauuuuaagcauauuaaaa

SEQ ID NO: 1519 - RNA, 27 nt, Artificial Sequence
  Synthetic oligonucleotide
uccaccugcuuauuuuaagcauauuaa

SEQ ID NO: 1520 - RNA, 27 nt, Artificial Sequence
  Synthetic oligonucleotide
gauccaccugcuuauuuuaagcauauu

SEQ ID NO: 1521 - RNA, 27 nt, Artificial Sequence
  Synthetic oligonucleotide
uagauccaccugcuuauuuuaagcaua

SEQ ID NO: 1522 - RNA, 27 nt, Artificial Sequence
  Synthetic oligonucleotide
aauagauccaccugcuuauuuuaagca

SEQ ID NO: 1523 - RNA, 27 nt, Artificial Sequence
  Synthetic oligonucleotide
gaaauagauccaccugcuuauuuuaag

SEQ ID NO: 1524 - RNA, 27 nt, Artificial Sequence
  Synthetic oligonucleotide
augaaauagauccaccugcuuauuuua

SEQ ID NO: 1525 - RNA, 27 nt, Artificial Sequence
  Synthetic oligonucleotide
acaugaaauagauccaccugcuuauuu

SEQ ID NO: 1526 - RNA, 27 nt, Artificial Sequence
  Synthetic oligonucleotide
aaacaugaaauagauccaccugcuuau

SEQ ID NO: 1527 - RNA, 27 nt, Artificial Sequence
  Synthetic oligonucleotide
aaaaacaugaaauagauccaccugcuu

SEQ ID NO: 1528 - RNA, 27 nt, Artificial Sequence
  Synthetic oligonucleotide
ucaaaaacaugaaauagauccaccugc

SEQ ID NO: 1529 - RNA, 27 nt, Artificial Sequence
  Synthetic oligonucleotide
gaucaaaaacaugaaauagauccaccu

SEQ ID NO: 1530 - RNA, 27 nt, Artificial Sequence
  Synthetic oligonucleotide
uugaucaaaaacaugaaauagauccac

SEQ ID NO: 1531 - RNA, 27 nt, Artificial Sequence
  Synthetic oligonucleotide
uuuugaucaaaaacaugaaauagaucc

SEQ ID NO: 1532 - RNA, 27 nt, Artificial Sequence
  Synthetic oligonucleotide
aacaccucuuacugauuuacccuaccc

SEQ ID NO: 1533 - RNA, 27 nt, Artificial Sequence
  Synthetic oligonucleotide
auaacaccucuuacugauuuacccuac

SEQ ID NO: 1534 - RNA, 27 nt, Artificial Sequence
  Synthetic oligonucleotide
aaauaacaccucuuacugauuuacccu

SEQ ID NO: 1535 - RNA, 27 nt, Artificial Sequence
  Synthetic oligonucleotide
ccaaauaacaccucuuacugauuuacc

SEQ ID NO: 1536 - RNA, 27 nt, Artificial Sequence
  Synthetic oligonucleotide
uuccaaauaacaccucuuacugauuua

SEQ ID NO: 1537 - RNA, 27 nt, Artificial Sequence
  Synthetic oligonucleotide
gguuccaaauaacaccucuuacugauu

SEQ ID NO: 1538 - RNA, 27 nt, Artificial Sequence
  Synthetic oligonucleotide
acuuugggauaaaaggcaacugguaaa

SEQ ID NO: 1539 - RNA, 27 nt, Artificial Sequence
  Synthetic oligonucleotide
caacuuugggauaaaaggcaacuggua

SEQ ID NO: 1540 - RNA, 27 nt, Artificial Sequence
  Synthetic oligonucleotide
aacaacuuugggauaaaaggcaacugg

SEQ ID NO: 1541 - RNA, 27 nt, Artificial Sequence
  Synthetic oligonucleotide
acaacaacuuugggauaaaaggcaacu

SEQ ID NO: 1542 - RNA, 27 nt, Artificial Sequence
  Synthetic oligonucleotide
uuacaacaacuuugggauaaaaggcaa

SEQ ID NO: 1543 - RNA, 27 nt, Artificial Sequence
  Synthetic oligonucleotide
gguuacaacaacuuugggauaaaaggc

SEQ ID NO: 1544 - RNA, 27 nt, Artificial Sequence
  Synthetic oligonucleotide
cagguuacaacaacuuugggauaaaag

SEQ ID NO: 1545 - RNA, 27 nt, Artificial Sequence
  Synthetic oligonucleotide
agcagguuacaacaacuuugggauaaa

SEQ ID NO: 1546 - RNA, 27 nt, Artificial Sequence
  Synthetic oligonucleotide
acagcagguuacaacaacuuugggaua

SEQ ID NO: 1547 - RNA, 27 nt, Artificial Sequence
  Synthetic oligonucleotide
ucacagcagguuacaacaacuuuggga

SEQ ID NO: 1548 - RNA, 27 nt, Artificial Sequence
  Synthetic oligonucleotide
uaucacagcagguuacaacaacuuugg

SEQ ID NO: 1549 - RNA, 27 nt, Artificial Sequence
  Synthetic oligonucleotide
cguaucacagcagguuacaacaacuuu

SEQ ID NO: 1550 - RNA, 27 nt, Artificial Sequence
  Synthetic oligonucleotide
aucguaucacagcagguuacaacaacu

SEQ ID NO: 1551 - RNA, 27 nt, Artificial Sequence
  Synthetic oligonucleotide
gcaucguaucacagcagguuacaacaa

SEQ ID NO: 1552 - RNA, 27 nt, Artificial Sequence
  Synthetic oligonucleotide
uuaaaaguuuaauucugaaccauuuuu

SEQ ID NO: 1553 - RNA, 27 nt, Artificial Sequence
  Synthetic oligonucleotide
aauuaaaaguuuaauucugaaccauuu

SEQ ID NO: 1554 - RNA, 27 nt, Artificial Sequence
  Synthetic oligonucleotide
ugaauuaaaaguuuaauucugaaccau

SEQ ID NO: 1555 - RNA, 27 nt, Artificial Sequence
  Synthetic oligonucleotide
aaugaauuaaaaguuuaauucugaacc

SEQ ID NO: 1556 - RNA, 27 nt, Artificial Sequence
  Synthetic oligonucleotide
cgaaugaauuaaaaguuuaauucugaa

SEQ ID NO: 1557 - RNA, 27 nt, Artificial Sequence
  Synthetic oligonucleotide
uccagaauccaaguaagacugcugcug

SEQ ID NO: 1558 - RNA, 27 nt, Artificial Sequence
  Synthetic oligonucleotide
ccagaauggauuccagaauccaaguaa

SEQ ID NO: 1559 - RNA, 27 nt, Artificial Sequence
  Synthetic oligonucleotide
auucauaaaggacuugggaggugucaa

SEQ ID NO: 1560 - RNA, 27 nt, Artificial Sequence
  Synthetic oligonucleotide
ucaauaucagcuacuugcucuugcgug

SEQ ID NO: 1561 - RNA, 27 nt, Artificial Sequence
  Synthetic oligonucleotide
ucaucuagcgucucagggaacauggca

SEQ ID NO: 1562 - RNA, 27 nt, Artificial Sequence
  Synthetic oligonucleotide
aucaaauugacaacugcauguuucaac

SEQ ID NO: 1563 - RNA, 27 nt, Artificial Sequence
  Synthetic oligonucleotide
aguuaaucaaauugacaacugcauguu

SEQ ID NO: 1564 - RNA, 27 nt, Artificial Sequence
  Synthetic oligonucleotide
ccugauaguuaaucaaauugacaacug

SEQ ID NO: 1565 - RNA, 27 nt, Artificial Sequence
  Synthetic oligonucleotide
cuuuauuaacuaccaccugguccucau

SEQ ID NO: 1566 - RNA, 27 nt, Artificial Sequence
  Synthetic oligonucleotide
aacaguacagaauccacuggugaccca

SEQ ID NO: 1567 - RNA, 27 nt, Artificial Sequence
  Synthetic oligonucleotide
gcguagaacaguacagaauccacuggu

SEQ ID NO: 1568 - RNA, 27 nt, Artificial Sequence
  Synthetic oligonucleotide
ugauggcguagaacaguacagaaucca

SEQ ID NO: 1569 - RNA, 27 nt, Artificial Sequence
  Synthetic oligonucleotide
aaagcaaccauuuucugcaguccacca

SEQ ID NO: 1570 - RNA, 27 nt, Artificial Sequence
  Synthetic oligonucleotide
uguuguaauagccaagaauuucacguu

SEQ ID NO: 1571 - RNA, 27 nt, Artificial Sequence
  Synthetic oligonucleotide
caguuuugaacaagucgcugacuuggg

SEQ ID NO: 1572 - RNA, 27 nt, Artificial Sequence
  Synthetic oligonucleotide
guccaaagacaguuuugaacaagucgc

SEQ ID NO: 1573 - RNA, 27 nt, Artificial Sequence
  Synthetic oligonucleotide
guuucugagaguccaaagacaguuuug

SEQ ID NO: 1574 - RNA, 27 nt, Artificial Sequence
  Synthetic oligonucleotide
guaauuauugcaagugagguuagagag

SEQ ID NO: 1575 - RNA, 27 nt, Artificial Sequence
  Synthetic oligonucleotide
uguuuuuguaauuauugcaagugaggu

SEQ ID NO: 1576 - RNA, 27 nt, Artificial Sequence
  Synthetic oligonucleotide
uccauaaugaaggcgaacggcauucug

SEQ ID NO: 1577 - RNA, 27 nt, Artificial Sequence
  Synthetic oligonucleotide
acaacaggcaguccauaaugaaggcga

SEQ ID NO: 1578 - RNA, 27 nt, Artificial Sequence
  Synthetic oligonucleotide
uaaccacaacaggcaguccauaaugaa

SEQ ID NO: 1579 - RNA, 27 nt, Artificial Sequence
  Synthetic oligonucleotide
aggaguuuaaccacaacaggcagucca

SEQ ID NO: 1580 - RNA, 27 nt, Artificial Sequence
  Synthetic oligonucleotide
aagguuucgaaucaauccaacaguugc

SEQ ID NO: 1581 - RNA, 27 nt, Artificial Sequence
  Synthetic oligonucleotide
aacaauggaaugguauugaguccucgg

SEQ ID NO: 1582 - RNA, 27 nt, Artificial Sequence
  Synthetic oligonucleotide
ucuuguaauccuguggcuuguccucag

SEQ ID NO: 1583 - RNA, 27 nt, Artificial Sequence
  Synthetic oligonucleotide
ucucaugcuccaucauaggguccaucc

SEQ ID NO: 1584 - RNA, 27 nt, Artificial Sequence
  Synthetic oligonucleotide
aaaggacgauuuacaggucaguaucaa

SEQ ID NO: 1585 - RNA, 27 nt, Artificial Sequence
  Synthetic oligonucleotide
agaguaaaguauucacccacacuggcu

SEQ ID NO: 1586 - RNA, 27 nt, Artificial Sequence
  Synthetic oligonucleotide
gaguauaacgcugcaaaagcuguggca

SEQ ID NO: 1587 - RNA, 27 nt, Artificial Sequence
  Synthetic oligonucleotide
cucaucugaguauaacgcugcaaaagc

SEQ ID NO: 1588 - RNA, 27 nt, Artificial Sequence
  Synthetic oligonucleotide
aauguuacucaucugaguauaacgcug

SEQ ID NO: 1589 - RNA, 27 nt, Artificial Sequence
  Synthetic oligonucleotide
gcuauuaauguugaaaacagcaaaugu

SEQ ID NO: 1590 - RNA, 27 nt, Artificial Sequence
  Synthetic oligonucleotide
cacaaugcacguucagacacuacagcu

SEQ ID NO: 1591 - RNA, 27 nt, Artificial Sequence
  Synthetic oligonucleotide
aacaaaaagcguacuucgacuguuccc

SEQ ID NO: 1592 - RNA, 27 nt, Artificial Sequence
  Synthetic oligonucleotide
accagaacaaaaagcguacuucgacug

SEQ ID NO: 1593 - RNA, 27 nt, Artificial Sequence
  Synthetic oligonucleotide
aaaaggaccagaacaaaaagcguacuu

SEQ ID NO: 1594 - RNA, 27 nt, Artificial Sequence
  Synthetic oligonucleotide
aaaacaaagaacaagcaaggcuagggu

SEQ ID NO: 1595 - RNA, 27 nt, Artificial Sequence
  Synthetic oligonucleotide
auauuaaaacaaagaacaagcaaggcu

SEQ ID NO: 1596 - RNA, 27 nt, Artificial Sequence
  Synthetic oligonucleotide
aaaucagaaauugcuguagcagguuca

SEQ ID NO: 1597 - RNA, 27 nt, Artificial Sequence
  Synthetic oligonucleotide
gguucuuagaaaucagaaauugcugua

SEQ ID NO: 1598 - RNA, 27 nt, Artificial Sequence
  Synthetic oligonucleotide
acaaggcucaaauaacaccucuuacug

SEQ ID NO: 1599 - RNA, 27 nt, Artificial Sequence
  Synthetic oligonucleotide
uccaaaacaaggcucaaauaacaccuc

SEQ ID NO: 1600 - RNA, 27 nt, Artificial Sequence
  Synthetic oligonucleotide
uacuguccaaaacaaggcucaaauaac

SEQ ID NO: 1601 - RNA, 27 nt, Artificial Sequence
  Synthetic oligonucleotide
ugguauacuguccaaaacaaggcucaa

SEQ ID NO: 1602 - RNA, 27 nt, Artificial Sequence
  Synthetic oligonucleotide
accauuucuauaaccgcaucuguugaa

SEQ ID NO: 1603 - RNA, 27 nt, Artificial Sequence
  Synthetic oligonucleotide
uuuaauucugaaccauuucuauaaccg

SEQ ID NO: 1604 - RNA, 27 nt, Artificial Sequence
  Synthetic oligonucleotide
aaaaguuuaauucugaaccauuucuau

SEQ ID NO: 1605 - RNA, 27 nt, Artificial Sequence
  Synthetic oligonucleotide
gaggguauuugaaguauaccauacaac

SEQ ID NO: 1606 - RNA, 27 nt, Artificial Sequence
  Synthetic oligonucleotide
uuugaaguauaccauacaacuguuuug

SEQ ID NO: 1607 - RNA, 27 nt, Artificial Sequence
  Synthetic oligonucleotide
uugaaguauaccauacaacuguuuuga

SEQ ID NO: 1608 - RNA, 27 nt, Artificial Sequence
  Synthetic oligonucleotide
gaaguauaccauacaacuguuuugaaa

SEQ ID NO: 1609 - RNA, 27 nt, Artificial Sequence
  Synthetic oligonucleotide
aaguauaccauacaacuguuuugaaaa

SEQ ID NO: 1610 - RNA, 27 nt, Artificial Sequence
  Synthetic oligonucleotide
aguauaccauacaacuguuuugaaaau

SEQ ID NO: 1611 - RNA, 27 nt, Artificial Sequence
  Synthetic oligonucleotide
acuguuuugaaaauccagcguggacaa

SEQ ID NO: 1612 - RNA, 27 nt, Artificial Sequence
  Synthetic oligonucleotide
cuguuuugaaaauccagcguggacaau

SEQ ID NO: 1613 - RNA, 27 nt, Artificial Sequence
  Synthetic oligonucleotide
caauggcuacucaagcugauuugaugg

SEQ ID NO: 1614 - RNA, 27 nt, Artificial Sequence
  Synthetic oligonucleotide
cucaagcugauuugauggaguuggaca

SEQ ID NO: 1615 - RNA, 27 nt, Artificial Sequence
  Synthetic oligonucleotide
ugagugguaaaggcaauccugaggaag

SEQ ID NO: 1616 - RNA, 27 nt, Artificial Sequence
  Synthetic oligonucleotide
gagugguaaaggcaauccugaggaaga

SEQ ID NO: 1617 - RNA, 27 nt, Artificial Sequence
  Synthetic oligonucleotide
cucaagaacaaguagcugauauugaug

SEQ ID NO: 1618 - RNA, 27 nt, Artificial Sequence
  Synthetic oligonucleotide
ucaagaacaaguagcugauauugaugg

SEQ ID NO: 1619 - RNA, 27 nt, Artificial Sequence
  Synthetic oligonucleotide
aacaaguagcugauauugauggacagu

SEQ ID NO: 1620 - RNA, 27 nt, Artificial Sequence
  Synthetic oligonucleotide
agcugauauugauggacaguaugcaau

SEQ ID NO: 1621 - RNA, 27 nt, Artificial Sequence
  Synthetic oligonucleotide
uauugauggacaguaugcaaugacucg

SEQ ID NO: 1622 - RNA, 27 nt, Artificial Sequence
  Synthetic oligonucleotide
cuauguucccugagacauuagaugagg

SEQ ID NO: 1623 - RNA, 27 nt, Artificial Sequence
  Synthetic oligonucleotide
cacagaugcugaaacaugcaguuguaa

SEQ ID NO: 1624 - RNA, 27 nt, Artificial Sequence
  Synthetic oligonucleotide
cagaugcugaaacaugcaguuguaaac

SEQ ID NO: 1625 - RNA, 27 nt, Artificial Sequence
  Synthetic oligonucleotide
aacaugcaguuguaaacuugauuaacu

SEQ ID NO: 1626 - RNA, 27 nt, Artificial Sequence
  Synthetic oligonucleotide
caguuguaaacuugauuaacuaucaag

SEQ ID NO: 1627 - RNA, 27 nt, Artificial Sequence
  Synthetic oligonucleotide
acuugauuaacuaucaagaugaugcag

SEQ ID NO: 1628 - RNA, 27 nt, Artificial Sequence
  Synthetic oligonucleotide
cuugauuaacuaucaagaugaugcaga

SEQ ID NO: 1629 - RNA, 27 nt, Artificial Sequence
  Synthetic oligonucleotide
acaaaacugcuaaaugacgaggaccag

SEQ ID NO: 1630 - RNA, 27 nt, Artificial Sequence
  Synthetic oligonucleotide
guggugguuaauaaggcugcaguuaug

SEQ ID NO: 1631 - RNA, 27 nt, Artificial Sequence
  Synthetic oligonucleotide
uggugguuaauaaggcugcaguuaugg

SEQ ID NO: 1632 - RNA, 27 nt, Artificial Sequence
  Synthetic oligonucleotide
ugguuaauaaggcugcaguuauggucc

SEQ ID NO: 1633 - RNA, 27 nt, Artificial Sequence
  Synthetic oligonucleotide
uuaugguccaucagcuuucuaaaaagg

SEQ ID NO: 1634 - RNA, 27 nt, Artificial Sequence
  Synthetic oligonucleotide
gauggugucugcuauuguacguaccau

SEQ ID NO: 1635 - RNA, 27 nt, Artificial Sequence
  Synthetic oligonucleotide
uacguaccaugcagaauacaaaugaug

SEQ ID NO: 1636 - RNA, 27 nt, Artificial Sequence
  Synthetic oligonucleotide
ugcagaauacaaaugauguagaaacag

SEQ ID NO: 1637 - RNA, 27 nt, Artificial Sequence
  Synthetic oligonucleotide
gcagaauacaaaugauguagaaacagc

SEQ ID NO: 1638 - RNA, 27 nt, Artificial Sequence
  Synthetic oligonucleotide
aaaugauguagaaacagcucguuguac

SEQ ID NO: 1639 - RNA, 27 nt, Artificial Sequence
  Synthetic oligonucleotide
augauguagaaacagcucguuguaccg

SEQ ID NO: 1640 - RNA, 27 nt, Artificial Sequence
  Synthetic oligonucleotide
ugauguagaaacagcucguuguaccgc

SEQ ID NO: 1641 - RNA, 27 nt, Artificial Sequence
  Synthetic oligonucleotide
accaguggauucuguguuguuuuaugc

SEQ ID NO: 1642 - RNA, 27 nt, Artificial Sequence
  Synthetic oligonucleotide
caguggauucuguguuguuuuaugcca

SEQ ID NO: 1643 - RNA, 27 nt, Artificial Sequence
  Synthetic oligonucleotide
aguggauucuguguuguuuuaugccau

SEQ ID NO: 1644 - RNA, 27 nt, Artificial Sequence
  Synthetic oligonucleotide
accuuuuauuacaucaagaaggagcua

SEQ ID NO: 1645 - RNA, 27 nt, Artificial Sequence
  Synthetic oligonucleotide
ccuuuuauuacaucaagaaggagcuaa

SEQ ID NO: 1646 - RNA, 27 nt, Artificial Sequence
  Synthetic oligonucleotide
gccuugcucaacaaaacaaauguuaaa

SEQ ID NO: 1647 - RNA, 27 nt, Artificial Sequence
  Synthetic oligonucleotide
acaaaacaaauguuaaauucuuggcua

SEQ ID NO: 1648 - RNA, 27 nt, Artificial Sequence
  Synthetic oligonucleotide
acaaauguuaaauucuuggcuauuacg

SEQ ID NO: 1649 - RNA, 27 nt, Artificial Sequence
  Synthetic oligonucleotide
caaauguuaaauucuuggcuauuacga

SEQ ID NO: 1650 - RNA, 27 nt, Artificial Sequence
  Synthetic oligonucleotide
gacagacugccuucaaauuuuagcuua

SEQ ID NO: 1651 - RNA, 27 nt, Artificial Sequence
  Synthetic oligonucleotide
agcuuuaguaaauauaaugaggaccua

SEQ ID NO: 1652 - RNA, 27 nt, Artificial Sequence
  Synthetic oligonucleotide
uaguaaauauaaugaggaccuauacuu

SEQ ID NO: 1653 - RNA, 27 nt, Artificial Sequence
  Synthetic oligonucleotide
aguaaauauaaugaggaccuauacuua

SEQ ID NO: 1654 - RNA, 27 nt, Artificial Sequence
  Synthetic oligonucleotide
uaaugaggaccuauacuuacgaaaaac

SEQ ID NO: 1655 - RNA, 27 nt, Artificial Sequence
  Synthetic oligonucleotide
aaugaggaccuauacuuacgaaaaacu

SEQ ID NO: 1656 - RNA, 27 nt, Artificial Sequence
  Synthetic oligonucleotide
augaggaccuauacuuacgaaaaacua

SEQ ID NO: 1657 - RNA, 27 nt, Artificial Sequence
  Synthetic oligonucleotide
ugaggaccuauacuuacgaaaaacuac

SEQ ID NO: 1658 - RNA, 27 nt, Artificial Sequence
  Synthetic oligonucleotide
uacuuacgaaaaacuacuguggaccac

SEQ ID NO: 1659 - RNA, 27 nt, Artificial Sequence
  Synthetic oligonucleotide
cucuaguaauaagccggcuauuguaga

SEQ ID NO: 1660 - RNA, 27 nt, Artificial Sequence
  Synthetic oligonucleotide
cuaguaauaagccggcuauuguagaag

SEQ ID NO: 1661 - RNA, 27 nt, Artificial Sequence
  Synthetic oligonucleotide
agcugguggaaugcaagcuuuaggacu

SEQ ID NO: 1662 - RNA, 27 nt, Artificial Sequence
  Synthetic oligonucleotide
gcugguggaaugcaagcuuuaggacuu

SEQ ID NO: 1663 - RNA, 27 nt, Artificial Sequence
  Synthetic oligonucleotide
cugguggaaugcaagcuuuaggacuuc

SEQ ID NO: 1664 - RNA, 27 nt, Artificial Sequence
  Synthetic oligonucleotide
uccaagucaacgucuuguucagaacug

SEQ ID NO: 1665 - RNA, 27 nt, Artificial Sequence
  Synthetic oligonucleotide
ccaagucaacgucuuguucagaacugu

SEQ ID NO: 1666 - RNA, 27 nt, Artificial Sequence
  Synthetic oligonucleotide
gucuuguucagaacugucuuuggacuc

SEQ ID NO: 1667 - RNA, 27 nt, Artificial Sequence
  Synthetic oligonucleotide
uucagaugcugcaacuaaacaggaagg

SEQ ID NO: 1668 - RNA, 27 nt, Artificial Sequence
  Synthetic oligonucleotide
uucuggguucagaugauauaaaugugg

SEQ ID NO: 1669 - RNA, 27 nt, Artificial Sequence
  Synthetic oligonucleotide
uggguucagaugauauaaaugugguca

SEQ ID NO: 1670 - RNA, 27 nt, Artificial Sequence
  Synthetic oligonucleotide
augauauaaauguggucaccugugcag

SEQ ID NO: 1671 - RNA, 27 nt, Artificial Sequence
  Synthetic oligonucleotide
ugauauaaauguggucaccugugcagc

SEQ ID NO: 1672 - RNA, 27 nt, Artificial Sequence
  Synthetic oligonucleotide
ggaauucuuucuaaccucacuugcaau

SEQ ID NO: 1673 - RNA, 27 nt, Artificial Sequence
  Synthetic oligonucleotide
uucuaaccucacuugcaauaauuauaa

SEQ ID NO: 1674 - RNA, 27 nt, Artificial Sequence
  Synthetic oligonucleotide
ugcaauaauuauaagaacaagaugaug

SEQ ID NO: 1675 - RNA, 27 nt, Artificial Sequence
  Synthetic oligonucleotide
gcaauaauuauaagaacaagaugaugg

SEQ ID NO: 1676 - RNA, 27 nt, Artificial Sequence
  Synthetic oligonucleotide
auaauuauaagaacaagaugauggucu

SEQ ID NO: 1677 - RNA, 27 nt, Artificial Sequence
  Synthetic oligonucleotide
aauuauaagaacaagaugauggucugc

SEQ ID NO: 1678 - RNA, 27 nt, Artificial Sequence
  Synthetic oligonucleotide
cucugauaaaggcuacuguuggauuga

SEQ ID NO: 1679 - RNA, 27 nt, Artificial Sequence
  Synthetic oligonucleotide
auaaaggcuacuguuggauugauucga

SEQ ID NO: 1680 - RNA, 27 nt, Artificial Sequence
  Synthetic oligonucleotide
gugggacacagcagcaauuuguggagg

SEQ ID NO: 1681 - RNA, 27 nt, Artificial Sequence
  Synthetic oligonucleotide
cauggaagaaauaguugaagguuguac

SEQ ID NO: 1682 - RNA, 27 nt, Artificial Sequence
  Synthetic oligonucleotide
auggaagaaauaguugaagguuguacc

SEQ ID NO: 1683 - RNA, 27 nt, Artificial Sequence
  Synthetic oligonucleotide
uggaagaaauaguugaagguuguaccg

SEQ ID NO: 1684 - RNA, 27 nt, Artificial Sequence
  Synthetic oligonucleotide
ggaagaaauaguugaagguuguaccgg

SEQ ID NO: 1685 - RNA, 27 nt, Artificial Sequence
  Synthetic oligonucleotide
aaauaguugaagguuguaccggagccc

SEQ ID NO: 1686 - RNA, 27 nt, Artificial Sequence
  Synthetic oligonucleotide
cucgggauguucacaaccgaauuguua

SEQ ID NO: 1687 - RNA, 27 nt, Artificial Sequence
  Synthetic oligonucleotide
ucgggauguucacaaccgaauuguuau

SEQ ID NO: 1688 - RNA, 27 nt, Artificial Sequence
  Synthetic oligonucleotide
cgggauguucacaaccgaauuguuauc

SEQ ID NO: 1689 - RNA, 27 nt, Artificial Sequence
  Synthetic oligonucleotide
gggauguucacaaccgaauuguuauca

SEQ ID NO: 1690 - RNA, 27 nt, Artificial Sequence
  Synthetic oligonucleotide
ggauguucacaaccgaauuguuaucag

SEQ ID NO: 1691 - RNA, 27 nt, Artificial Sequence
  Synthetic oligonucleotide
gauguucacaaccgaauuguuaucaga

SEQ ID NO: 1692 - RNA, 27 nt, Artificial Sequence
  Synthetic oligonucleotide
ccgaauuguuaucagaggacuaaauac

SEQ ID NO: 1693 - RNA, 27 nt, Artificial Sequence
  Synthetic oligonucleotide
cgaauuguuaucagaggacuaaauacc

SEQ ID NO: 1694 - RNA, 27 nt, Artificial Sequence
  Synthetic oligonucleotide
gaauuguuaucagaggacuaaauacca

SEQ ID NO: 1695 - RNA, 27 nt, Artificial Sequence
  Synthetic oligonucleotide
aauuguuaucagaggacuaaauaccau

SEQ ID NO: 1696 - RNA, 27 nt, Artificial Sequence
  Synthetic oligonucleotide
agaggacuaaauaccauuccauuguuu

SEQ ID NO: 1697 - RNA, 27 nt, Artificial Sequence
  Synthetic oligonucleotide
gacuaaauaccauuccauuguuugugc

SEQ ID NO: 1698 - RNA, 27 nt, Artificial Sequence
  Synthetic oligonucleotide
cuaaauaccauuccauuguuugugcag

SEQ ID NO: 1699 - RNA, 27 nt, Artificial Sequence
  Synthetic oligonucleotide
uaaauaccauuccauuguuugugcagc

SEQ ID NO: 1700 - RNA, 27 nt, Artificial Sequence
  Synthetic oligonucleotide
ccauugaaaacauccaaagaguagcug

SEQ ID NO: 1701 - RNA, 27 nt, Artificial Sequence
  Synthetic oligonucleotide
cauugaaaacauccaaagaguagcugc

SEQ ID NO: 1702 - RNA, 27 nt, Artificial Sequence
  Synthetic oligonucleotide
aggaagcugcagaagcuauugaagcug

SEQ ID NO: 1703 - RNA, 27 nt, Artificial Sequence
  Synthetic oligonucleotide
ugcagaagcuauugaagcugagggagc

SEQ ID NO: 1704 - RNA, 27 nt, Artificial Sequence
  Synthetic oligonucleotide
cagaagcuauugaagcugagggagcca

SEQ ID NO: 1705 - RNA, 27 nt, Artificial Sequence
  Synthetic oligonucleotide
gacagaguuacuucacucuaggaauga

SEQ ID NO: 1706 - RNA, 27 nt, Artificial Sequence
  Synthetic oligonucleotide
cagaguuacuucacucuaggaaugaag

SEQ ID NO: 1707 - RNA, 27 nt, Artificial Sequence
  Synthetic oligonucleotide
agaguuacuucacucuaggaaugaagg

SEQ ID NO: 1708 - RNA, 27 nt, Artificial Sequence
  Synthetic oligonucleotide
cuguuuuguuccgaaugucugaggaca

SEQ ID NO: 1709 - RNA, 27 nt, Artificial Sequence
  Synthetic oligonucleotide
guuuuguuccgaaugucugaggacaag

SEQ ID NO: 1710 - RNA, 27 nt, Artificial Sequence
  Synthetic oligonucleotide
gacaagccacaagauuacaagaaacgg

SEQ ID NO: 1711 - RNA, 27 nt, Artificial Sequence
  Synthetic oligonucleotide
acaagauuacaagaaacggcuuucagu

SEQ ID NO: 1712 - RNA, 27 nt, Artificial Sequence
  Synthetic oligonucleotide
uacaagaaacggcuuucaguugagcug

SEQ ID NO: 1713 - RNA, 27 nt, Artificial Sequence
  Synthetic oligonucleotide
ggaaugagacugcugaucuuggacuug

SEQ ID NO: 1714 - RNA, 27 nt, Artificial Sequence
  Synthetic oligonucleotide
ugcugaucuuggacuugauauuggugc

SEQ ID NO: 1715 - RNA, 27 nt, Artificial Sequence
  Synthetic oligonucleotide
ccaggaugauccuagcuaucguucuuu

SEQ ID NO: 1716 - RNA, 27 nt, Artificial Sequence
  Synthetic oligonucleotide
aucguucuuuucacucugguggauaug

SEQ ID NO: 1717 - RNA, 27 nt, Artificial Sequence
  Synthetic oligonucleotide
ccugguuugauacugaccuguaaauca

SEQ ID NO: 1718 - RNA, 27 nt, Artificial Sequence
  Synthetic oligonucleotide
cugguuugauacugaccuguaaaucau

SEQ ID NO: 1719 - RNA, 27 nt, Artificial Sequence
  Synthetic oligonucleotide
ugguuugauacugaccuguaaaucauc

SEQ ID NO: 1720 - RNA, 27 nt, Artificial Sequence
  Synthetic oligonucleotide
ccuguaaaucauccuuuagguaagaag

SEQ ID NO: 1721 - RNA, 27 nt, Artificial Sequence
  Synthetic oligonucleotide
cuguaaaucauccuuuagguaagaagu

SEQ ID NO: 1722 - RNA, 27 nt, Artificial Sequence
  Synthetic oligonucleotide
guaaaucauccuuuagguaagaaguuu

SEQ ID NO: 1723 - RNA, 27 nt, Artificial Sequence
  Synthetic oligonucleotide
uccuuuagguaagaaguuuuaaaaagc

SEQ ID NO: 1724 - RNA, 27 nt, Artificial Sequence
  Synthetic oligonucleotide
cuuuagguaagaaguuuuaaaaagcca

SEQ ID NO: 1725 - RNA, 27 nt, Artificial Sequence
  Synthetic oligonucleotide
guaagaaguuuuaaaaagccaguuugg

SEQ ID NO: 1726 - RNA, 27 nt, Artificial Sequence
  Synthetic oligonucleotide
gaaguuuuaaaaagccaguuuggguaa

SEQ ID NO: 1727 - RNA, 27 nt, Artificial Sequence
  Synthetic oligonucleotide
aaguuuuaaaaagccaguuuggguaaa

SEQ ID NO: 1728 - RNA, 27 nt, Artificial Sequence
  Synthetic oligonucleotide
aguuuuaaaaagccaguuuggguaaaa

SEQ ID NO: 1729 - RNA, 27 nt, Artificial Sequence
  Synthetic oligonucleotide
guuuuaaaaagccaguuuggguaaaau

SEQ ID NO: 1730 - RNA, 27 nt, Artificial Sequence
  Synthetic oligonucleotide
uacagaacuucagaaagacuugguugg

SEQ ID NO: 1731 - RNA, 27 nt, Artificial Sequence
  Synthetic oligonucleotide
uucagaaagacuugguugguagggugg

SEQ ID NO: 1732 - RNA, 27 nt, Artificial Sequence
  Synthetic oligonucleotide
ugggagugguuuaggcuauuuguaaau

SEQ ID NO: 1733 - RNA, 27 nt, Artificial Sequence
  Synthetic oligonucleotide
gggagugguuuaggcuauuuguaaauc

SEQ ID NO: 1734 - RNA, 27 nt, Artificial Sequence
  Synthetic oligonucleotide
ggagugguuuaggcuauuuguaaaucu

SEQ ID NO: 1735 - RNA, 27 nt, Artificial Sequence
  Synthetic oligonucleotide
gagugguuuaggcuauuuguaaaucug

SEQ ID NO: 1736 - RNA, 27 nt, Artificial Sequence
  Synthetic oligonucleotide
gcuauuuguaaaucugccacaaaaaca

SEQ ID NO: 1737 - RNA, 27 nt, Artificial Sequence
  Synthetic oligonucleotide
cuauuuguaaaucugccacaaaaacag

SEQ ID NO: 1738 - RNA, 27 nt, Artificial Sequence
  Synthetic oligonucleotide
uauuuguaaaucugccacaaaaacagg

SEQ ID NO: 1739 - RNA, 27 nt, Artificial Sequence
  Synthetic oligonucleotide
guaaaucugccacaaaaacagguauau

SEQ ID NO: 1740 - RNA, 27 nt, Artificial Sequence
  Synthetic oligonucleotide
cacaaaaacagguauauacuuugaaag

SEQ ID NO: 1741 - RNA, 27 nt, Artificial Sequence
  Synthetic oligonucleotide
aacagguauauacuuugaaaggagaug

SEQ ID NO: 1742 - RNA, 27 nt, Artificial Sequence
  Synthetic oligonucleotide
acagguauauacuuugaaaggagaugu

SEQ ID NO: 1743 - RNA, 27 nt, Artificial Sequence
  Synthetic oligonucleotide
agguauauacuuugaaaggagaugucu

SEQ ID NO: 1744 - RNA, 27 nt, Artificial Sequence
  Synthetic oligonucleotide
gguauauacuuugaaaggagaugucuu

SEQ ID NO: 1745 - RNA, 27 nt, Artificial Sequence
  Synthetic oligonucleotide
guauauacuuugaaaggagaugucuug

SEQ ID NO: 1746 - RNA, 27 nt, Artificial Sequence
  Synthetic oligonucleotide
uacuuugaaaggagaugucuuggaaca

SEQ ID NO: 1747 - RNA, 27 nt, Artificial Sequence
  Synthetic oligonucleotide
aaggagaugucuuggaacauuggaaug

SEQ ID NO: 1748 - RNA, 27 nt, Artificial Sequence
  Synthetic oligonucleotide
aggagaugucuuggaacauuggaaugu

SEQ ID NO: 1749 - RNA, 27 nt, Artificial Sequence
  Synthetic oligonucleotide
gagaugucuuggaacauuggaauguuc

SEQ ID NO: 1750 - RNA, 27 nt, Artificial Sequence
  Synthetic oligonucleotide
aacauuggaauguucucagauuucugg

SEQ ID NO: 1751 - RNA, 27 nt, Artificial Sequence
  Synthetic oligonucleotide
uuggaauguucucagauuucugguugu

SEQ ID NO: 1752 - RNA, 27 nt, Artificial Sequence
  Synthetic oligonucleotide
ggaauguucucagauuucugguuguua

SEQ ID NO: 1753 - RNA, 27 nt, Artificial Sequence
  Synthetic oligonucleotide
gaauguucucagauuucugguuguuau

SEQ ID NO: 1754 - RNA, 27 nt, Artificial Sequence
  Synthetic oligonucleotide
aauguucucagauuucugguuguuaug

SEQ ID NO: 1755 - RNA, 27 nt, Artificial Sequence
  Synthetic oligonucleotide
cucagauuucugguuguuaugugauca

SEQ ID NO: 1756 - RNA, 27 nt, Artificial Sequence
  Synthetic oligonucleotide
ucagauuucugguuguuaugugaucau

SEQ ID NO: 1757 - RNA, 27 nt, Artificial Sequence
  Synthetic oligonucleotide
uucugguuguuaugugaucaugugugg

SEQ ID NO: 1758 - RNA, 27 nt, Artificial Sequence
  Synthetic oligonucleotide
ugguuguuaugugaucauguguggaag

SEQ ID NO: 1759 - RNA, 27 nt, Artificial Sequence
  Synthetic oligonucleotide
guuaugugaucauguguggaaguuauu

SEQ ID NO: 1760 - RNA, 27 nt, Artificial Sequence
  Synthetic oligonucleotide
uuaugugaucauguguggaaguuauua

SEQ ID NO: 1761 - RNA, 27 nt, Artificial Sequence
  Synthetic oligonucleotide
uaugugaucauguguggaaguuauuaa

SEQ ID NO: 1762 - RNA, 27 nt, Artificial Sequence
  Synthetic oligonucleotide
augugaucauguguggaaguuauuaac

SEQ ID NO: 1763 - RNA, 27 nt, Artificial Sequence
  Synthetic oligonucleotide
cauguguggaaguuauuaacuuuaaug

SEQ ID NO: 1764 - RNA, 27 nt, Artificial Sequence
  Synthetic oligonucleotide
auguguggaaguuauuaacuuuaaugu

SEQ ID NO: 1765 - RNA, 27 nt, Artificial Sequence
  Synthetic oligonucleotide
guguggaaguuauuaacuuuaauguuu

SEQ ID NO: 1766 - RNA, 27 nt, Artificial Sequence
  Synthetic oligonucleotide
uguggaaguuauuaacuuuaauguuuu

SEQ ID NO: 1767 - RNA, 27 nt, Artificial Sequence
  Synthetic oligonucleotide
guggaaguuauuaacuuuaauguuuuu

SEQ ID NO: 1768 - RNA, 27 nt, Artificial Sequence
  Synthetic oligonucleotide
uggaaguuauuaacuuuaauguuuuuu

SEQ ID NO: 1769 - RNA, 27 nt, Artificial Sequence
  Synthetic oligonucleotide
ggaaguuauuaacuuuaauguuuuuug

SEQ ID NO: 1770 - RNA, 27 nt, Artificial Sequence
  Synthetic oligonucleotide
gaaguuauuaacuuuaauguuuuuugc

SEQ ID NO: 1771 - RNA, 27 nt, Artificial Sequence
  Synthetic oligonucleotide
aguuauuaacuuuaauguuuuuugcca

SEQ ID NO: 1772 - RNA, 27 nt, Artificial Sequence
  Synthetic oligonucleotide
guuauuaacuuuaauguuuuuugccac

SEQ ID NO: 1773 - RNA, 27 nt, Artificial Sequence
  Synthetic oligonucleotide
uaauguuuuuugccacagcuuuugcaa

SEQ ID NO: 1774 - RNA, 27 nt, Artificial Sequence
  Synthetic oligonucleotide
aauguuuuuugccacagcuuuugcaac

SEQ ID NO: 1775 - RNA, 27 nt, Artificial Sequence
  Synthetic oligonucleotide
cuuuugcaacuuaauacucaaaugagu

SEQ ID NO: 1776 - RNA, 27 nt, Artificial Sequence
  Synthetic oligonucleotide
ucaaaugaguaacauuugcuguuuuaa

SEQ ID NO: 1777 - RNA, 27 nt, Artificial Sequence
  Synthetic oligonucleotide
caaaugaguaacauuugcuguuuuaaa

SEQ ID NO: 1778 - RNA, 27 nt, Artificial Sequence
  Synthetic oligonucleotide
aaaugaguaacauuugcuguuuuaaac

SEQ ID NO: 1779 - RNA, 27 nt, Artificial Sequence
  Synthetic oligonucleotide
aaugaguaacauuugcuguuuuaaaca

SEQ ID NO: 1780 - RNA, 27 nt, Artificial Sequence
  Synthetic oligonucleotide
augaguaacauuugcuguuuuaaacau

SEQ ID NO: 1781 - RNA, 27 nt, Artificial Sequence
  Synthetic oligonucleotide
ugaguaacauuugcuguuuuaaacauu

SEQ ID NO: 1782 - RNA, 27 nt, Artificial Sequence
  Synthetic oligonucleotide
aacauuugcuguuuuaaacauuaauag

SEQ ID NO: 1783 - RNA, 27 nt, Artificial Sequence
  Synthetic oligonucleotide
uuuaaacauuaauagcagccuuucucu

SEQ ID NO: 1784 - RNA, 27 nt, Artificial Sequence
  Synthetic oligonucleotide
uuuauacagcuguauugucugaacuug

SEQ ID NO: 1785 - RNA, 27 nt, Artificial Sequence
  Synthetic oligonucleotide
gcuguauugucugaacuugcauuguga

SEQ ID NO: 1786 - RNA, 27 nt, Artificial Sequence
  Synthetic oligonucleotide
uguauugucugaacuugcauugugauu

SEQ ID NO: 1787 - RNA, 27 nt, Artificial Sequence
  Synthetic oligonucleotide
uauugucugaacuugcauugugauugg

SEQ ID NO: 1788 - RNA, 27 nt, Artificial Sequence
  Synthetic oligonucleotide
gucugaacuugcauugugauuggccug

SEQ ID NO: 1789 - RNA, 27 nt, Artificial Sequence
  Synthetic oligonucleotide
accaagcugaguuuccuaugggaacaa

SEQ ID NO: 1790 - RNA, 27 nt, Artificial Sequence
  Synthetic oligonucleotide
cugaguuuccuaugggaacaauugaag

SEQ ID NO: 1791 - RNA, 27 nt, Artificial Sequence
  Synthetic oligonucleotide
ugaguuuccuaugggaacaauugaagu

SEQ ID NO: 1792 - RNA, 27 nt, Artificial Sequence
  Synthetic oligonucleotide
uccuaugggaacaauugaaguaaacuu

SEQ ID NO: 1793 - RNA, 27 nt, Artificial Sequence
  Synthetic oligonucleotide
ccuaugggaacaauugaaguaaacuuu

SEQ ID NO: 1794 - RNA, 27 nt, Artificial Sequence
  Synthetic oligonucleotide
ugggaacaauugaaguaaacuuuuugu

SEQ ID NO: 1795 - RNA, 27 nt, Artificial Sequence
  Synthetic oligonucleotide
aacaauugaaguaaacuuuuuguucug

SEQ ID NO: 1796 - RNA, 27 nt, Artificial Sequence
  Synthetic oligonucleotide
uugaaguaaacuuuuuguucugguccu

SEQ ID NO: 1797 - RNA, 27 nt, Artificial Sequence
  Synthetic oligonucleotide
ugaaguaaacuuuuuguucugguccuu

SEQ ID NO: 1798 - RNA, 27 nt, Artificial Sequence
  Synthetic oligonucleotide
acuuuuuguucugguccuuuuuggucg

SEQ ID NO: 1799 - RNA, 27 nt, Artificial Sequence
  Synthetic oligonucleotide
cuuuuuguucugguccuuuuuggucga

SEQ ID NO: 1800 - RNA, 27 nt, Artificial Sequence
  Synthetic oligonucleotide
uucugguccuuuuuggucgaggaguaa

SEQ ID NO: 1801 - RNA, 27 nt, Artificial Sequence
  Synthetic oligonucleotide
gucgaggaguaacaauacaaauggauu

SEQ ID NO: 1802 - RNA, 27 nt, Artificial Sequence
  Synthetic oligonucleotide
ucgaggaguaacaauacaaauggauuu

SEQ ID NO: 1803 - RNA, 27 nt, Artificial Sequence
  Synthetic oligonucleotide
cgaggaguaacaauacaaauggauuuu

SEQ ID NO: 1804 - RNA, 27 nt, Artificial Sequence
  Synthetic oligonucleotide
gaggaguaacaauacaaauggauuuug

SEQ ID NO: 1805 - RNA, 27 nt, Artificial Sequence
  Synthetic oligonucleotide
aggaguaacaauacaaauggauuuugg

SEQ ID NO: 1806 - RNA, 27 nt, Artificial Sequence
  Synthetic oligonucleotide
aacaauacaaauggauuuugggaguga

SEQ ID NO: 1807 - RNA, 27 nt, Artificial Sequence
  Synthetic oligonucleotide
uuuugggagugacucaagaagugaaga

SEQ ID NO: 1808 - RNA, 27 nt, Artificial Sequence
  Synthetic oligonucleotide
uugggagugacucaagaagugaagaau

SEQ ID NO: 1809 - RNA, 27 nt, Artificial Sequence
  Synthetic oligonucleotide
ugggagugacucaagaagugaagaaug

SEQ ID NO: 1810 - RNA, 27 nt, Artificial Sequence
  Synthetic oligonucleotide
gggagugacucaagaagugaagaaugc

SEQ ID NO: 1811 - RNA, 27 nt, Artificial Sequence
  Synthetic oligonucleotide
gagugacucaagaagugaagaaugcac

SEQ ID NO: 1812 - RNA, 27 nt, Artificial Sequence
  Synthetic oligonucleotide
caagaagugaagaaugcacaagaaugg

SEQ ID NO: 1813 - RNA, 27 nt, Artificial Sequence
  Synthetic oligonucleotide
gaagugaagaaugcacaagaauggauc

SEQ ID NO: 1814 - RNA, 27 nt, Artificial Sequence
  Synthetic oligonucleotide
aagugaagaaugcacaagaauggauca

SEQ ID NO: 1815 - RNA, 27 nt, Artificial Sequence
  Synthetic oligonucleotide
agugaagaaugcacaagaauggaucac

SEQ ID NO: 1816 - RNA, 27 nt, Artificial Sequence
  Synthetic oligonucleotide
caagaauggaucacaagauggaauuua

SEQ ID NO: 1817 - RNA, 27 nt, Artificial Sequence
  Synthetic oligonucleotide
agaauggaucacaagauggaauuuauc

SEQ ID NO: 1818 - RNA, 27 nt, Artificial Sequence
  Synthetic oligonucleotide
gaauggaucacaagauggaauuuauca

SEQ ID NO: 1819 - RNA, 27 nt, Artificial Sequence
  Synthetic oligonucleotide
aauggaucacaagauggaauuuaucaa

SEQ ID NO: 1820 - RNA, 27 nt, Artificial Sequence
  Synthetic oligonucleotide
auggaucacaagauggaauuuaucaaa

SEQ ID NO: 1821 - RNA, 27 nt, Artificial Sequence
  Synthetic oligonucleotide
agauggaauuuaucaaacccuagccuu

SEQ ID NO: 1822 - RNA, 27 nt, Artificial Sequence
  Synthetic oligonucleotide
cccuagccuugcuuguuaaauuuuuuu

SEQ ID NO: 1823 - RNA, 27 nt, Artificial Sequence
  Synthetic oligonucleotide
ugcuuguuaaauuuuuuuuuuuuuuuu

SEQ ID NO: 1824 - RNA, 27 nt, Artificial Sequence
  Synthetic oligonucleotide
gcuuguuaaauuuuuuuuuuuuuuuuu

SEQ ID NO: 1825 - RNA, 27 nt, Artificial Sequence
  Synthetic oligonucleotide
cuuguuaaauuuuuuuuuuuuuuuuuu

SEQ ID NO: 1826 - RNA, 27 nt, Artificial Sequence
  Synthetic oligonucleotide
uuguuaaauuuuuuuuuuuuuuuuuuu

SEQ ID NO: 1827 - RNA, 27 nt, Artificial Sequence
  Synthetic oligonucleotide
uguuaaauuuuuuuuuuuuuuuuuuua

SEQ ID NO: 1828 - RNA, 27 nt, Artificial Sequence
  Synthetic oligonucleotide
guuaaauuuuuuuuuuuuuuuuuuuaa

SEQ ID NO: 1829 - RNA, 27 nt, Artificial Sequence
  Synthetic oligonucleotide
uuaaauuuuuuuuuuuuuuuuuuuaag

SEQ ID NO: 1830 - RNA, 27 nt, Artificial Sequence
  Synthetic oligonucleotide
uaaauuuuuuuuuuuuuuuuuuuaaga

SEQ ID NO: 1831 - RNA, 27 nt, Artificial Sequence
  Synthetic oligonucleotide
aauuuuuuuuuuuuuuuuuuuaagaau

SEQ ID NO: 1832 - RNA, 27 nt, Artificial Sequence
  Synthetic oligonucleotide
auuuuuuuuuuuuuuuuuuuaagaaua

SEQ ID NO: 1833 - RNA, 27 nt, Artificial Sequence
  Synthetic oligonucleotide
uuuuuuuuuuuuuuuuuuuaagaauau

SEQ ID NO: 1834 - RNA, 27 nt, Artificial Sequence
  Synthetic oligonucleotide
uuuuuuuuuuuuuuuuuuaagaauauc

SEQ ID NO: 1835 - RNA, 27 nt, Artificial Sequence
  Synthetic oligonucleotide
uuuuuuuuuuuuuuuuuaagaauaucu

SEQ ID NO: 1836 - RNA, 27 nt, Artificial Sequence
  Synthetic oligonucleotide
uuuuuuuuuuuuuuuuaagaauaucug

SEQ ID NO: 1837 - RNA, 27 nt, Artificial Sequence
  Synthetic oligonucleotide
uuuuuuuuuuuuuuuaagaauaucugu

SEQ ID NO: 1838 - RNA, 27 nt, Artificial Sequence
  Synthetic oligonucleotide
uuuuuuuuuuuaagaauaucuguaaug

SEQ ID NO: 1839 - RNA, 27 nt, Artificial Sequence
  Synthetic oligonucleotide
uuuuuuuuuuaagaauaucuguaaugg

SEQ ID NO: 1840 - RNA, 27 nt, Artificial Sequence
  Synthetic oligonucleotide
uuuuuuaagaauaucuguaaugguacu

SEQ ID NO: 1841 - RNA, 27 nt, Artificial Sequence
  Synthetic oligonucleotide
uuuuuaagaauaucuguaaugguacug

SEQ ID NO: 1842 - RNA, 27 nt, Artificial Sequence
  Synthetic oligonucleotide
uuuuaagaauaucuguaaugguacuga

SEQ ID NO: 1843 - RNA, 27 nt, Artificial Sequence
  Synthetic oligonucleotide
aagaauaucuguaaugguacugacuuu

SEQ ID NO: 1844 - RNA, 27 nt, Artificial Sequence
  Synthetic oligonucleotide
uacugacuuugcuugcuuugaaguagc

SEQ ID NO: 1845 - RNA, 27 nt, Artificial Sequence
  Synthetic oligonucleotide
ugcuugcuuugaaguagcucuuuuuuu

SEQ ID NO: 1846 - RNA, 27 nt, Artificial Sequence
  Synthetic oligonucleotide
gcuuugaaguagcucuuuuuuuuuuuu

SEQ ID NO: 1847 - RNA, 27 nt, Artificial Sequence
  Synthetic oligonucleotide
cuuugaaguagcucuuuuuuuuuuuuu

SEQ ID NO: 1848 - RNA, 27 nt, Artificial Sequence
  Synthetic oligonucleotide
uugaaguagcucuuuuuuuuuuuuuuu

SEQ ID NO: 1849 - RNA, 27 nt, Artificial Sequence
  Synthetic oligonucleotide
ugaaguagcucuuuuuuuuuuuuuuuu

SEQ ID NO: 1850 - RNA, 27 nt, Artificial Sequence
  Synthetic oligonucleotide
gaaguagcucuuuuuuuuuuuuuuuuu

SEQ ID NO: 1851 - RNA, 27 nt, Artificial Sequence
  Synthetic oligonucleotide
aaguagcucuuuuuuuuuuuuuuuuuu

SEQ ID NO: 1852 - RNA, 27 nt, Artificial Sequence
  Synthetic oligonucleotide
cucuuuuuuuuuuuuuuuuuuuuuuuu

SEQ ID NO: 1853 - RNA, 27 nt, Artificial Sequence
  Synthetic oligonucleotide
ucuuuuuuuuuuuuuuuuuuuuuuuuu

SEQ ID NO: 1854 - RNA, 27 nt, Artificial Sequence
  Synthetic oligonucleotide
cuuuuuuuuuuuuuuuuuuuuuuuuug

SEQ ID NO: 1855 - RNA, 27 nt, Artificial Sequence
  Synthetic oligonucleotide
uuuuuuuuuuuuuuuuuuuuuuuuugc

SEQ ID NO: 1856 - RNA, 27 nt, Artificial Sequence
  Synthetic oligonucleotide
uuuuuuuuuuuuuuuuuuuuuuugcag

SEQ ID NO: 1857 - RNA, 27 nt, Artificial Sequence
  Synthetic oligonucleotide
uuuuuuuuuuuuuuuuuuuuuugcagu

SEQ ID NO: 1858 - RNA, 27 nt, Artificial Sequence
  Synthetic oligonucleotide
uuuuuuuuuuuuuuuuuugcaguaacu

SEQ ID NO: 1859 - RNA, 27 nt, Artificial Sequence
  Synthetic oligonucleotide
uuuuuuuuuuuuuuuuugcaguaacug

SEQ ID NO: 1860 - RNA, 27 nt, Artificial Sequence
  Synthetic oligonucleotide
uuuuuuuuuuuuuuuugcaguaacugu

SEQ ID NO: 1861 - RNA, 27 nt, Artificial Sequence
  Synthetic oligonucleotide
uuuuuuuuuuuugcaguaacuguuuuu

SEQ ID NO: 1862 - RNA, 27 nt, Artificial Sequence
  Synthetic oligonucleotide
uuuuuuuuuuugcaguaacuguuuuuu

SEQ ID NO: 1863 - RNA, 27 nt, Artificial Sequence
  Synthetic oligonucleotide
uuuuuuuuuugcaguaacuguuuuuua

SEQ ID NO: 1864 - RNA, 27 nt, Artificial Sequence
  Synthetic oligonucleotide
uuuuuuuugcaguaacuguuuuuuaag

SEQ ID NO: 1865 - RNA, 27 nt, Artificial Sequence
  Synthetic oligonucleotide
uuuuuuugcaguaacuguuuuuuaagu

SEQ ID NO: 1866 - RNA, 27 nt, Artificial Sequence
  Synthetic oligonucleotide
uuuuugcaguaacuguuuuuuaagucu

SEQ ID NO: 1867 - RNA, 27 nt, Artificial Sequence
  Synthetic oligonucleotide
aacuguuuuuuaagucucucguagugu

SEQ ID NO: 1868 - RNA, 27 nt, Artificial Sequence
  Synthetic oligonucleotide
cuguuuuuuaagucucucguaguguua

SEQ ID NO: 1869 - RNA, 27 nt, Artificial Sequence
  Synthetic oligonucleotide
uguuuuuuaagucucucguaguguuaa

SEQ ID NO: 1870 - RNA, 27 nt, Artificial Sequence
  Synthetic oligonucleotide
uuuuuuaagucucucguaguguuaagu

SEQ ID NO: 1871 - RNA, 27 nt, Artificial Sequence
  Synthetic oligonucleotide
uuuaagucucucguaguguuaaguuau

SEQ ID NO: 1872 - RNA, 27 nt, Artificial Sequence
  Synthetic oligonucleotide
uuaagucucucguaguguuaaguuaua

SEQ ID NO: 1873 - RNA, 27 nt, Artificial Sequence
  Synthetic oligonucleotide
cucguaguguuaaguuauagugaauac

SEQ ID NO: 1874 - RNA, 27 nt, Artificial Sequence
  Synthetic oligonucleotide
ucguaguguuaaguuauagugaauacu

SEQ ID NO: 1875 - RNA, 27 nt, Artificial Sequence
  Synthetic oligonucleotide
cguaguguuaaguuauagugaauacug

SEQ ID NO: 1876 - RNA, 27 nt, Artificial Sequence
  Synthetic oligonucleotide
guaguguuaaguuauagugaauacugc

SEQ ID NO: 1877 - RNA, 27 nt, Artificial Sequence
  Synthetic oligonucleotide
auagugaauacugcuacagcaauuucu

SEQ ID NO: 1878 - RNA, 27 nt, Artificial Sequence
  Synthetic oligonucleotide
uagugaauacugcuacagcaauuucua

SEQ ID NO: 1879 - RNA, 27 nt, Artificial Sequence
  Synthetic oligonucleotide
agugaauacugcuacagcaauuucuaa

SEQ ID NO: 1880 - RNA, 27 nt, Artificial Sequence
  Synthetic oligonucleotide
gcaauuucuaauuuuuaagaauugagu

SEQ ID NO: 1881 - RNA, 27 nt, Artificial Sequence
  Synthetic oligonucleotide
uucuaauuuuuaagaauugaguaaugg

SEQ ID NO: 1882 - RNA, 27 nt, Artificial Sequence
  Synthetic oligonucleotide
uaauuuuuaagaauugaguaauggugu

SEQ ID NO: 1883 - RNA, 27 nt, Artificial Sequence
  Synthetic oligonucleotide
auuuuuaagaauugaguaaugguguag

SEQ ID NO: 1884 - RNA, 27 nt, Artificial Sequence
  Synthetic oligonucleotide
uuuuuaagaauugaguaaugguguaga

SEQ ID NO: 1885 - RNA, 27 nt, Artificial Sequence
  Synthetic oligonucleotide
uuuaagaauugaguaaugguguagaac

SEQ ID NO: 1886 - RNA, 27 nt, Artificial Sequence
  Synthetic oligonucleotide
uaagaauugaguaaugguguagaacac

SEQ ID NO: 1887 - RNA, 27 nt, Artificial Sequence
  Synthetic oligonucleotide
gaguaaugguguagaacacuaauucau

SEQ ID NO: 1888 - RNA, 27 nt, Artificial Sequence
  Synthetic oligonucleotide
augguguagaacacuaauucauaauca

SEQ ID NO: 1889 - RNA, 27 nt, Artificial Sequence
  Synthetic oligonucleotide
ugguguagaacacuaauucauaaucac

SEQ ID NO: 1890 - RNA, 27 nt, Artificial Sequence
  Synthetic oligonucleotide
gguguagaacacuaauucauaaucacu

SEQ ID NO: 1891 - RNA, 27 nt, Artificial Sequence
  Synthetic oligonucleotide
cacuaauucauaaucacucuaauuaau

SEQ ID NO: 1892 - RNA, 27 nt, Artificial Sequence
  Synthetic oligonucleotide
acuaauucauaaucacucuaauuaauu

SEQ ID NO: 1893 - RNA, 27 nt, Artificial Sequence
  Synthetic oligonucleotide
cuaauucauaaucacucuaauuaauug

SEQ ID NO: 1894 - RNA, 27 nt, Artificial Sequence
  Synthetic oligonucleotide
uucauaaucacucuaauuaauuguaau

SEQ ID NO: 1895 - RNA, 27 nt, Artificial Sequence
  Synthetic oligonucleotide
ucauaaucacucuaauuaauuguaauc

SEQ ID NO: 1896 - RNA, 27 nt, Artificial Sequence
  Synthetic oligonucleotide
cauaaucacucuaauuaauuguaaucu

SEQ ID NO: 1897 - RNA, 27 nt, Artificial Sequence
  Synthetic oligonucleotide
cucuaauuaauuguaaucugaauaaag

SEQ ID NO: 1898 - RNA, 27 nt, Artificial Sequence
  Synthetic oligonucleotide
ucuaauuaauuguaaucugaauaaagu

SEQ ID NO: 1899 - RNA, 27 nt, Artificial Sequence
  Synthetic oligonucleotide
auuaauuguaaucugaauaaaguguaa

SEQ ID NO: 1900 - RNA, 27 nt, Artificial Sequence
  Synthetic oligonucleotide
uuaauuguaaucugaauaaaguguaac

SEQ ID NO: 1901 - RNA, 27 nt, Artificial Sequence
  Synthetic oligonucleotide
uaauuguaaucugaauaaaguguaaca

SEQ ID NO: 1902 - RNA, 27 nt, Artificial Sequence
  Synthetic oligonucleotide
aauuguaaucugaauaaaguguaacaa

SEQ ID NO: 1903 - RNA, 27 nt, Artificial Sequence
  Synthetic oligonucleotide
auuguaaucugaauaaaguguaacaau

SEQ ID NO: 1904 - RNA, 27 nt, Artificial Sequence
  Synthetic oligonucleotide
ucugaauaaaguguaacaauuguguag

SEQ ID NO: 1905 - RNA, 27 nt, Artificial Sequence
  Synthetic oligonucleotide
aauaaaguguaacaauuguguagccuu

SEQ ID NO: 1906 - RNA, 27 nt, Artificial Sequence
  Synthetic oligonucleotide
aguguaacaauuguguagccuuuuugu

SEQ ID NO: 1907 - RNA, 27 nt, Artificial Sequence
  Synthetic oligonucleotide
acaauuguguagccuuuuuguauaaaa

SEQ ID NO: 1908 - RNA, 27 nt, Artificial Sequence
  Synthetic oligonucleotide
caauuguguagccuuuuuguauaaaau

SEQ ID NO: 1909 - RNA, 27 nt, Artificial Sequence
  Synthetic oligonucleotide
auuguguagccuuuuuguauaaaauag

SEQ ID NO: 1910 - RNA, 27 nt, Artificial Sequence
  Synthetic oligonucleotide
uuguguagccuuuuuguauaaaauaga

SEQ ID NO: 1911 - RNA, 27 nt, Artificial Sequence
  Synthetic oligonucleotide
guguagccuuuuuguauaaaauagaca

SEQ ID NO: 1912 - RNA, 27 nt, Artificial Sequence
  Synthetic oligonucleotide
ccuuuuuguauaaaauagacaaauaga

SEQ ID NO: 1913 - RNA, 27 nt, Artificial Sequence
  Synthetic oligonucleotide
uuuuuguauaaaauagacaaauagaaa

SEQ ID NO: 1914 - RNA, 27 nt, Artificial Sequence
  Synthetic oligonucleotide
uuuuguauaaaauagacaaauagaaaa

SEQ ID NO: 1915 - RNA, 27 nt, Artificial Sequence
  Synthetic oligonucleotide
uuuguauaaaauagacaaauagaaaau

SEQ ID NO: 1916 - RNA, 27 nt, Artificial Sequence
  Synthetic oligonucleotide
uuguauaaaauagacaaauagaaaaug

SEQ ID NO: 1917 - RNA, 27 nt, Artificial Sequence
  Synthetic oligonucleotide
uguauaaaauagacaaauagaaaaugg

SEQ ID NO: 1918 - RNA, 27 nt, Artificial Sequence
  Synthetic oligonucleotide
auaaaauagacaaauagaaaauggucc

SEQ ID NO: 1919 - RNA, 27 nt, Artificial Sequence
  Synthetic oligonucleotide
uaaaauagacaaauagaaaauggucca

SEQ ID NO: 1920 - RNA, 27 nt, Artificial Sequence
  Synthetic oligonucleotide
aaaauagacaaauagaaaaugguccaa

SEQ ID NO: 1921 - RNA, 27 nt, Artificial Sequence
  Synthetic oligonucleotide
acaaauagaaaaugguccaauuaguuu

SEQ ID NO: 1922 - RNA, 27 nt, Artificial Sequence
  Synthetic oligonucleotide
caaauagaaaaugguccaauuaguuuc

SEQ ID NO: 1923 - RNA, 27 nt, Artificial Sequence
  Synthetic oligonucleotide
aaauagaaaaugguccaauuaguuucc

SEQ ID NO: 1924 - RNA, 27 nt, Artificial Sequence
  Synthetic oligonucleotide
aauagaaaaugguccaauuaguuuccu

SEQ ID NO: 1925 - RNA, 27 nt, Artificial Sequence
  Synthetic oligonucleotide
aaaugguccaauuaguuuccuuuuuaa

SEQ ID NO: 1926 - RNA, 27 nt, Artificial Sequence
  Synthetic oligonucleotide
aaugguccaauuaguuuccuuuuuaau

SEQ ID NO: 1927 - RNA, 27 nt, Artificial Sequence
  Synthetic oligonucleotide
ccaauuaguuuccuuuuuaauaugcuu

SEQ ID NO: 1928 - RNA, 27 nt, Artificial Sequence
  Synthetic oligonucleotide
caauuaguuuccuuuuuaauaugcuua

SEQ ID NO: 1929 - RNA, 27 nt, Artificial Sequence
  Synthetic oligonucleotide
uaguuuccuuuuuaauaugcuuaaaau

SEQ ID NO: 1930 - RNA, 27 nt, Artificial Sequence
  Synthetic oligonucleotide
ccuuuuuaauaugcuuaaaauaagcag

SEQ ID NO: 1931 - RNA, 27 nt, Artificial Sequence
  Synthetic oligonucleotide
cuuuuuaauaugcuuaaaauaagcagg

SEQ ID NO: 1932 - RNA, 27 nt, Artificial Sequence
  Synthetic oligonucleotide
aauaugcuuaaaauaagcagguggauc

SEQ ID NO: 1933 - RNA, 27 nt, Artificial Sequence
  Synthetic oligonucleotide
agcagguggaucuauuucauguuuuug

SEQ ID NO: 1934 - RNA, 27 nt, Artificial Sequence
  Synthetic oligonucleotide
gcagguggaucuauuucauguuuuuga

SEQ ID NO: 1935 - RNA, 27 nt, Artificial Sequence
  Synthetic oligonucleotide
agguggaucuauuucauguuuuugauc

SEQ ID NO: 1936 - RNA, 27 nt, Artificial Sequence
  Synthetic oligonucleotide
gguggaucuauuucauguuuuugauca

SEQ ID NO: 1937 - RNA, 27 nt, Artificial Sequence
  Synthetic oligonucleotide
guggaucuauuucauguuuuugaucaa

SEQ ID NO: 1938 - RNA, 27 nt, Artificial Sequence
  Synthetic oligonucleotide
ucuauuucauguuuuugaucaaaaacu

SEQ ID NO: 1939 - RNA, 27 nt, Artificial Sequence
  Synthetic oligonucleotide
ucauguuuuugaucaaaaacuauuugg

SEQ ID NO: 1940 - RNA, 27 nt, Artificial Sequence
  Synthetic oligonucleotide
guuuuugaucaaaaacuauuugggaua

SEQ ID NO: 1941 - RNA, 27 nt, Artificial Sequence
  Synthetic oligonucleotide
uuuuugaucaaaaacuauuugggauau

SEQ ID NO: 1942 - RNA, 27 nt, Artificial Sequence
  Synthetic oligonucleotide
uuuugaucaaaaacuauuugggauaug

SEQ ID NO: 1943 - RNA, 27 nt, Artificial Sequence
  Synthetic oligonucleotide
uuugaucaaaaacuauuugggauaugu

SEQ ID NO: 1944 - RNA, 27 nt, Artificial Sequence
  Synthetic oligonucleotide
aucaaaaacuauuugggauauguaugg

SEQ ID NO: 1945 - RNA, 27 nt, Artificial Sequence
  Synthetic oligonucleotide
uauuugggauauguauggguaggguaa

SEQ ID NO: 1946 - RNA, 27 nt, Artificial Sequence
  Synthetic oligonucleotide
auuugggauauguauggguaggguaaa

SEQ ID NO: 1947 - RNA, 27 nt, Artificial Sequence
  Synthetic oligonucleotide
uuugggauauguauggguaggguaaau

SEQ ID NO: 1948 - RNA, 27 nt, Artificial Sequence
  Synthetic oligonucleotide
uggguaggguaaaucaguaagaggugu

SEQ ID NO: 1949 - RNA, 27 nt, Artificial Sequence
  Synthetic oligonucleotide
gguaggguaaaucaguaagagguguua

SEQ ID NO: 1950 - RNA, 27 nt, Artificial Sequence
  Synthetic oligonucleotide
guaggguaaaucaguaagagguguuau

SEQ ID NO: 1951 - RNA, 27 nt, Artificial Sequence
  Synthetic oligonucleotide
uaggguaaaucaguaagagguguuauu

SEQ ID NO: 1952 - RNA, 27 nt, Artificial Sequence
  Synthetic oligonucleotide
aggguaaaucaguaagagguguuauuu

SEQ ID NO: 1953 - RNA, 27 nt, Artificial Sequence
  Synthetic oligonucleotide
ggguaaaucaguaagagguguuauuug

SEQ ID NO: 1954 - RNA, 27 nt, Artificial Sequence
  Synthetic oligonucleotide
aucaguaagagguguuauuuggaaccu

SEQ ID NO: 1955 - RNA, 27 nt, Artificial Sequence
  Synthetic oligonucleotide
aagagguguuauuuggaaccuuguuuu

SEQ ID NO: 1956 - RNA, 27 nt, Artificial Sequence
  Synthetic oligonucleotide
agagguguuauuuggaaccuuguuuug

SEQ ID NO: 1957 - RNA, 27 nt, Artificial Sequence
  Synthetic oligonucleotide
gagguguuauuuggaaccuuguuuugg

SEQ ID NO: 1958 - RNA, 27 nt, Artificial Sequence
  Synthetic oligonucleotide
guuauuuggaaccuuguuuuggacagu

SEQ ID NO: 1959 - RNA, 27 nt, Artificial Sequence
  Synthetic oligonucleotide
uuuggaaccuuguuuuggacaguuuac

SEQ ID NO: 1960 - RNA, 27 nt, Artificial Sequence
  Synthetic oligonucleotide
uuggaaccuuguuuuggacaguuuacc

SEQ ID NO: 1961 - RNA, 27 nt, Artificial Sequence
  Synthetic oligonucleotide
uuguuuuggacaguuuaccaguugccu

SEQ ID NO: 1962 - RNA, 27 nt, Artificial Sequence
  Synthetic oligonucleotide
gacaguuuaccaguugccuuuuauccc

SEQ ID NO: 1963 - RNA, 27 nt, Artificial Sequence
  Synthetic oligonucleotide
acaguuuaccaguugccuuuuauccca

SEQ ID NO: 1964 - RNA, 27 nt, Artificial Sequence
  Synthetic oligonucleotide
accaguugccuuuuaucccaaaguugu

SEQ ID NO: 1965 - RNA, 27 nt, Artificial Sequence
  Synthetic oligonucleotide
caguugccuuuuaucccaaaguuguug

SEQ ID NO: 1966 - RNA, 27 nt, Artificial Sequence
  Synthetic oligonucleotide
gccuuuuaucccaaaguuguuguaacc

SEQ ID NO: 1967 - RNA, 27 nt, Artificial Sequence
  Synthetic oligonucleotide
ccuuuuaucccaaaguuguuguaaccu

SEQ ID NO: 1968 - RNA, 27 nt, Artificial Sequence
  Synthetic oligonucleotide
cuuuuaucccaaaguuguuguaaccug

SEQ ID NO: 1969 - RNA, 27 nt, Artificial Sequence
  Synthetic oligonucleotide
ccaaaguuguuguaaccugcugugaua

SEQ ID NO: 1970 - RNA, 27 nt, Artificial Sequence
  Synthetic oligonucleotide
caaaguuguuguaaccugcugugauac

SEQ ID NO: 1971 - RNA, 27 nt, Artificial Sequence
  Synthetic oligonucleotide
aaguuguuguaaccugcugugauacga

SEQ ID NO: 1972 - RNA, 27 nt, Artificial Sequence
  Synthetic oligonucleotide
ugcugugauacgaugcuucaagagaaa

SEQ ID NO: 1973 - RNA, 27 nt, Artificial Sequence
  Synthetic oligonucleotide
gcugugauacgaugcuucaagagaaaa

SEQ ID NO: 1974 - RNA, 27 nt, Artificial Sequence
  Synthetic oligonucleotide
ugugauacgaugcuucaagagaaaaug

SEQ ID NO: 1975 - RNA, 27 nt, Artificial Sequence
  Synthetic oligonucleotide
uucaagagaaaaugcgguuauaaaaaa

SEQ ID NO: 1976 - RNA, 27 nt, Artificial Sequence
  Synthetic oligonucleotide
ucaagagaaaaugcgguuauaaaaaau

SEQ ID NO: 1977 - RNA, 27 nt, Artificial Sequence
  Synthetic oligonucleotide
caagagaaaaugcgguuauaaaaaaug

SEQ ID NO: 1978 - RNA, 27 nt, Artificial Sequence
  Synthetic oligonucleotide
aagagaaaaugcgguuauaaaaaaugg

SEQ ID NO: 1979 - RNA, 27 nt, Artificial Sequence
  Synthetic oligonucleotide
aaaaugcgguuauaaaaaaugguucag

SEQ ID NO: 1980 - RNA, 27 nt, Artificial Sequence
  Synthetic oligonucleotide
gcgguuauaaaaaaugguucagaauua

SEQ ID NO: 1981 - RNA, 27 nt, Artificial Sequence
  Synthetic oligonucleotide
cgguuauaaaaaaugguucagaauuaa

SEQ ID NO: 1982 - RNA, 27 nt, Artificial Sequence
  Synthetic oligonucleotide
gguuauaaaaaaugguucagaauuaaa

SEQ ID NO: 1983 - RNA, 27 nt, Artificial Sequence
  Synthetic oligonucleotide
guuauaaaaaaugguucagaauuaaac

SEQ ID NO: 1984 - RNA, 27 nt, Artificial Sequence
  Synthetic oligonucleotide
uuauaaaaaaugguucagaauuaaacu

SEQ ID NO: 1985 - RNA, 27 nt, Artificial Sequence
  Synthetic oligonucleotide
uauaaaaaaugguucagaauuaaacuu

SEQ ID NO: 1986 - RNA, 27 nt, Artificial Sequence
  Synthetic oligonucleotide
aaaaugguucagaauuaaacuuuuaau

SEQ ID NO: 1987 - RNA, 27 nt, Artificial Sequence
  Synthetic oligonucleotide
aaaugguucagaauuaaacuuuuaauu

SEQ ID NO: 1988 - RNA, 27 nt, Artificial Sequence
  Synthetic oligonucleotide
augguucagaauuaaacuuuuaauuca

SEQ ID NO: 1989 - RNA, 27 nt, Artificial Sequence
  Synthetic oligonucleotide
ccuguaaaucauccuuuagcuguauug

SEQ ID NO: 1990 - RNA, 27 nt, Artificial Sequence
  Synthetic oligonucleotide
cuguaaaucauccuuuagcuguauugu

SEQ ID NO: 1991 - RNA, 27 nt, Artificial Sequence
  Synthetic oligonucleotide
guaaaucauccuuuagcuguauugucu

SEQ ID NO: 1992 - RNA, 27 nt, Artificial Sequence
  Synthetic oligonucleotide
accuguaaaucauccuuuaggaguaac

SEQ ID NO: 1993 - RNA, 27 nt, Artificial Sequence
  Synthetic oligonucleotide
ccuguaaaucauccuuuaggaguaaca

SEQ ID NO: 1994 - RNA, 27 nt, Artificial Sequence
  Synthetic oligonucleotide
cuguaaaucauccuuuaggaguaacaa

SEQ ID NO: 1995 - RNA, 27 nt, Artificial Sequence
  Synthetic oligonucleotide
uguaaaucauccuuuaggaguaacaau

SEQ ID NO: 1996 - RNA, 27 nt, Artificial Sequence
  Synthetic oligonucleotide
agcagucuuacuuggauucuggaaucc

SEQ ID NO: 1997 - RNA, 27 nt, Artificial Sequence
  Synthetic oligonucleotide
cccaaguccuuuaugaaugggagcaag

SEQ ID NO: 1998 - RNA, 27 nt, Artificial Sequence
  Synthetic oligonucleotide
cgcaagagcaaguagcugauauugacg

SEQ ID NO: 1999 - RNA, 27 nt, Artificial Sequence
  Synthetic oligonucleotide
gcaagagcaaguagcugauauugacgg

SEQ ID NO: 2000 - RNA, 27 nt, Artificial Sequence
  Synthetic oligonucleotide
agcaaguagcugauauugacgggcagu

SEQ ID NO: 2001 - RNA, 27 nt, Artificial Sequence
  Synthetic oligonucleotide
ggcugaaccaucacagauguugaaaca

SEQ ID NO: 2002 - RNA, 27 nt, Artificial Sequence
  Synthetic oligonucleotide
gcugaaccaucacagauguugaaacau

SEQ ID NO: 2003 - RNA, 27 nt, Artificial Sequence
  Synthetic oligonucleotide
cacagauguugaaacaugcaguuguca

SEQ ID NO: 2004 - RNA, 27 nt, Artificial Sequence
  Synthetic oligonucleotide
cagauguugaaacaugcaguugucaau

SEQ ID NO: 2005 - RNA, 27 nt, Artificial Sequence
  Synthetic oligonucleotide
uguugaaacaugcaguugucaauuuga

SEQ ID NO: 2006 - RNA, 27 nt, Artificial Sequence
  Synthetic oligonucleotide
aacaugcaguugucaauuugauuaacu

SEQ ID NO: 2007 - RNA, 27 nt, Artificial Sequence
  Synthetic oligonucleotide
caguugucaauuugauuaacuaucagg

SEQ ID NO: 2008 - RNA, 27 nt, Artificial Sequence
  Synthetic oligonucleotide
ucaauuugauuaacuaucaggaugacg

SEQ ID NO: 2009 - RNA, 27 nt, Artificial Sequence
  Synthetic oligonucleotide
caauuugauuaacuaucaggaugacgc

SEQ ID NO: 2010 - RNA, 27 nt, Artificial Sequence
  Synthetic oligonucleotide
agcugacaaaacugcuaaacgaugagg

SEQ ID NO: 2011 - RNA, 27 nt, Artificial Sequence
  Synthetic oligonucleotide
acaaaacugcuaaacgaugaggaccag

SEQ ID NO: 2012 - RNA, 27 nt, Artificial Sequence
  Synthetic oligonucleotide
gugguaguuaauaaagcugcuguuaug

SEQ ID NO: 2013 - RNA, 27 nt, Artificial Sequence
  Synthetic oligonucleotide
ugguaguuaauaaagcugcuguuaugg

SEQ ID NO: 2014 - RNA, 27 nt, Artificial Sequence
  Synthetic oligonucleotide
uaguuaauaaagcugcuguuauggucc

SEQ ID NO: 2015 - RNA, 27 nt, Artificial Sequence
  Synthetic oligonucleotide
aguuaauaaagcugcuguuauggucca

SEQ ID NO: 2016 - RNA, 27 nt, Artificial Sequence
  Synthetic oligonucleotide
ugcagaauacaaaugauguagagacag

SEQ ID NO: 2017 - RNA, 27 nt, Artificial Sequence
  Synthetic oligonucleotide
gcagaauacaaaugauguagagacagc

SEQ ID NO: 2018 - RNA, 27 nt, Artificial Sequence
  Synthetic oligonucleotide
agcugguggacugcagaaaaugguugc

SEQ ID NO: 2019 - RNA, 27 nt, Artificial Sequence
  Synthetic oligonucleotide
cugguggacugcagaaaaugguugcuu

SEQ ID NO: 2020 - RNA, 27 nt, Artificial Sequence
  Synthetic oligonucleotide
aaaugguugcuuugcucaacaaaacaa

SEQ ID NO: 2021 - RNA, 27 nt, Artificial Sequence
  Synthetic oligonucleotide
aaugguugcuuugcucaacaaaacaaa

SEQ ID NO: 2022 - RNA, 27 nt, Artificial Sequence
  Synthetic oligonucleotide
acaaaacaaacgugaaauucuuggcua

SEQ ID NO: 2023 - RNA, 27 nt, Artificial Sequence
  Synthetic oligonucleotide
uucagaucuuagcuuauggcaaucaag

SEQ ID NO: 2024 - RNA, 27 nt, Artificial Sequence
  Synthetic oligonucleotide
aucuuagcuuauggcaaucaagagagc

SEQ ID NO: 2025 - RNA, 27 nt, Artificial Sequence
  Synthetic oligonucleotide
auaaugaggaccuacacuuaugagaag

SEQ ID NO: 2026 - RNA, 27 nt, Artificial Sequence
  Synthetic oligonucleotide
uaaugaggaccuacacuuaugagaagc

SEQ ID NO: 2027 - RNA, 27 nt, Artificial Sequence
  Synthetic oligonucleotide
augaggaccuacacuuaugagaagcuu

SEQ ID NO: 2028 - RNA, 27 nt, Artificial Sequence
  Synthetic oligonucleotide
ugaggaccuacacuuaugagaagcuuc

SEQ ID NO: 2029 - RNA, 27 nt, Artificial Sequence
  Synthetic oligonucleotide
gacuuguucaaaacugucuuuggacuc

SEQ ID NO: 2030 - RNA, 27 nt, Artificial Sequence
  Synthetic oligonucleotide
acuuguucaaaacugucuuuggacucu

SEQ ID NO: 2031 - RNA, 27 nt, Artificial Sequence
  Synthetic oligonucleotide
uucuggguuccgaugauauaaaugugg

SEQ ID NO: 2032 - RNA, 27 nt, Artificial Sequence
  Synthetic oligonucleotide
uggguuccgaugauauaaaugugguca

SEQ ID NO: 2033 - RNA, 27 nt, Artificial Sequence
  Synthetic oligonucleotide
augauauaaauguggucaccugugcag

SEQ ID NO: 2034 - RNA, 27 nt, Artificial Sequence
  Synthetic oligonucleotide
ugauauaaauguggucaccugugcagc

SEQ ID NO: 2035 - RNA, 27 nt, Artificial Sequence
  Synthetic oligonucleotide
cucuaaccucacuugcaauaauuacaa

SEQ ID NO: 2036 - RNA, 27 nt, Artificial Sequence
  Synthetic oligonucleotide
ugcaauaauuacaaaaacaagaugaug

SEQ ID NO: 2037 - RNA, 27 nt, Artificial Sequence
  Synthetic oligonucleotide
gcaauaauuacaaaaacaagaugaugg

SEQ ID NO: 2038 - RNA, 27 nt, Artificial Sequence
  Synthetic oligonucleotide
auaauuacaaaaacaagaugauggugu

SEQ ID NO: 2039 - RNA, 27 nt, Artificial Sequence
  Synthetic oligonucleotide
uacaaaaacaagaugauggugugccaa

SEQ ID NO: 2040 - RNA, 27 nt, Artificial Sequence
  Synthetic oligonucleotide
cucugauaaaggcaacuguuggauuga

SEQ ID NO: 2041 - RNA, 27 nt, Artificial Sequence
  Synthetic oligonucleotide
auaaaggcaacuguuggauugauucga

SEQ ID NO: 2042 - RNA, 27 nt, Artificial Sequence
  Synthetic oligonucleotide
agggugcuauuccacgacuaguucagc

SEQ ID NO: 2043 - RNA, 27 nt, Artificial Sequence
  Synthetic oligonucleotide
auggaggagauaguagaaggguguacu

SEQ ID NO: 2044 - RNA, 27 nt, Artificial Sequence
  Synthetic oligonucleotide
uggaggagauaguagaaggguguacug

SEQ ID NO: 2045 - RNA, 27 nt, Artificial Sequence
  Synthetic oligonucleotide
ggaggagauaguagaaggguguacugg

SEQ ID NO: 2046 - RNA, 27 nt, Artificial Sequence
  Synthetic oligonucleotide
agauaguagaaggguguacuggagcuc

SEQ ID NO: 2047 - RNA, 27 nt, Artificial Sequence
  Synthetic oligonucleotide
cgaggacucaauaccauuccauuguuu

SEQ ID NO: 2048 - RNA, 27 nt, Artificial Sequence
  Synthetic oligonucleotide
cucaauaccauuccauuguuugugcag

SEQ ID NO: 2049 - RNA, 27 nt, Artificial Sequence
  Synthetic oligonucleotide
ucaauaccauuccauuguuugugcagu

SEQ ID NO: 2050 - RNA, 27 nt, Artificial Sequence
  Synthetic oligonucleotide
accauuccauuguuugugcaguugcuu

SEQ ID NO: 2051 - RNA, 27 nt, Artificial Sequence
  Synthetic oligonucleotide
cauuguuugugcaguugcuuuauucuc

SEQ ID NO: 2052 - RNA, 27 nt, Artificial Sequence
  Synthetic oligonucleotide
ugcaguugcuuuauucucccauugaaa

SEQ ID NO: 2053 - RNA, 27 nt, Artificial Sequence
  Synthetic oligonucleotide
gcaguugcuuuauucucccauugaaaa

SEQ ID NO: 2054 - RNA, 27 nt, Artificial Sequence
  Synthetic oligonucleotide
caguugcuuuauucucccauugaaaau

SEQ ID NO: 2055 - RNA, 27 nt, Artificial Sequence
  Synthetic oligonucleotide
ugcuuuauucucccauugaaaauaucc

SEQ ID NO: 2056 - RNA, 27 nt, Artificial Sequence
  Synthetic oligonucleotide
gcuuuauucucccauugaaaauaucca

SEQ ID NO: 2057 - RNA, 27 nt, Artificial Sequence
  Synthetic oligonucleotide
cuuuauucucccauugaaaauauccaa

SEQ ID NO: 2058 - RNA, 27 nt, Artificial Sequence
  Synthetic oligonucleotide
ccauugaaaauauccaaagaguagcug

SEQ ID NO: 2059 - RNA, 27 nt, Artificial Sequence
  Synthetic oligonucleotide
cauugaaaauauccaaagaguagcugc

SEQ ID NO: 2060 - RNA, 27 nt, Artificial Sequence
  Synthetic oligonucleotide
gacaagccacaggauuacaagaagcgg

SEQ ID NO: 2061 - RNA, 27 nt, Artificial Sequence
  Synthetic oligonucleotide
ggaaugagacugcagaucuuggacugg

SEQ ID NO: 2062 - RNA, 27 nt, Artificial Sequence
  Synthetic oligonucleotide
accguucuuuucacucugguggauacg

SEQ ID NO: 2063 - RNA, 27 nt, Artificial Sequence
  Synthetic oligonucleotide
cccaggugauagcaaucagcuggccug

SEQ ID NO: 2064 - RNA, 27 nt, Artificial Sequence
  Synthetic oligonucleotide
ccugguuugauacugaccuguaaaucg

SEQ ID NO: 2065 - RNA, 27 nt, Artificial Sequence
  Synthetic oligonucleotide
cugguuugauacugaccuguaaaucgu

SEQ ID NO: 2066 - RNA, 27 nt, Artificial Sequence
  Synthetic oligonucleotide
ccuguaaaucguccuuuagguaagaaa

SEQ ID NO: 2067 - RNA, 27 nt, Artificial Sequence
  Synthetic oligonucleotide
uguaaaucguccuuuagguaagaaagc

SEQ ID NO: 2068 - RNA, 27 nt, Artificial Sequence
  Synthetic oligonucleotide
uccuuuagguaagaaagcuuauaaaag

SEQ ID NO: 2069 - RNA, 27 nt, Artificial Sequence
  Synthetic oligonucleotide
ccuuuagguaagaaagcuuauaaaagc

SEQ ID NO: 2070 - RNA, 27 nt, Artificial Sequence
  Synthetic oligonucleotide
uuagguaagaaagcuuauaaaagccag

SEQ ID NO: 2071 - RNA, 27 nt, Artificial Sequence
  Synthetic oligonucleotide
uaagaaagcuuauaaaagccagugugg

SEQ ID NO: 2072 - RNA, 27 nt, Artificial Sequence
  Synthetic oligonucleotide
agcuuauaaaagccagugugggugaau

SEQ ID NO: 2073 - RNA, 27 nt, Artificial Sequence
  Synthetic oligonucleotide
ugcagaacuccagaaagacuugguagg

SEQ ID NO: 2074 - RNA, 27 nt, Artificial Sequence
  Synthetic oligonucleotide
ggaaugguuuuaggccuguuuguaaau

SEQ ID NO: 2075 - RNA, 27 nt, Artificial Sequence
  Synthetic oligonucleotide
gaaugguuuuaggccuguuuguaaauc

SEQ ID NO: 2076 - RNA, 27 nt, Artificial Sequence
  Synthetic oligonucleotide
aaugguuuuaggccuguuuguaaaucu

SEQ ID NO: 2077 - RNA, 27 nt, Artificial Sequence
  Synthetic oligonucleotide
aacagauacauaccuuggaaggagaug

SEQ ID NO: 2078 - RNA, 27 nt, Artificial Sequence
  Synthetic oligonucleotide
acagauacauaccuuggaaggagaugu

SEQ ID NO: 2079 - RNA, 27 nt, Artificial Sequence
  Synthetic oligonucleotide
uggaaggagauguucauguguggaagu

SEQ ID NO: 2080 - RNA, 27 nt, Artificial Sequence
  Synthetic oligonucleotide
aaggagauguucauguguggaaguuuc

SEQ ID NO: 2081 - RNA, 27 nt, Artificial Sequence
  Synthetic oligonucleotide
aggagauguucauguguggaaguuucu

SEQ ID NO: 2082 - RNA, 27 nt, Artificial Sequence
  Synthetic oligonucleotide
ggagauguucauguguggaaguuucuc

SEQ ID NO: 2083 - RNA, 27 nt, Artificial Sequence
  Synthetic oligonucleotide
gagauguucauguguggaaguuucuca

SEQ ID NO: 2084 - RNA, 27 nt, Artificial Sequence
  Synthetic oligonucleotide
cauguguggaaguuucucacguugaug

SEQ ID NO: 2085 - RNA, 27 nt, Artificial Sequence
  Synthetic oligonucleotide
guguggaaguuucucacguugauguuu

SEQ ID NO: 2086 - RNA, 27 nt, Artificial Sequence
  Synthetic oligonucleotide
uguggaaguuucucacguugauguuuu

SEQ ID NO: 2087 - RNA, 27 nt, Artificial Sequence
  Synthetic oligonucleotide
guggaaguuucucacguugauguuuuu

SEQ ID NO: 2088 - RNA, 27 nt, Artificial Sequence
  Synthetic oligonucleotide
uggaaguuucucacguugauguuuuug

SEQ ID NO: 2089 - RNA, 27 nt, Artificial Sequence
  Synthetic oligonucleotide
ggaaguuucucacguugauguuuuugc

SEQ ID NO: 2090 - RNA, 27 nt, Artificial Sequence
  Synthetic oligonucleotide
aaguuucucacguugauguuuuugcca

SEQ ID NO: 2091 - RNA, 27 nt, Artificial Sequence
  Synthetic oligonucleotide
uugauguuuuugccacagcuuuugcag

SEQ ID NO: 2092 - RNA, 27 nt, Artificial Sequence
  Synthetic oligonucleotide
ugauguuuuugccacagcuuuugcagc

SEQ ID NO: 2093 - RNA, 27 nt, Artificial Sequence
  Synthetic oligonucleotide
cuuuugcagcguuauacucagaugagu

SEQ ID NO: 2094 - RNA, 27 nt, Artificial Sequence
  Synthetic oligonucleotide
ucagaugaguaacauuugcuguuuuca

SEQ ID NO: 2095 - RNA, 27 nt, Artificial Sequence
  Synthetic oligonucleotide
cagaugaguaacauuugcuguuuucaa

SEQ ID NO: 2096 - RNA, 27 nt, Artificial Sequence
  Synthetic oligonucleotide
agaugaguaacauuugcuguuuucaac

SEQ ID NO: 2097 - RNA, 27 nt, Artificial Sequence
  Synthetic oligonucleotide
aacauuugcuguuuucaacauuaauag

SEQ ID NO: 2098 - RNA, 27 nt, Artificial Sequence
  Synthetic oligonucleotide
gccuuucucucuauacagcuguagugu

SEQ ID NO: 2099 - RNA, 27 nt, Artificial Sequence
  Synthetic oligonucleotide
gucugaacgugcauugugauuggccug

SEQ ID NO: 2100 - RNA, 27 nt, Artificial Sequence
  Synthetic oligonucleotide
accaagcugaguuuccuaugggaacag

SEQ ID NO: 2101 - RNA, 27 nt, Artificial Sequence
  Synthetic oligonucleotide
aacagucgaaguacgcuuuuuguucug

SEQ ID NO: 2102 - RNA, 27 nt, Artificial Sequence
  Synthetic oligonucleotide
cgaaguacgcuuuuuguucugguccuu

SEQ ID NO: 2103 - RNA, 27 nt, Artificial Sequence
  Synthetic oligonucleotide
gcuuuuuguucugguccuuuuuggucg

SEQ ID NO: 2104 - RNA, 27 nt, Artificial Sequence
  Synthetic oligonucleotide
cuuuuuguucugguccuuuuuggucga

SEQ ID NO: 2105 - RNA, 27 nt, Artificial Sequence
  Synthetic oligonucleotide
uucugguccuuuuuggucgaggaguaa

SEQ ID NO: 2106 - RNA, 27 nt, Artificial Sequence
  Synthetic oligonucleotide
gucgaggaguaacaauacaaauggauu

SEQ ID NO: 2107 - RNA, 27 nt, Artificial Sequence
  Synthetic oligonucleotide
ucgaggaguaacaauacaaauggauuu

SEQ ID NO: 2108 - RNA, 27 nt, Artificial Sequence
  Synthetic oligonucleotide
cgaggaguaacaauacaaauggauuug

SEQ ID NO: 2109 - RNA, 27 nt, Artificial Sequence
  Synthetic oligonucleotide
gaggaguaacaauacaaauggauuugg

SEQ ID NO: 2110 - RNA, 27 nt, Artificial Sequence
  Synthetic oligonucleotide
aacaauacaaauggauuuggggaguga

SEQ ID NO: 2111 - RNA, 27 nt, Artificial Sequence
  Synthetic oligonucleotide
gcagugaagaaugcacacgaauggauc

SEQ ID NO: 2112 - RNA, 27 nt, Artificial Sequence
  Synthetic oligonucleotide
cagugaagaaugcacacgaauggauca

SEQ ID NO: 2113 - RNA, 27 nt, Artificial Sequence
  Synthetic oligonucleotide
agugaagaaugcacacgaauggaucac

SEQ ID NO: 2114 - RNA, 27 nt, Artificial Sequence
  Synthetic oligonucleotide
cccuagccuugcuuguucuuuguuuua

SEQ ID NO: 2115 - RNA, 27 nt, Artificial Sequence
  Synthetic oligonucleotide
ucuuuguuuuaauaucuguaguggugc

SEQ ID NO: 2116 - RNA, 27 nt, Artificial Sequence
  Synthetic oligonucleotide
uuuguuuuaauaucuguaguggugcug

SEQ ID NO: 2117 - RNA, 27 nt, Artificial Sequence
  Synthetic oligonucleotide
uuguuuuaauaucuguaguggugcuga

SEQ ID NO: 2118 - RNA, 27 nt, Artificial Sequence
  Synthetic oligonucleotide
ugcugacuuugcuugcuuuuauuuuuu

SEQ ID NO: 2119 - RNA, 27 nt, Artificial Sequence
  Synthetic oligonucleotide
gacuuugcuugcuuuuauuuuuugcag

SEQ ID NO: 2120 - RNA, 27 nt, Artificial Sequence
  Synthetic oligonucleotide
ugcuugcuuuuauuuuuugcaguaacu

SEQ ID NO: 2121 - RNA, 27 nt, Artificial Sequence
  Synthetic oligonucleotide
cuuuuauuuuuugcaguaacuguuagu

SEQ ID NO: 2122 - RNA, 27 nt, Artificial Sequence
  Synthetic oligonucleotide
uuuauuuuuugcaguaacuguuaguuu

SEQ ID NO: 2123 - RNA, 27 nt, Artificial Sequence
  Synthetic oligonucleotide
uauuuuuugcaguaacuguuaguuuuu

SEQ ID NO: 2124 - RNA, 27 nt, Artificial Sequence
  Synthetic oligonucleotide
auuuuuugcaguaacuguuaguuuuua

SEQ ID NO: 2125 - RNA, 27 nt, Artificial Sequence
  Synthetic oligonucleotide
uuuuugcaguaacuguuaguuuuuaag

SEQ ID NO: 2126 - RNA, 27 nt, Artificial Sequence
  Synthetic oligonucleotide
ugcaguaacuguuaguuuuuaaguagu

SEQ ID NO: 2127 - RNA, 27 nt, Artificial Sequence
  Synthetic oligonucleotide
caguaacuguuaguuuuuaaguagugu

SEQ ID NO: 2128 - RNA, 27 nt, Artificial Sequence
  Synthetic oligonucleotide
aacuguuaguuuuuaaguaguguuaug

SEQ ID NO: 2129 - RNA, 27 nt, Artificial Sequence
  Synthetic oligonucleotide
acuguuaguuuuuaaguaguguuaugu

SEQ ID NO: 2130 - RNA, 27 nt, Artificial Sequence
  Synthetic oligonucleotide
uguuaguuuuuaaguaguguuauguuc

SEQ ID NO: 2131 - RNA, 27 nt, Artificial Sequence
  Synthetic oligonucleotide
guuaguuuuuaaguaguguuauguucu

SEQ ID NO: 2132 - RNA, 27 nt, Artificial Sequence
  Synthetic oligonucleotide
uuaguuuuuaaguaguguuauguucua

SEQ ID NO: 2133 - RNA, 27 nt, Artificial Sequence
  Synthetic oligonucleotide
uaguuuuuaaguaguguuauguucuag

SEQ ID NO: 2134 - RNA, 27 nt, Artificial Sequence
  Synthetic oligonucleotide
uuuaaguaguguuauguucuagugaac

SEQ ID NO: 2135 - RNA, 27 nt, Artificial Sequence
  Synthetic oligonucleotide
uaaguaguguuauguucuagugaaccu

SEQ ID NO: 2136 - RNA, 27 nt, Artificial Sequence
  Synthetic oligonucleotide
aaguaguguuauguucuagugaaccug

SEQ ID NO: 2137 - RNA, 27 nt, Artificial Sequence
  Synthetic oligonucleotide
uucugauuucuaagaaccgaguaaugg

SEQ ID NO: 2138 - RNA, 27 nt, Artificial Sequence
  Synthetic oligonucleotide
ugauuucuaagaaccgaguaauggugu

SEQ ID NO: 2139 - RNA, 27 nt, Artificial Sequence
  Synthetic oligonucleotide
ucuaagaaccgaguaaugguguagaac

SEQ ID NO: 2140 - RNA, 27 nt, Artificial Sequence
  Synthetic oligonucleotide
gaguaaugguguagaacacuaauucau

SEQ ID NO: 2141 - RNA, 27 nt, Artificial Sequence
  Synthetic oligonucleotide
augguguagaacacuaauucauaauca

SEQ ID NO: 2142 - RNA, 27 nt, Artificial Sequence
  Synthetic oligonucleotide
ugguguagaacacuaauucauaaucac

SEQ ID NO: 2143 - RNA, 27 nt, Artificial Sequence
  Synthetic oligonucleotide
gguguagaacacuaauucauaaucacg

SEQ ID NO: 2144 - RNA, 27 nt, Artificial Sequence
  Synthetic oligonucleotide
acuaauucauaaucacgcuaauuguaa

SEQ ID NO: 2145 - RNA, 27 nt, Artificial Sequence
  Synthetic oligonucleotide
cuaauucauaaucacgcuaauuguaau

SEQ ID NO: 2146 - RNA, 27 nt, Artificial Sequence
  Synthetic oligonucleotide
uucauaaucacgcuaauuguaaucugg

SEQ ID NO: 2147 - RNA, 27 nt, Artificial Sequence
  Synthetic oligonucleotide
gcuaauuguaaucuggagacguguaac

SEQ ID NO: 2148 - RNA, 27 nt, Artificial Sequence
  Synthetic oligonucleotide
uaauuguaaucuggagacguguaacau

SEQ ID NO: 2149 - RNA, 27 nt, Artificial Sequence
  Synthetic oligonucleotide
aucuggagacguguaacauuguguagc

SEQ ID NO: 2150 - RNA, 27 nt, Artificial Sequence
  Synthetic oligonucleotide
cuggagacguguaacauuguguagccu

SEQ ID NO: 2151 - RNA, 27 nt, Artificial Sequence
  Synthetic oligonucleotide
cguguaacauuguguagccuuuuguau

SEQ ID NO: 2152 - RNA, 27 nt, Artificial Sequence
  Synthetic oligonucleotide
guguaacauuguguagccuuuuguaua

SEQ ID NO: 2153 - RNA, 27 nt, Artificial Sequence
  Synthetic oligonucleotide
aacauuguguagccuuuuguauaaaua

SEQ ID NO: 2154 - RNA, 27 nt, Artificial Sequence
  Synthetic oligonucleotide
acauuguguagccuuuuguauaaauag

SEQ ID NO: 2155 - RNA, 27 nt, Artificial Sequence
  Synthetic oligonucleotide
uuguguagccuuuuguauaaauagaca

SEQ ID NO: 2156 - RNA, 27 nt, Artificial Sequence
  Synthetic oligonucleotide
uguguagccuuuuguauaaauagacag

SEQ ID NO: 2157 - RNA, 27 nt, Artificial Sequence
  Synthetic oligonucleotide
guguagccuuuuguauaaauagacaga

SEQ ID NO: 2158 - RNA, 27 nt, Artificial Sequence
  Synthetic oligonucleotide
ccuuuuguauaaauagacagauagaaa

SEQ ID NO: 2159 - RNA, 27 nt, Artificial Sequence
  Synthetic oligonucleotide
cuuuuguauaaauagacagauagaaau

SEQ ID NO: 2160 - RNA, 27 nt, Artificial Sequence
  Synthetic oligonucleotide
uuuuguauaaauagacagauagaaaug

SEQ ID NO: 2161 - RNA, 27 nt, Artificial Sequence
  Synthetic oligonucleotide
uuuguauaaauagacagauagaaaugg

SEQ ID NO: 2162 - RNA, 27 nt, Artificial Sequence
  Synthetic oligonucleotide
uauaaauagacagauagaaaugguccg

SEQ ID NO: 2163 - RNA, 27 nt, Artificial Sequence
  Synthetic oligonucleotide
auaaauagacagauagaaaugguccga

SEQ ID NO: 2164 - RNA, 27 nt, Artificial Sequence
  Synthetic oligonucleotide
gacagauagaaaugguccgauuaguuu

SEQ ID NO: 2165 - RNA, 27 nt, Artificial Sequence
  Synthetic oligonucleotide
acagauagaaaugguccgauuaguuuc

SEQ ID NO: 2166 - RNA, 27 nt, Artificial Sequence
  Synthetic oligonucleotide
cagauagaaaugguccgauuaguuucc

SEQ ID NO: 2167 - RNA, 27 nt, Artificial Sequence
  Synthetic oligonucleotide
agauagaaaugguccgauuaguuuccu

SEQ ID NO: 2168 - RNA, 27 nt, Artificial Sequence
  Synthetic oligonucleotide
aaugguccgauuaguuuccuuuuuaau

SEQ ID NO: 2169 - RNA, 27 nt, Artificial Sequence
  Synthetic oligonucleotide
ccgauuaguuuccuuuuuaauaugcuu

SEQ ID NO: 2170 - RNA, 27 nt, Artificial Sequence
  Synthetic oligonucleotide
cgauuaguuuccuuuuuaauaugcuua

SEQ ID NO: 2171 - RNA, 27 nt, Artificial Sequence
  Synthetic oligonucleotide
uaguuuccuuuuuaauaugcuuaaaau

SEQ ID NO: 2172 - RNA, 27 nt, Artificial Sequence
  Synthetic oligonucleotide
ccuuuuuaauaugcuuaaaauaagcag

SEQ ID NO: 2173 - RNA, 27 nt, Artificial Sequence
  Synthetic oligonucleotide
cuuuuuaauaugcuuaaaauaagcagg

SEQ ID NO: 2174 - RNA, 27 nt, Artificial Sequence
  Synthetic oligonucleotide
aauaugcuuaaaauaagcagguggauc

SEQ ID NO: 2175 - RNA, 27 nt, Artificial Sequence
  Synthetic oligonucleotide
agcagguggaucuauuucauguuuuug

SEQ ID NO: 2176 - RNA, 27 nt, Artificial Sequence
  Synthetic oligonucleotide
gcagguggaucuauuucauguuuuuga

SEQ ID NO: 2177 - RNA, 27 nt, Artificial Sequence
  Synthetic oligonucleotide
agguggaucuauuucauguuuuugaac

SEQ ID NO: 2178 - RNA, 27 nt, Artificial Sequence
  Synthetic oligonucleotide
gguggaucuauuucauguuuuugaaca

SEQ ID NO: 2179 - RNA, 27 nt, Artificial Sequence
  Synthetic oligonucleotide
guggaucuauuucauguuuuugaacaa

SEQ ID NO: 2180 - RNA, 27 nt, Artificial Sequence
  Synthetic oligonucleotide
ucuauuucauguuuuugaacaaaaacu

SEQ ID NO: 2181 - RNA, 27 nt, Artificial Sequence
  Synthetic oligonucleotide
ucauguuuuugaacaaaaacuuuaucg

SEQ ID NO: 2182 - RNA, 27 nt, Artificial Sequence
  Synthetic oligonucleotide
uuuugaacaaaaacuuuaucggggaua

SEQ ID NO: 2183 - RNA, 27 nt, Artificial Sequence
  Synthetic oligonucleotide
uuugaacaaaaacuuuaucggggauac

SEQ ID NO: 2184 - RNA, 27 nt, Artificial Sequence
  Synthetic oligonucleotide
gcgguaggguaaaucaguaagaggugu

SEQ ID NO: 2185 - RNA, 27 nt, Artificial Sequence
  Synthetic oligonucleotide
gguaggguaaaucaguaagagguguua

SEQ ID NO: 2186 - RNA, 27 nt, Artificial Sequence
  Synthetic oligonucleotide
guaggguaaaucaguaagagguguuau

SEQ ID NO: 2187 - RNA, 27 nt, Artificial Sequence
  Synthetic oligonucleotide
uaggguaaaucaguaagagguguuauu

SEQ ID NO: 2188 - RNA, 27 nt, Artificial Sequence
  Synthetic oligonucleotide
aggguaaaucaguaagagguguuauuu

SEQ ID NO: 2189 - RNA, 27 nt, Artificial Sequence
  Synthetic oligonucleotide
ggguaaaucaguaagagguguuauuug

SEQ ID NO: 2190 - RNA, 27 nt, Artificial Sequence
  Synthetic oligonucleotide
aucaguaagagguguuauuugagccuu

SEQ ID NO: 2191 - RNA, 27 nt, Artificial Sequence
  Synthetic oligonucleotide
uaagagguguuauuugagccuuguuuu

SEQ ID NO: 2192 - RNA, 27 nt, Artificial Sequence
  Synthetic oligonucleotide
aagagguguuauuugagccuuguuuug

SEQ ID NO: 2193 - RNA, 27 nt, Artificial Sequence
  Synthetic oligonucleotide
agagguguuauuugagccuuguuuugg

SEQ ID NO: 2194 - RNA, 27 nt, Artificial Sequence
  Synthetic oligonucleotide
gguguuauuugagccuuguuuuggaca

SEQ ID NO: 2195 - RNA, 27 nt, Artificial Sequence
  Synthetic oligonucleotide
uguuauuugagccuuguuuuggacagu

SEQ ID NO: 2196 - RNA, 27 nt, Artificial Sequence
  Synthetic oligonucleotide
uuugagccuuguuuuggacaguauacc

SEQ ID NO: 2197 - RNA, 27 nt, Artificial Sequence
  Synthetic oligonucleotide
uuguuuuggacaguauaccaguugccu

SEQ ID NO: 2198 - RNA, 27 nt, Artificial Sequence
  Synthetic oligonucleotide
gacaguauaccaguugccuuuuauccc

SEQ ID NO: 2199 - RNA, 27 nt, Artificial Sequence
  Synthetic oligonucleotide
acaguauaccaguugccuuuuauccca

SEQ ID NO: 2200 - RNA, 27 nt, Artificial Sequence
  Synthetic oligonucleotide
accaguugccuuuuaucccaaaguugu

SEQ ID NO: 2201 - RNA, 27 nt, Artificial Sequence
  Synthetic oligonucleotide
caguugccuuuuaucccaaaguuguug

SEQ ID NO: 2202 - RNA, 27 nt, Artificial Sequence
  Synthetic oligonucleotide
gccuuuuaucccaaaguuguuguaacc

SEQ ID NO: 2203 - RNA, 27 nt, Artificial Sequence
  Synthetic oligonucleotide
ccuuuuaucccaaaguuguuguaaccu

SEQ ID NO: 2204 - RNA, 27 nt, Artificial Sequence
  Synthetic oligonucleotide
cuuuuaucccaaaguuguuguaaccug

SEQ ID NO: 2205 - RNA, 27 nt, Artificial Sequence
  Synthetic oligonucleotide
ccaaaguuguuguaaccugcugugaua

SEQ ID NO: 2206 - RNA, 27 nt, Artificial Sequence
  Synthetic oligonucleotide
caaaguuguuguaaccugcugugauac

SEQ ID NO: 2207 - RNA, 27 nt, Artificial Sequence
  Synthetic oligonucleotide
aaguuguuguaaccugcugugauacaa

SEQ ID NO: 2208 - RNA, 27 nt, Artificial Sequence
  Synthetic oligonucleotide
ugugauacaaugcuucaacagaugcgg

SEQ ID NO: 2209 - RNA, 27 nt, Artificial Sequence
  Synthetic oligonucleotide
cagaugcgguuauagaaaugguucaga

SEQ ID NO: 2210 - RNA, 27 nt, Artificial Sequence
  Synthetic oligonucleotide
ugcgguuauagaaaugguucagaauua

SEQ ID NO: 2211 - RNA, 27 nt, Artificial Sequence
  Synthetic oligonucleotide
cgguuauagaaaugguucagaauuaaa

SEQ ID NO: 2212 - RNA, 27 nt, Artificial Sequence
  Synthetic oligonucleotide
gguuauagaaaugguucagaauuaaac

SEQ ID NO: 2213 - RNA, 27 nt, Artificial Sequence
  Synthetic oligonucleotide
guuauagaaaugguucagaauuaaacu

SEQ ID NO: 2214 - RNA, 27 nt, Artificial Sequence
  Synthetic oligonucleotide
uuauagaaaugguucagaauuaaacuu

SEQ ID NO: 2215 - RNA, 27 nt, Artificial Sequence
  Synthetic oligonucleotide
gaaaugguucagaauuaaacuuuuaau

SEQ ID NO: 2216 - RNA, 27 nt, Artificial Sequence
  Synthetic oligonucleotide
aaaugguucagaauuaaacuuuuaauu

SEQ ID NO: 2217 - RNA, 27 nt, Artificial Sequence
  Synthetic oligonucleotide
augguucagaauuaaacuuuuaauuca

SEQ ID NO: 2218 - RNA, 27 nt, Artificial Sequence
  Synthetic oligonucleotide
cagaauuaaacuuuuaauucauucaaa

SEQ ID NO: 2219 - RNA, 27 nt, Artificial Sequence
  Synthetic oligonucleotide
auuaaacuuuuaauucauucaaaaaaa

SEQ ID NO: 2220 - RNA, 27 nt, Artificial Sequence
  Synthetic oligonucleotide
aacuuuuaauucauucaaaaaaaaaaa

SEQ ID NO: 2221 - RNA, 27 nt, Artificial Sequence
  Synthetic oligonucleotide
acuuuuaauucauucaaaaaaaaaaaa

SEQ ID NO: 2222 - RNA, 27 nt, Artificial Sequence
  Synthetic oligonucleotide
cuuuuaauucauucaaaaaaaaaaaaa

SEQ ID NO: 2223 - RNA, 27 nt, Artificial Sequence
  Synthetic oligonucleotide
uuuuaauucauucaaaaaaaaaaaaaa

SEQ ID NO: 2224 - RNA, 27 nt, Artificial Sequence
  Synthetic oligonucleotide
uuuaauucauucaaaaaaaaaaaaaaa

SEQ ID NO: 2225 - RNA, 27 nt, Artificial Sequence
  Synthetic oligonucleotide
uuaauucauucaaaaaaaaaaaaaaaa

SEQ ID NO: 2226 - DNA, 27 bp, Artificial Sequence
  Synthetic oligonucleotide
ccctgagggtatttgaagtataccata

SEQ ID NO: 2227 - DNA, 27 bp, Artificial Sequence
  Synthetic oligonucleotide
gagggtatttgaagtataccatacaac

SEQ ID NO: 2228 - DNA, 27 bp, Artificial Sequence
  Synthetic oligonucleotide
tgaagtataccatacaactgttttgaa

SEQ ID NO: 2229 - DNA, 27 bp, Artificial Sequence
  Synthetic oligonucleotide
ataccatacaactgttttgaaaatcca

SEQ ID NO: 2230 - DNA, 27 bp, Artificial Sequence
  Synthetic oligonucleotide
atacaactgttttgaaaatccagcgtg

SEQ ID NO: 2231 - DNA, 27 bp, Artificial Sequence
  Synthetic oligonucleotide
cagggattttctcagtccttcactcaa

SEQ ID NO: 2232 - DNA, 27 bp, Artificial Sequence
  Synthetic oligonucleotide
cactcaagaacaagtagctgatattga

SEQ ID NO: 2233 - DNA, 27 bp, Artificial Sequence
  Synthetic oligonucleotide
agaacaagtagctgatattgatggaca

SEQ ID NO: 2234 - DNA, 27 bp, Artificial Sequence
  Synthetic oligonucleotide
aacaagtagctgatattgatggacagt

SEQ ID NO: 2235 - DNA, 27 bp, Artificial Sequence
  Synthetic oligonucleotide
tgatggacagtatgcaatgactcgagc

SEQ ID NO: 2236 - DNA, 27 bp, Artificial Sequence
  Synthetic oligonucleotide
tgctatgttccctgagacattagatga

SEQ ID NO: 2237 - DNA, 27 bp, Artificial Sequence
  Synthetic oligonucleotide
tgctgaaacatgcagttgtaaacttga

SEQ ID NO: 2238 - DNA, 27 bp, Artificial Sequence
  Synthetic oligonucleotide
aacatgcagttgtaaacttgattaact

SEQ ID NO: 2239 - DNA, 27 bp, Artificial Sequence
  Synthetic oligonucleotide
gcagttgtaaacttgattaactatcaa

SEQ ID NO: 2240 - DNA, 27 bp, Artificial Sequence
  Synthetic oligonucleotide
acttgattaactatcaagatgatgcag

SEQ ID NO: 2241 - DNA, 27 bp, Artificial Sequence
  Synthetic oligonucleotide
ccctgaactgacaaaactgctaaatga

SEQ ID NO: 2242 - DNA, 27 bp, Artificial Sequence
  Synthetic oligonucleotide
tcagatggtgtctgctattgtacgtac

SEQ ID NO: 2243 - DNA, 27 bp, Artificial Sequence
  Synthetic oligonucleotide
gtacgtaccatgcagaatacaaatgat

SEQ ID NO: 2244 - DNA, 27 bp, Artificial Sequence
  Synthetic oligonucleotide
attacaactctccacaaccttttatta

SEQ ID NO: 2245 - DNA, 27 bp, Artificial Sequence
  Synthetic oligonucleotide
aactctccacaaccttttattacatca

SEQ ID NO: 2246 - DNA, 27 bp, Artificial Sequence
  Synthetic oligonucleotide
tccacaaccttttattacatcaagaag

SEQ ID NO: 2247 - DNA, 27 bp, Artificial Sequence
  Synthetic oligonucleotide
accttttattacatcaagaaggagcta

SEQ ID NO: 2248 - DNA, 27 bp, Artificial Sequence
  Synthetic oligonucleotide
acaaaacaaatgttaaattcttggcta

SEQ ID NO: 2249 - DNA, 27 bp, Artificial Sequence
  Synthetic oligonucleotide
attacgacagactgccttcaaatttta

SEQ ID NO: 2250 - DNA, 27 bp, Artificial Sequence
  Synthetic oligonucleotide
gacagactgccttcaaattttagctta

SEQ ID NO: 2251 - DNA, 27 bp, Artificial Sequence
  Synthetic oligonucleotide
agctttagtaaatataatgaggaccta

SEQ ID NO: 2252 - DNA, 27 bp, Artificial Sequence
  Synthetic oligonucleotide
gaaaaactactgtggaccacaagcaga

SEQ ID NO: 2253 - DNA, 27 bp, Artificial Sequence
  Synthetic oligonucleotide
caagtcaacgtcttgttcagaactgtc

SEQ ID NO: 2254 - DNA, 27 bp, Artificial Sequence
  Synthetic oligonucleotide
aacgtcttgttcagaactgtctttgga

SEQ ID NO: 2255 - DNA, 27 bp, Artificial Sequence
  Synthetic oligonucleotide
cttgttcagaactgtctttggactctc

SEQ ID NO: 2256 - DNA, 27 bp, Artificial Sequence
  Synthetic oligonucleotide
tgggttcagatgatataaatgtggtca

SEQ ID NO: 2257 - DNA, 27 bp, Artificial Sequence
  Synthetic oligonucleotide
attctttctaacctcacttgcaataat

SEQ ID NO: 2258 - DNA, 27 bp, Artificial Sequence
  Synthetic oligonucleotide
acctcacttgcaataattataagaaca

SEQ ID NO: 2259 - DNA, 27 bp, Artificial Sequence
  Synthetic oligonucleotide
tgcaataattataagaacaagatgatg

SEQ ID NO: 2260 - DNA, 27 bp, Artificial Sequence
  Synthetic oligonucleotide
tggtatagaggctcttgtgcgtactgt

SEQ ID NO: 2261 - DNA, 27 bp, Artificial Sequence
  Synthetic oligonucleotide
aaggctactgttggattgattcgaaat

SEQ ID NO: 2262 - DNA, 27 bp, Artificial Sequence
  Synthetic oligonucleotide
cgcatggaagaaatagttgaaggttgt

SEQ ID NO: 2263 - DNA, 27 bp, Artificial Sequence
  Synthetic oligonucleotide
catggaagaaatagttgaaggttgtac

SEQ ID NO: 2264 - DNA, 27 bp, Artificial Sequence
  Synthetic oligonucleotide
ccattgaaaacatccaaagagtagctg

SEQ ID NO: 2265 - DNA, 27 bp, Artificial Sequence
  Synthetic oligonucleotide
ctgaggacaagccacaagattacaaga

SEQ ID NO: 2266 - DNA, 27 bp, Artificial Sequence
  Synthetic oligonucleotide
ttgatactgacctgtaaatcatccttt

SEQ ID NO: 2267 - DNA, 27 bp, Artificial Sequence
  Synthetic oligonucleotide
ctttaggtaagaagttttaaaaagcca

SEQ ID NO: 2268 - DNA, 27 bp, Artificial Sequence
  Synthetic oligonucleotide
aacaggtatatactttgaaaggagatg

SEQ ID NO: 2269 - DNA, 27 bp, Artificial Sequence
  Synthetic oligonucleotide
tggaagttattaactttaatgtttttt

SEQ ID NO: 2270 - DNA, 27 bp, Artificial Sequence
  Synthetic oligonucleotide
tgccacagcttttgcaacttaatactc

SEQ ID NO: 2271 - DNA, 27 bp, Artificial Sequence
  Synthetic oligonucleotide
aacatttgctgttttaaacattaatag

SEQ ID NO: 2272 - DNA, 27 bp, Artificial Sequence
  Synthetic oligonucleotide
aacaattgaagtaaactttttgttctg

SEQ ID NO: 2273 - DNA, 27 bp, Artificial Sequence
  Synthetic oligonucleotide
aaaccctagccttgcttgttaaatttt

SEQ ID NO: 2274 - DNA, 27 bp, Artificial Sequence
  Synthetic oligonucleotide
tagccttgcttgttaaatttttttttt

SEQ ID NO: 2275 - DNA, 27 bp, Artificial Sequence
  Synthetic oligonucleotide
ttgaagtagctcttttttttttttttt

SEQ ID NO: 2276 - DNA, 27 bp, Artificial Sequence
  Synthetic oligonucleotide
tcgtagtgttaagttatagtgaatact

SEQ ID NO: 2277 - DNA, 27 bp, Artificial Sequence
  Synthetic oligonucleotide
tagtgaatactgctacagcaatttcta

SEQ ID NO: 2278 - DNA, 27 bp, Artificial Sequence
  Synthetic oligonucleotide
aatactgctacagcaatttctaatttt

SEQ ID NO: 2279 - DNA, 27 bp, Artificial Sequence
  Synthetic oligonucleotide
ttctaatttttaagaattgagtaatgg

SEQ ID NO: 2280 - DNA, 27 bp, Artificial Sequence
  Synthetic oligonucleotide
atttttaagaattgagtaatggtgtag

SEQ ID NO: 2281 - DNA, 27 bp, Artificial Sequence
  Synthetic oligonucleotide
ttcataatcactctaattaattgtaat

SEQ ID NO: 2282 - DNA, 27 bp, Artificial Sequence
  Synthetic oligonucleotide
attaattgtaatctgaataaagtgtaa

SEQ ID NO: 2283 - DNA, 27 bp, Artificial Sequence
  Synthetic oligonucleotide
ttgtaatctgaataaagtgtaacaatt

SEQ ID NO: 2284 - DNA, 27 bp, Artificial Sequence
  Synthetic oligonucleotide
tctgaataaagtgtaacaattgtgtag

SEQ ID NO: 2285 - DNA, 27 bp, Artificial Sequence
  Synthetic oligonucleotide
gtgtagcctttttgtataaaatagaca

SEQ ID NO: 2286 - DNA, 27 bp, Artificial Sequence
  Synthetic oligonucleotide
tttgtataaaatagacaaatagaaaat

SEQ ID NO: 2287 - DNA, 27 bp, Artificial Sequence
  Synthetic oligonucleotide
agaaaatggtccaattagtttcctttt

SEQ ID NO: 2288 - DNA, 27 bp, Artificial Sequence
  Synthetic oligonucleotide
gtccaattagtttcctttttaatatgc

SEQ ID NO: 2289 - DNA, 27 bp, Artificial Sequence
  Synthetic oligonucleotide
tttttgatcaaaaactatttgggatat

SEQ ID NO: 2290 - DNA, 27 bp, Artificial Sequence
  Synthetic oligonucleotide
aagaggtgttatttggaaccttgtttt

SEQ ID NO: 2291 - DNA, 27 bp, Artificial Sequence
  Synthetic oligonucleotide
gtgttatttggaaccttgttttggaca

SEQ ID NO: 2292 - DNA, 27 bp, Artificial Sequence
  Synthetic oligonucleotide
gaaccttgttttggacagtttaccagt

SEQ ID NO: 2293 - DNA, 27 bp, Artificial Sequence
  Synthetic oligonucleotide
gtgatacgatgcttcaagagaaaatgc

SEQ ID NO: 2294 - DNA, 27 bp, Artificial Sequence
  Synthetic oligonucleotide
ttcaagagaaaatgcggttataaaaaa

SEQ ID NO: 2295 - DNA, 27 bp, Artificial Sequence
  Synthetic oligonucleotide
gagaaaatgcggttataaaaaatggtt

SEQ ID NO: 2296 - DNA, 27 bp, Artificial Sequence
  Synthetic oligonucleotide
cggttataaaaaatggttcagaattaa

SEQ ID NO: 2297 - DNA, 27 bp, Artificial Sequence
  Synthetic oligonucleotide
aaaaaatggttcagaattaaactttta

SEQ ID NO: 2298 - DNA, 27 bp, Artificial Sequence
  Synthetic oligonucleotide
cagcgtggacaatggctactcaagctg

SEQ ID NO: 2299 - DNA, 27 bp, Artificial Sequence
  Synthetic oligonucleotide
agcgtggacaatggctactcaagctga

SEQ ID NO: 2300 - DNA, 27 bp, Artificial Sequence
  Synthetic oligonucleotide
gcgtggacaatggctactcaagctgat

SEQ ID NO: 2301 - DNA, 27 bp, Artificial Sequence
  Synthetic oligonucleotide
cgtggacaatggctactcaagctgatt

SEQ ID NO: 2302 - DNA, 27 bp, Artificial Sequence
  Synthetic oligonucleotide
gtggacaatggctactcaagctgattt

SEQ ID NO: 2303 - DNA, 27 bp, Artificial Sequence
  Synthetic oligonucleotide
tggacaatggctactcaagctgatttg

SEQ ID NO: 2304 - DNA, 27 bp, Artificial Sequence
  Synthetic oligonucleotide
ggacaatggctactcaagctgatttga

SEQ ID NO: 2305 - DNA, 27 bp, Artificial Sequence
  Synthetic oligonucleotide
gacaatggctactcaagctgatttgat

SEQ ID NO: 2306 - DNA, 27 bp, Artificial Sequence
  Synthetic oligonucleotide
tttgatggagttggacatggccatgga

SEQ ID NO: 2307 - DNA, 27 bp, Artificial Sequence
  Synthetic oligonucleotide
ttgatggagttggacatggccatggaa

SEQ ID NO: 2308 - DNA, 27 bp, Artificial Sequence
  Synthetic oligonucleotide
tgatggagttggacatggccatggaac

SEQ ID NO: 2309 - DNA, 27 bp, Artificial Sequence
  Synthetic oligonucleotide
gatggagttggacatggccatggaacc

SEQ ID NO: 2310 - DNA, 27 bp, Artificial Sequence
  Synthetic oligonucleotide
atggagttggacatggccatggaacca

SEQ ID NO: 2311 - DNA, 27 bp, Artificial Sequence
  Synthetic oligonucleotide
tggagttggacatggccatggaaccag

SEQ ID NO: 2312 - DNA, 27 bp, Artificial Sequence
  Synthetic oligonucleotide
ggagttggacatggccatggaaccaga

SEQ ID NO: 2313 - DNA, 27 bp, Artificial Sequence
  Synthetic oligonucleotide
actctggaatccattctggtgccacta

SEQ ID NO: 2314 - DNA, 27 bp, Artificial Sequence
  Synthetic oligonucleotide
ctctggaatccattctggtgccactac

SEQ ID NO: 2315 - DNA, 27 bp, Artificial Sequence
  Synthetic oligonucleotide
tctggaatccattctggtgccactacc

SEQ ID NO: 2316 - DNA, 27 bp, Artificial Sequence
  Synthetic oligonucleotide
ctggaatccattctggtgccactacca

SEQ ID NO: 2317 - DNA, 27 bp, Artificial Sequence
  Synthetic oligonucleotide
tggaatccattctggtgccactaccac

SEQ ID NO: 2318 - DNA, 27 bp, Artificial Sequence
  Synthetic oligonucleotide
attagatgagggcatgcagatcccatc

SEQ ID NO: 2319 - DNA, 27 bp, Artificial Sequence
  Synthetic oligonucleotide
ttagatgagggcatgcagatcccatct

SEQ ID NO: 2320 - DNA, 27 bp, Artificial Sequence
  Synthetic oligonucleotide
tagatgagggcatgcagatcccatcta

SEQ ID NO: 2321 - DNA, 27 bp, Artificial Sequence
  Synthetic oligonucleotide
agatgagggcatgcagatcccatctac

SEQ ID NO: 2322 - DNA, 27 bp, Artificial Sequence
  Synthetic oligonucleotide
gatgagggcatgcagatcccatctaca

SEQ ID NO: 2323 - DNA, 27 bp, Artificial Sequence
  Synthetic oligonucleotide
atgagggcatgcagatcccatctacac

SEQ ID NO: 2324 - DNA, 27 bp, Artificial Sequence
  Synthetic oligonucleotide
atgctgctcatcccactaatgtccagc

SEQ ID NO: 2325 - DNA, 27 bp, Artificial Sequence
  Synthetic oligonucleotide
tgctgctcatcccactaatgtccagcg

SEQ ID NO: 2326 - DNA, 27 bp, Artificial Sequence
  Synthetic oligonucleotide
gctgctcatcccactaatgtccagcgt

SEQ ID NO: 2327 - DNA, 27 bp, Artificial Sequence
  Synthetic oligonucleotide
ctgctcatcccactaatgtccagcgtt

SEQ ID NO: 2328 - DNA, 27 bp, Artificial Sequence
  Synthetic oligonucleotide
tgctcatcccactaatgtccagcgttt

SEQ ID NO: 2329 - DNA, 27 bp, Artificial Sequence
  Synthetic oligonucleotide
gctcatcccactaatgtccagcgtttg

SEQ ID NO: 2330 - DNA, 27 bp, Artificial Sequence
  Synthetic oligonucleotide
ctcatcccactaatgtccagcgtttgg

SEQ ID NO: 2331 - DNA, 27 bp, Artificial Sequence
  Synthetic oligonucleotide
tcatcccactaatgtccagcgtttggc

SEQ ID NO: 2332 - DNA, 27 bp, Artificial Sequence
  Synthetic oligonucleotide
gtttggctgaaccatcacagatgctga

SEQ ID NO: 2333 - DNA, 27 bp, Artificial Sequence
  Synthetic oligonucleotide
tttggctgaaccatcacagatgctgaa

SEQ ID NO: 2334 - DNA, 27 bp, Artificial Sequence
  Synthetic oligonucleotide
ttggctgaaccatcacagatgctgaaa

SEQ ID NO: 2335 - DNA, 27 bp, Artificial Sequence
  Synthetic oligonucleotide
cagaacttgccacacgtgcaatccctg

SEQ ID NO: 2336 - DNA, 27 bp, Artificial Sequence
  Synthetic oligonucleotide
agaacttgccacacgtgcaatccctga

SEQ ID NO: 2337 - DNA, 27 bp, Artificial Sequence
  Synthetic oligonucleotide
cagttatggtccatcagctttctaaaa

SEQ ID NO: 2338 - DNA, 27 bp, Artificial Sequence
  Synthetic oligonucleotide
agttatggtccatcagctttctaaaaa

SEQ ID NO: 2339 - DNA, 27 bp, Artificial Sequence
  Synthetic oligonucleotide
ctaaaaaggaagcttccagacacgcta

SEQ ID NO: 2340 - DNA, 27 bp, Artificial Sequence
  Synthetic oligonucleotide
taaaaaggaagcttccagacacgctat

SEQ ID NO: 2341 - DNA, 27 bp, Artificial Sequence
  Synthetic oligonucleotide
gtaccatgcagaatacaaatgatgtag

SEQ ID NO: 2342 - DNA, 27 bp, Artificial Sequence
  Synthetic oligonucleotide
taccatgcagaatacaaatgatgtaga

SEQ ID NO: 2343 - DNA, 27 bp, Artificial Sequence
  Synthetic oligonucleotide
accatgcagaatacaaatgatgtagaa

SEQ ID NO: 2344 - DNA, 27 bp, Artificial Sequence
  Synthetic oligonucleotide
ccatgcagaatacaaatgatgtagaaa

SEQ ID NO: 2345 - DNA, 27 bp, Artificial Sequence
  Synthetic oligonucleotide
catgcagaatacaaatgatgtagaaac

SEQ ID NO: 2346 - DNA, 27 bp, Artificial Sequence
  Synthetic oligonucleotide
atgcagaatacaaatgatgtagaaaca

SEQ ID NO: 2347 - DNA, 27 bp, Artificial Sequence
  Synthetic oligonucleotide
tgcagaatacaaatgatgtagaaacag

SEQ ID NO: 2348 - DNA, 27 bp, Artificial Sequence
  Synthetic oligonucleotide
gcagaatacaaatgatgtagaaacagc

SEQ ID NO: 2349 - DNA, 27 bp, Artificial Sequence
  Synthetic oligonucleotide
tactggccatctttaagtctggaggca

SEQ ID NO: 2350 - DNA, 27 bp, Artificial Sequence
  Synthetic oligonucleotide
actggccatctttaagtctggaggcat

SEQ ID NO: 2351 - DNA, 27 bp, Artificial Sequence
  Synthetic oligonucleotide
aagaaggagctaaaatggcagtgcgtt

SEQ ID NO: 2352 - DNA, 27 bp, Artificial Sequence
  Synthetic oligonucleotide
agaaggagctaaaatggcagtgcgttt

SEQ ID NO: 2353 - DNA, 27 bp, Artificial Sequence
  Synthetic oligonucleotide
gaaggagctaaaatggcagtgcgttta

SEQ ID NO: 2354 - DNA, 27 bp, Artificial Sequence
  Synthetic oligonucleotide
aaggagctaaaatggcagtgcgtttag

SEQ ID NO: 2355 - DNA, 27 bp, Artificial Sequence
  Synthetic oligonucleotide
aggagctaaaatggcagtgcgtttagc

SEQ ID NO: 2356 - DNA, 27 bp, Artificial Sequence
  Synthetic oligonucleotide
tactgtggaccacaagcagagtgctga

SEQ ID NO: 2357 - DNA, 27 bp, Artificial Sequence
  Synthetic oligonucleotide
actgtggaccacaagcagagtgctgaa

SEQ ID NO: 2358 - DNA, 27 bp, Artificial Sequence
  Synthetic oligonucleotide
ctgtggaccacaagcagagtgctgaag

SEQ ID NO: 2359 - DNA, 27 bp, Artificial Sequence
  Synthetic oligonucleotide
tgtggaccacaagcagagtgctgaagg

SEQ ID NO: 2360 - DNA, 27 bp, Artificial Sequence
  Synthetic oligonucleotide
gtggaccacaagcagagtgctgaaggt

SEQ ID NO: 2361 - DNA, 27 bp, Artificial Sequence
  Synthetic oligonucleotide
tggaccacaagcagagtgctgaaggtg

SEQ ID NO: 2362 - DNA, 27 bp, Artificial Sequence
  Synthetic oligonucleotide
ggaccacaagcagagtgctgaaggtgc

SEQ ID NO: 2363 - DNA, 27 bp, Artificial Sequence
  Synthetic oligonucleotide
gaccacaagcagagtgctgaaggtgct

SEQ ID NO: 2364 - DNA, 27 bp, Artificial Sequence
  Synthetic oligonucleotide
accacaagcagagtgctgaaggtgcta

SEQ ID NO: 2365 - DNA, 27 bp, Artificial Sequence
  Synthetic oligonucleotide
ccacaagcagagtgctgaaggtgctat

SEQ ID NO: 2366 - DNA, 27 bp, Artificial Sequence
  Synthetic oligonucleotide
cacaagcagagtgctgaaggtgctatc

SEQ ID NO: 2367 - DNA, 27 bp, Artificial Sequence
  Synthetic oligonucleotide
acaagcagagtgctgaaggtgctatct

SEQ ID NO: 2368 - DNA, 27 bp, Artificial Sequence
  Synthetic oligonucleotide
caagcagagtgctgaaggtgctatctg

SEQ ID NO: 2369 - DNA, 27 bp, Artificial Sequence
  Synthetic oligonucleotide
aagcagagtgctgaaggtgctatctgt

SEQ ID NO: 2370 - DNA, 27 bp, Artificial Sequence
  Synthetic oligonucleotide
agaactgtctttggactctcaggaatc

SEQ ID NO: 2371 - DNA, 27 bp, Artificial Sequence
  Synthetic oligonucleotide
gaactgtctttggactctcaggaatct

SEQ ID NO: 2372 - DNA, 27 bp, Artificial Sequence
  Synthetic oligonucleotide
cagatgatataaatgtggtcacctgtg

SEQ ID NO: 2373 - DNA, 27 bp, Artificial Sequence
  Synthetic oligonucleotide
agatgatataaatgtggtcacctgtgc

SEQ ID NO: 2374 - DNA, 27 bp, Artificial Sequence
  Synthetic oligonucleotide
gatgatataaatgtggtcacctgtgca

SEQ ID NO: 2375 - DNA, 27 bp, Artificial Sequence
  Synthetic oligonucleotide
atgatataaatgtggtcacctgtgcag

SEQ ID NO: 2376 - DNA, 27 bp, Artificial Sequence
  Synthetic oligonucleotide
tgatataaatgtggtcacctgtgcagc

SEQ ID NO: 2377 - DNA, 27 bp, Artificial Sequence
  Synthetic oligonucleotide
gatataaatgtggtcacctgtgcagct

SEQ ID NO: 2378 - DNA, 27 bp, Artificial Sequence
  Synthetic oligonucleotide
atataaatgtggtcacctgtgcagctg

SEQ ID NO: 2379 - DNA, 27 bp, Artificial Sequence
  Synthetic oligonucleotide
tataaatgtggtcacctgtgcagctgg

SEQ ID NO: 2380 - DNA, 27 bp, Artificial Sequence
  Synthetic oligonucleotide
ataaatgtggtcacctgtgcagctgga

SEQ ID NO: 2381 - DNA, 27 bp, Artificial Sequence
  Synthetic oligonucleotide
taaatgtggtcacctgtgcagctggaa

SEQ ID NO: 2382 - DNA, 27 bp, Artificial Sequence
  Synthetic oligonucleotide
aaatgtggtcacctgtgcagctggaat

SEQ ID NO: 2383 - DNA, 27 bp, Artificial Sequence
  Synthetic oligonucleotide
aatgtggtcacctgtgcagctggaatt

SEQ ID NO: 2384 - DNA, 27 bp, Artificial Sequence
  Synthetic oligonucleotide
atgtggtcacctgtgcagctggaattc

SEQ ID NO: 2385 - DNA, 27 bp, Artificial Sequence
  Synthetic oligonucleotide
tgtggtcacctgtgcagctggaattct

SEQ ID NO: 2386 - DNA, 27 bp, Artificial Sequence
  Synthetic oligonucleotide
gtggtcacctgtgcagctggaattctt

SEQ ID NO: 2387 - DNA, 27 bp, Artificial Sequence
  Synthetic oligonucleotide
tggtcacctgtgcagctggaattcttt

SEQ ID NO: 2388 - DNA, 27 bp, Artificial Sequence
  Synthetic oligonucleotide
ggtcacctgtgcagctggaattctttc

SEQ ID NO: 2389 - DNA, 27 bp, Artificial Sequence
  Synthetic oligonucleotide
gtcacctgtgcagctggaattctttct

SEQ ID NO: 2390 - DNA, 27 bp, Artificial Sequence
  Synthetic oligonucleotide
tcacctgtgcagctggaattctttcta

SEQ ID NO: 2391 - DNA, 27 bp, Artificial Sequence
  Synthetic oligonucleotide
cacctgtgcagctggaattctttctaa

SEQ ID NO: 2392 - DNA, 27 bp, Artificial Sequence
  Synthetic oligonucleotide
tttctaacctcacttgcaataattata

SEQ ID NO: 2393 - DNA, 27 bp, Artificial Sequence
  Synthetic oligonucleotide
ttctaacctcacttgcaataattataa

SEQ ID NO: 2394 - DNA, 27 bp, Artificial Sequence
  Synthetic oligonucleotide
tctaacctcacttgcaataattataag

SEQ ID NO: 2395 - DNA, 27 bp, Artificial Sequence
  Synthetic oligonucleotide
ctaacctcacttgcaataattataaga

SEQ ID NO: 2396 - DNA, 27 bp, Artificial Sequence
  Synthetic oligonucleotide
taacctcacttgcaataattataagaa

SEQ ID NO: 2397 - DNA, 27 bp, Artificial Sequence
  Synthetic oligonucleotide
gggctggtgacagggaagacatcactg

SEQ ID NO: 2398 - DNA, 27 bp, Artificial Sequence
  Synthetic oligonucleotide
ggctggtgacagggaagacatcactga

SEQ ID NO: 2399 - DNA, 27 bp, Artificial Sequence
  Synthetic oligonucleotide
gctggtgacagggaagacatcactgag

SEQ ID NO: 2400 - DNA, 27 bp, Artificial Sequence
  Synthetic oligonucleotide
ctggtgacagggaagacatcactgagc

SEQ ID NO: 2401 - DNA, 27 bp, Artificial Sequence
  Synthetic oligonucleotide
tggtgacagggaagacatcactgagcc

SEQ ID NO: 2402 - DNA, 27 bp, Artificial Sequence
  Synthetic oligonucleotide
ggtgacagggaagacatcactgagcct

SEQ ID NO: 2403 - DNA, 27 bp, Artificial Sequence
  Synthetic oligonucleotide
gtgacagggaagacatcactgagcctg

SEQ ID NO: 2404 - DNA, 27 bp, Artificial Sequence
  Synthetic oligonucleotide
tgacagggaagacatcactgagcctgc

SEQ ID NO: 2405 - DNA, 27 bp, Artificial Sequence
  Synthetic oligonucleotide
gacagggaagacatcactgagcctgcc

SEQ ID NO: 2406 - DNA, 27 bp, Artificial Sequence
  Synthetic oligonucleotide
acagggaagacatcactgagcctgcca

SEQ ID NO: 2407 - DNA, 27 bp, Artificial Sequence
  Synthetic oligonucleotide
cagggaagacatcactgagcctgccat

SEQ ID NO: 2408 - DNA, 27 bp, Artificial Sequence
  Synthetic oligonucleotide
agggaagacatcactgagcctgccatc

SEQ ID NO: 2409 - DNA, 27 bp, Artificial Sequence
  Synthetic oligonucleotide
gggaagacatcactgagcctgccatct

SEQ ID NO: 2410 - DNA, 27 bp, Artificial Sequence
  Synthetic oligonucleotide
ggaagacatcactgagcctgccatctg

SEQ ID NO: 2411 - DNA, 27 bp, Artificial Sequence
  Synthetic oligonucleotide
gaagacatcactgagcctgccatctgt

SEQ ID NO: 2412 - DNA, 27 bp, Artificial Sequence
  Synthetic oligonucleotide
aagacatcactgagcctgccatctgtg

SEQ ID NO: 2413 - DNA, 27 bp, Artificial Sequence
  Synthetic oligonucleotide
agacatcactgagcctgccatctgtgc

SEQ ID NO: 2414 - DNA, 27 bp, Artificial Sequence
  Synthetic oligonucleotide
gacatcactgagcctgccatctgtgct

SEQ ID NO: 2415 - DNA, 27 bp, Artificial Sequence
  Synthetic oligonucleotide
acatcactgagcctgccatctgtgctc

SEQ ID NO: 2416 - DNA, 27 bp, Artificial Sequence
  Synthetic oligonucleotide
catcactgagcctgccatctgtgctct

SEQ ID NO: 2417 - DNA, 27 bp, Artificial Sequence
  Synthetic oligonucleotide
atcactgagcctgccatctgtgctctt

SEQ ID NO: 2418 - DNA, 27 bp, Artificial Sequence
  Synthetic oligonucleotide
tcactgagcctgccatctgtgctcttc

SEQ ID NO: 2419 - DNA, 27 bp, Artificial Sequence
  Synthetic oligonucleotide
cactgagcctgccatctgtgctcttcg

SEQ ID NO: 2420 - DNA, 27 bp, Artificial Sequence
  Synthetic oligonucleotide
actgagcctgccatctgtgctcttcgt

SEQ ID NO: 2421 - DNA, 27 bp, Artificial Sequence
  Synthetic oligonucleotide
ctgagcctgccatctgtgctcttcgtc

SEQ ID NO: 2422 - DNA, 27 bp, Artificial Sequence
  Synthetic oligonucleotide
tgagcctgccatctgtgctcttcgtca

SEQ ID NO: 2423 - DNA, 27 bp, Artificial Sequence
  Synthetic oligonucleotide
gagcctgccatctgtgctcttcgtcat

SEQ ID NO: 2424 - DNA, 27 bp, Artificial Sequence
  Synthetic oligonucleotide
agcctgccatctgtgctcttcgtcatc

SEQ ID NO: 2425 - DNA, 27 bp, Artificial Sequence
  Synthetic oligonucleotide
gcctgccatctgtgctcttcgtcatct

SEQ ID NO: 2426 - DNA, 27 bp, Artificial Sequence
  Synthetic oligonucleotide
cctgccatctgtgctcttcgtcatctg

SEQ ID NO: 2427 - DNA, 27 bp, Artificial Sequence
  Synthetic oligonucleotide
ctgccatctgtgctcttcgtcatctga

SEQ ID NO: 2428 - DNA, 27 bp, Artificial Sequence
  Synthetic oligonucleotide
tgccatctgtgctcttcgtcatctgac

SEQ ID NO: 2429 - DNA, 27 bp, Artificial Sequence
  Synthetic oligonucleotide
gccatctgtgctcttcgtcatctgacc

SEQ ID NO: 2430 - DNA, 27 bp, Artificial Sequence
  Synthetic oligonucleotide
ccatctgtgctcttcgtcatctgacca

SEQ ID NO: 2431 - DNA, 27 bp, Artificial Sequence
  Synthetic oligonucleotide
catctgtgctcttcgtcatctgaccag

SEQ ID NO: 2432 - DNA, 27 bp, Artificial Sequence
  Synthetic oligonucleotide
atctgtgctcttcgtcatctgaccagc

SEQ ID NO: 2433 - DNA, 27 bp, Artificial Sequence
  Synthetic oligonucleotide
tctgtgctcttcgtcatctgaccagcc

SEQ ID NO: 2434 - DNA, 27 bp, Artificial Sequence
  Synthetic oligonucleotide
ctgtgctcttcgtcatctgaccagccg

SEQ ID NO: 2435 - DNA, 27 bp, Artificial Sequence
  Synthetic oligonucleotide
tgtgctcttcgtcatctgaccagccga

SEQ ID NO: 2436 - DNA, 27 bp, Artificial Sequence
  Synthetic oligonucleotide
gtgctcttcgtcatctgaccagccgac

SEQ ID NO: 2437 - DNA, 27 bp, Artificial Sequence
  Synthetic oligonucleotide
tgctcttcgtcatctgaccagccgaca

SEQ ID NO: 2438 - DNA, 27 bp, Artificial Sequence
  Synthetic oligonucleotide
gctcttcgtcatctgaccagccgacac

SEQ ID NO: 2439 - DNA, 27 bp, Artificial Sequence
  Synthetic oligonucleotide
ctcttcgtcatctgaccagccgacacc

SEQ ID NO: 2440 - DNA, 27 bp, Artificial Sequence
  Synthetic oligonucleotide
tcttcgtcatctgaccagccgacacca

SEQ ID NO: 2441 - DNA, 27 bp, Artificial Sequence
  Synthetic oligonucleotide
tacacccaccatcccactggcctctga

SEQ ID NO: 2442 - DNA, 27 bp, Artificial Sequence
  Synthetic oligonucleotide
acacccaccatcccactggcctctgat

SEQ ID NO: 2443 - DNA, 27 bp, Artificial Sequence
  Synthetic oligonucleotide
cacccaccatcccactggcctctgata

SEQ ID NO: 2444 - DNA, 27 bp, Artificial Sequence
  Synthetic oligonucleotide
acccaccatcccactggcctctgataa

SEQ ID NO: 2445 - DNA, 27 bp, Artificial Sequence
  Synthetic oligonucleotide
cccaccatcccactggcctctgataaa

SEQ ID NO: 2446 - DNA, 27 bp, Artificial Sequence
  Synthetic oligonucleotide
ccaccatcccactggcctctgataaag

SEQ ID NO: 2447 - DNA, 27 bp, Artificial Sequence
  Synthetic oligonucleotide
caccatcccactggcctctgataaagg

SEQ ID NO: 2448 - DNA, 27 bp, Artificial Sequence
  Synthetic oligonucleotide
accatcccactggcctctgataaaggc

SEQ ID NO: 2449 - DNA, 27 bp, Artificial Sequence
  Synthetic oligonucleotide
ccatcccactggcctctgataaaggct

SEQ ID NO: 2450 - DNA, 27 bp, Artificial Sequence
  Synthetic oligonucleotide
catcccactggcctctgataaaggcta

SEQ ID NO: 2451 - DNA, 27 bp, Artificial Sequence
  Synthetic oligonucleotide
atcccactggcctctgataaaggctac

SEQ ID NO: 2452 - DNA, 27 bp, Artificial Sequence
  Synthetic oligonucleotide
tcccactggcctctgataaaggctact

SEQ ID NO: 2453 - DNA, 27 bp, Artificial Sequence
  Synthetic oligonucleotide
cccactggcctctgataaaggctactg

SEQ ID NO: 2454 - DNA, 27 bp, Artificial Sequence
  Synthetic oligonucleotide
ccactggcctctgataaaggctactgt

SEQ ID NO: 2455 - DNA, 27 bp, Artificial Sequence
  Synthetic oligonucleotide
ctactgttggattgattcgaaatcttg

SEQ ID NO: 2456 - DNA, 27 bp, Artificial Sequence
  Synthetic oligonucleotide
tactgttggattgattcgaaatcttgc

SEQ ID NO: 2457 - DNA, 27 bp, Artificial Sequence
  Synthetic oligonucleotide
taaataccattccattgtttgtgcagc

SEQ ID NO: 2458 - DNA, 27 bp, Artificial Sequence
  Synthetic oligonucleotide
aaataccattccattgtttgtgcagct

SEQ ID NO: 2459 - DNA, 27 bp, Artificial Sequence
  Synthetic oligonucleotide
aataccattccattgtttgtgcagctg

SEQ ID NO: 2460 - DNA, 27 bp, Artificial Sequence
  Synthetic oligonucleotide
ataccattccattgtttgtgcagctgc

SEQ ID NO: 2461 - DNA, 27 bp, Artificial Sequence
  Synthetic oligonucleotide
taccattccattgtttgtgcagctgct

SEQ ID NO: 2462 - DNA, 27 bp, Artificial Sequence
  Synthetic oligonucleotide
accattccattgtttgtgcagctgctt

SEQ ID NO: 2463 - DNA, 27 bp, Artificial Sequence
  Synthetic oligonucleotide
gctgctttattctcccattgaaaacat

SEQ ID NO: 2464 - DNA, 27 bp, Artificial Sequence
  Synthetic oligonucleotide
ctgctttattctcccattgaaaacatc

SEQ ID NO: 2465 - DNA, 27 bp, Artificial Sequence
  Synthetic oligonucleotide
tgctttattctcccattgaaaacatcc

SEQ ID NO: 2466 - DNA, 27 bp, Artificial Sequence
  Synthetic oligonucleotide
gctttattctcccattgaaaacatcca

SEQ ID NO: 2467 - DNA, 27 bp, Artificial Sequence
  Synthetic oligonucleotide
gggtcctctgtgaacttgctcaggaca

SEQ ID NO: 2468 - DNA, 27 bp, Artificial Sequence
  Synthetic oligonucleotide
ggtcctctgtgaacttgctcaggacaa

SEQ ID NO: 2469 - DNA, 27 bp, Artificial Sequence
  Synthetic oligonucleotide
gtcctctgtgaacttgctcaggacaag

SEQ ID NO: 2470 - DNA, 27 bp, Artificial Sequence
  Synthetic oligonucleotide
tcctctgtgaacttgctcaggacaagg

SEQ ID NO: 2471 - DNA, 27 bp, Artificial Sequence
  Synthetic oligonucleotide
cctctgtgaacttgctcaggacaagga

SEQ ID NO: 2472 - DNA, 27 bp, Artificial Sequence
  Synthetic oligonucleotide
ctctgtgaacttgctcaggacaaggaa

SEQ ID NO: 2473 - DNA, 27 bp, Artificial Sequence
  Synthetic oligonucleotide
tctgtgaacttgctcaggacaaggaag

SEQ ID NO: 2474 - DNA, 27 bp, Artificial Sequence
  Synthetic oligonucleotide
ctgtgaacttgctcaggacaaggaagc

SEQ ID NO: 2475 - DNA, 27 bp, Artificial Sequence
  Synthetic oligonucleotide
tgtgaacttgctcaggacaaggaagct

SEQ ID NO: 2476 - DNA, 27 bp, Artificial Sequence
  Synthetic oligonucleotide
gtgaacttgctcaggacaaggaagctg

SEQ ID NO: 2477 - DNA, 27 bp, Artificial Sequence
  Synthetic oligonucleotide
tgaacttgctcaggacaaggaagctgc

SEQ ID NO: 2478 - DNA, 27 bp, Artificial Sequence
  Synthetic oligonucleotide
ctattgaagctgagggagccacagctc

SEQ ID NO: 2479 - DNA, 27 bp, Artificial Sequence
  Synthetic oligonucleotide
tattgaagctgagggagccacagctcc

SEQ ID NO: 2480 - DNA, 27 bp, Artificial Sequence
  Synthetic oligonucleotide
attgaagctgagggagccacagctcct

SEQ ID NO: 2481 - DNA, 27 bp, Artificial Sequence
  Synthetic oligonucleotide
tgttccgaatgtctgaggacaagccac

SEQ ID NO: 2482 - DNA, 27 bp, Artificial Sequence
  Synthetic oligonucleotide
gttccgaatgtctgaggacaagccaca

SEQ ID NO: 2483 - DNA, 27 bp, Artificial Sequence
  Synthetic oligonucleotide
ttccgaatgtctgaggacaagccacaa

SEQ ID NO: 2484 - DNA, 27 bp, Artificial Sequence
  Synthetic oligonucleotide
tccgaatgtctgaggacaagccacaag

SEQ ID NO: 2485 - DNA, 27 bp, Artificial Sequence
  Synthetic oligonucleotide
ccgaatgtctgaggacaagccacaaga

SEQ ID NO: 2486 - DNA, 27 bp, Artificial Sequence
  Synthetic oligonucleotide
cgaatgtctgaggacaagccacaagat

SEQ ID NO: 2487 - DNA, 27 bp, Artificial Sequence
  Synthetic oligonucleotide
gaatgtctgaggacaagccacaagatt

SEQ ID NO: 2488 - DNA, 27 bp, Artificial Sequence
  Synthetic oligonucleotide
aatgtctgaggacaagccacaagatta

SEQ ID NO: 2489 - DNA, 27 bp, Artificial Sequence
  Synthetic oligonucleotide
gaacagagccaatggcttggaatgaga

SEQ ID NO: 2490 - DNA, 27 bp, Artificial Sequence
  Synthetic oligonucleotide
aacagagccaatggcttggaatgagac

SEQ ID NO: 2491 - DNA, 27 bp, Artificial Sequence
  Synthetic oligonucleotide
acagagccaatggcttggaatgagact

SEQ ID NO: 2492 - DNA, 27 bp, Artificial Sequence
  Synthetic oligonucleotide
cagagccaatggcttggaatgagactg

SEQ ID NO: 2493 - DNA, 27 bp, Artificial Sequence
  Synthetic oligonucleotide
agagccaatggcttggaatgagactgc

SEQ ID NO: 2494 - DNA, 27 bp, Artificial Sequence
  Synthetic oligonucleotide
gagccaatggcttggaatgagactgct

SEQ ID NO: 2495 - DNA, 27 bp, Artificial Sequence
  Synthetic oligonucleotide
agccaatggcttggaatgagactgctg

SEQ ID NO: 2496 - DNA, 27 bp, Artificial Sequence
  Synthetic oligonucleotide
gccaatggcttggaatgagactgctga

SEQ ID NO: 2497 - DNA, 27 bp, Artificial Sequence
  Synthetic oligonucleotide
ccaatggcttggaatgagactgctgat

SEQ ID NO: 2498 - DNA, 27 bp, Artificial Sequence
  Synthetic oligonucleotide
caatggcttggaatgagactgctgatc

SEQ ID NO: 2499 - DNA, 27 bp, Artificial Sequence
  Synthetic oligonucleotide
aatggcttggaatgagactgctgatct

SEQ ID NO: 2500 - DNA, 27 bp, Artificial Sequence
  Synthetic oligonucleotide
cccttggatatcgccaggatgatccta

SEQ ID NO: 2501 - DNA, 27 bp, Artificial Sequence
  Synthetic oligonucleotide
ccttggatatcgccaggatgatcctag

SEQ ID NO: 2502 - DNA, 27 bp, Artificial Sequence
  Synthetic oligonucleotide
cttggatatcgccaggatgatcctagc

SEQ ID NO: 2503 - DNA, 27 bp, Artificial Sequence
  Synthetic oligonucleotide
ttggatatcgccaggatgatcctagct

SEQ ID NO: 2504 - DNA, 27 bp, Artificial Sequence
  Synthetic oligonucleotide
tggatatcgccaggatgatcctagcta

SEQ ID NO: 2505 - DNA, 27 bp, Artificial Sequence
  Synthetic oligonucleotide
atcgttcttttcactctggtggatatg

SEQ ID NO: 2506 - DNA, 27 bp, Artificial Sequence
  Synthetic oligonucleotide
tcgttcttttcactctggtggatatgg

SEQ ID NO: 2507 - DNA, 27 bp, Artificial Sequence
  Synthetic oligonucleotide
cgttcttttcactctggtggatatggc

SEQ ID NO: 2508 - DNA, 27 bp, Artificial Sequence
  Synthetic oligonucleotide
gttcttttcactctggtggatatggcc

SEQ ID NO: 2509 - DNA, 27 bp, Artificial Sequence
  Synthetic oligonucleotide
ttcttttcactctggtggatatggcca

SEQ ID NO: 2510 - DNA, 27 bp, Artificial Sequence
  Synthetic oligonucleotide
aacatgagatgggtggccaccaccctg

SEQ ID NO: 2511 - DNA, 27 bp, Artificial Sequence
  Synthetic oligonucleotide
acatgagatgggtggccaccaccctgg

SEQ ID NO: 2512 - DNA, 27 bp, Artificial Sequence
  Synthetic oligonucleotide
catgagatgggtggccaccaccctggt

SEQ ID NO: 2513 - DNA, 27 bp, Artificial Sequence
  Synthetic oligonucleotide
atgagatgggtggccaccaccctggtg

SEQ ID NO: 2514 - DNA, 27 bp, Artificial Sequence
  Synthetic oligonucleotide
tgagatgggtggccaccaccctggtgc

SEQ ID NO: 2515 - DNA, 27 bp, Artificial Sequence
  Synthetic oligonucleotide
gagatgggtggccaccaccctggtgct

SEQ ID NO: 2516 - DNA, 27 bp, Artificial Sequence
  Synthetic oligonucleotide
agatgggtggccaccaccctggtgctg

SEQ ID NO: 2517 - DNA, 27 bp, Artificial Sequence
  Synthetic oligonucleotide
gatgggtggccaccaccctggtgctga

SEQ ID NO: 2518 - DNA, 27 bp, Artificial Sequence
  Synthetic oligonucleotide
atgggtggccaccaccctggtgctgac

SEQ ID NO: 2519 - DNA, 27 bp, Artificial Sequence
  Synthetic oligonucleotide
tgggtggccaccaccctggtgctgact

SEQ ID NO: 2520 - DNA, 27 bp, Artificial Sequence
  Synthetic oligonucleotide
gggtggccaccaccctggtgctgacta

SEQ ID NO: 2521 - DNA, 27 bp, Artificial Sequence
  Synthetic oligonucleotide
ggtggccaccaccctggtgctgactat

SEQ ID NO: 2522 - DNA, 27 bp, Artificial Sequence
  Synthetic oligonucleotide
gtggccaccaccctggtgctgactatc

SEQ ID NO: 2523 - DNA, 27 bp, Artificial Sequence
  Synthetic oligonucleotide
tggccaccaccctggtgctgactatcc

SEQ ID NO: 2524 - DNA, 27 bp, Artificial Sequence
  Synthetic oligonucleotide
ggccaccaccctggtgctgactatcca

SEQ ID NO: 2525 - DNA, 27 bp, Artificial Sequence
  Synthetic oligonucleotide
gccaccaccctggtgctgactatccag

SEQ ID NO: 2526 - DNA, 27 bp, Artificial Sequence
  Synthetic oligonucleotide
ccaccaccctggtgctgactatccagt

SEQ ID NO: 2527 - DNA, 27 bp, Artificial Sequence
  Synthetic oligonucleotide
caccaccctggtgctgactatccagtt

SEQ ID NO: 2528 - DNA, 27 bp, Artificial Sequence
  Synthetic oligonucleotide
accaccctggtgctgactatccagttg

SEQ ID NO: 2529 - DNA, 27 bp, Artificial Sequence
  Synthetic oligonucleotide
ccaccctggtgctgactatccagttga

SEQ ID NO: 2530 - DNA, 27 bp, Artificial Sequence
  Synthetic oligonucleotide
caccctggtgctgactatccagttgat

SEQ ID NO: 2531 - DNA, 27 bp, Artificial Sequence
  Synthetic oligonucleotide
accctggtgctgactatccagttgatg

SEQ ID NO: 2532 - DNA, 27 bp, Artificial Sequence
  Synthetic oligonucleotide
ccctggtgctgactatccagttgatgg

SEQ ID NO: 2533 - DNA, 27 bp, Artificial Sequence
  Synthetic oligonucleotide
cctggtgctgactatccagttgatggg

SEQ ID NO: 2534 - DNA, 27 bp, Artificial Sequence
  Synthetic oligonucleotide
ctggtgctgactatccagttgatgggc

SEQ ID NO: 2535 - DNA, 27 bp, Artificial Sequence
  Synthetic oligonucleotide
tggtgctgactatccagttgatgggct

SEQ ID NO: 2536 - DNA, 27 bp, Artificial Sequence
  Synthetic oligonucleotide
ggtgctgactatccagttgatgggctg

SEQ ID NO: 2537 - DNA, 27 bp, Artificial Sequence
  Synthetic oligonucleotide
gtgctgactatccagttgatgggctgc

SEQ ID NO: 2538 - DNA, 27 bp, Artificial Sequence
  Synthetic oligonucleotide
tgctgactatccagttgatgggctgcc

SEQ ID NO: 2539 - DNA, 27 bp, Artificial Sequence
  Synthetic oligonucleotide
gctgactatccagttgatgggctgcca

SEQ ID NO: 2540 - DNA, 27 bp, Artificial Sequence
  Synthetic oligonucleotide
ctgactatccagttgatgggctgccag

SEQ ID NO: 2541 - DNA, 27 bp, Artificial Sequence
  Synthetic oligonucleotide
tgactatccagttgatgggctgccaga

SEQ ID NO: 2542 - DNA, 27 bp, Artificial Sequence
  Synthetic oligonucleotide
gactatccagttgatgggctgccagat

SEQ ID NO: 2543 - DNA, 27 bp, Artificial Sequence
  Synthetic oligonucleotide
actatccagttgatgggctgccagatc

SEQ ID NO: 2544 - DNA, 27 bp, Artificial Sequence
  Synthetic oligonucleotide
ctatccagttgatgggctgccagatct

SEQ ID NO: 2545 - DNA, 27 bp, Artificial Sequence
  Synthetic oligonucleotide
atgcccaggacctcatggatgggctgc

SEQ ID NO: 2546 - DNA, 27 bp, Artificial Sequence
  Synthetic oligonucleotide
tgcccaggacctcatggatgggctgcc

SEQ ID NO: 2547 - DNA, 27 bp, Artificial Sequence
  Synthetic oligonucleotide
gcccaggacctcatggatgggctgcct

SEQ ID NO: 2548 - DNA, 27 bp, Artificial Sequence
  Synthetic oligonucleotide
acagcaatcagctggcctggtttgata

SEQ ID NO: 2549 - DNA, 27 bp, Artificial Sequence
  Synthetic oligonucleotide
cagcaatcagctggcctggtttgatac

SEQ ID NO: 2550 - DNA, 27 bp, Artificial Sequence
  Synthetic oligonucleotide
agcaatcagctggcctggtttgatact

SEQ ID NO: 2551 - DNA, 27 bp, Artificial Sequence
  Synthetic oligonucleotide
gcaatcagctggcctggtttgatactg

SEQ ID NO: 2552 - DNA, 27 bp, Artificial Sequence
  Synthetic oligonucleotide
caatcagctggcctggtttgatactga

SEQ ID NO: 2553 - DNA, 27 bp, Artificial Sequence
  Synthetic oligonucleotide
aatcagctggcctggtttgatactgac

SEQ ID NO: 2554 - DNA, 27 bp, Artificial Sequence
  Synthetic oligonucleotide
atcagctggcctggtttgatactgacc

SEQ ID NO: 2555 - DNA, 27 bp, Artificial Sequence
  Synthetic oligonucleotide
tcagctggcctggtttgatactgacct

SEQ ID NO: 2556 - DNA, 27 bp, Artificial Sequence
  Synthetic oligonucleotide
cagctggcctggtttgatactgacctg

SEQ ID NO: 2557 - DNA, 27 bp, Artificial Sequence
  Synthetic oligonucleotide
agctggcctggtttgatactgacctgt

SEQ ID NO: 2558 - DNA, 27 bp, Artificial Sequence
  Synthetic oligonucleotide
gctggcctggtttgatactgacctgta

SEQ ID NO: 2559 - DNA, 27 bp, Artificial Sequence
  Synthetic oligonucleotide
ctggcctggtttgatactgacctgtaa

SEQ ID NO: 2560 - DNA, 27 bp, Artificial Sequence
  Synthetic oligonucleotide
tggcctggtttgatactgacctgtaaa

SEQ ID NO: 2561 - DNA, 27 bp, Artificial Sequence
  Synthetic oligonucleotide
ggcctggtttgatactgacctgtaaat

SEQ ID NO: 2562 - DNA, 27 bp, Artificial Sequence
  Synthetic oligonucleotide
gcctggtttgatactgacctgtaaatc

SEQ ID NO: 2563 - DNA, 27 bp, Artificial Sequence
  Synthetic oligonucleotide
cctggtttgatactgacctgtaaatca

SEQ ID NO: 2564 - DNA, 27 bp, Artificial Sequence
  Synthetic oligonucleotide
ctggtttgatactgacctgtaaatcat

SEQ ID NO: 2565 - DNA, 27 bp, Artificial Sequence
  Synthetic oligonucleotide
tggtttgatactgacctgtaaatcatc

SEQ ID NO: 2566 - DNA, 27 bp, Artificial Sequence
  Synthetic oligonucleotide
ggtttgatactgacctgtaaatcatcc

SEQ ID NO: 2567 - DNA, 27 bp, Artificial Sequence
  Synthetic oligonucleotide
gtttgatactgacctgtaaatcatcct

SEQ ID NO: 2568 - DNA, 27 bp, Artificial Sequence
  Synthetic oligonucleotide
tttgatactgacctgtaaatcatcctt

SEQ ID NO: 2569 - DNA, 27 bp, Artificial Sequence
  Synthetic oligonucleotide
ttttttgccacagcttttgcaacttaa

SEQ ID NO: 2570 - DNA, 27 bp, Artificial Sequence
  Synthetic oligonucleotide
aatgagtaacatttgctgttttaaaca

SEQ ID NO: 2571 - DNA, 27 bp, Artificial Sequence
  Synthetic oligonucleotide
taaacattaatagcagcctttctctct

SEQ ID NO: 2572 - DNA, 27 bp, Artificial Sequence
  Synthetic oligonucleotide
aacattaatagcagcctttctctcttt

SEQ ID NO: 2573 - DNA, 27 bp, Artificial Sequence
  Synthetic oligonucleotide
cattaatagcagcctttctctctttat

SEQ ID NO: 2574 - DNA, 27 bp, Artificial Sequence
  Synthetic oligonucleotide
ttaatagcagcctttctctctttatac

SEQ ID NO: 2575 - DNA, 27 bp, Artificial Sequence
  Synthetic oligonucleotide
ttgcattgtgattggcctgtagagttg

SEQ ID NO: 2576 - DNA, 27 bp, Artificial Sequence
  Synthetic oligonucleotide
gcattgtgattggcctgtagagttgct

SEQ ID NO: 2577 - DNA, 27 bp, Artificial Sequence
  Synthetic oligonucleotide
attgtgattggcctgtagagttgctga

SEQ ID NO: 2578 - DNA, 27 bp, Artificial Sequence
  Synthetic oligonucleotide
tgtgattggcctgtagagttgctgaga

SEQ ID NO: 2579 - DNA, 27 bp, Artificial Sequence
  Synthetic oligonucleotide
tgattggcctgtagagttgctgagagg

SEQ ID NO: 2580 - DNA, 27 bp, Artificial Sequence
  Synthetic oligonucleotide
attggcctgtagagttgctgagagggc

SEQ ID NO: 2581 - DNA, 27 bp, Artificial Sequence
  Synthetic oligonucleotide
tggcctgtagagttgctgagagggctc

SEQ ID NO: 2582 - DNA, 27 bp, Artificial Sequence
  Synthetic oligonucleotide
gcctgtagagttgctgagagggctcga

SEQ ID NO: 2583 - DNA, 27 bp, Artificial Sequence
  Synthetic oligonucleotide
ctgtagagttgctgagagggctcgagg

SEQ ID NO: 2584 - DNA, 27 bp, Artificial Sequence
  Synthetic oligonucleotide
gggtgggctggtatctcagaaagtgcc

SEQ ID NO: 2585 - DNA, 27 bp, Artificial Sequence
  Synthetic oligonucleotide
gtgggctggtatctcagaaagtgcctg

SEQ ID NO: 2586 - DNA, 27 bp, Artificial Sequence
  Synthetic oligonucleotide
gggctggtatctcagaaagtgcctgac

SEQ ID NO: 2587 - DNA, 27 bp, Artificial Sequence
  Synthetic oligonucleotide
gctggtatctcagaaagtgcctgacac

SEQ ID NO: 2588 - DNA, 27 bp, Artificial Sequence
  Synthetic oligonucleotide
acactaaccaagctgagtttcctatgg

SEQ ID NO: 2589 - DNA, 27 bp, Artificial Sequence
  Synthetic oligonucleotide
actaaccaagctgagtttcctatggga

SEQ ID NO: 2590 - DNA, 27 bp, Artificial Sequence
  Synthetic oligonucleotide
taaccaagctgagtttcctatgggaac

SEQ ID NO: 2591 - DNA, 27 bp, Artificial Sequence
  Synthetic oligonucleotide
accaagctgagtttcctatgggaacaa

SEQ ID NO: 2592 - DNA, 27 bp, Artificial Sequence
  Synthetic oligonucleotide
caagctgagtttcctatgggaacaatt

SEQ ID NO: 2593 - DNA, 27 bp, Artificial Sequence
  Synthetic oligonucleotide
agctgagtttcctatgggaacaattga

SEQ ID NO: 2594 - DNA, 27 bp, Artificial Sequence
  Synthetic oligonucleotide
aactttttgttctggtcctttttggtc

SEQ ID NO: 2595 - DNA, 27 bp, Artificial Sequence
  Synthetic oligonucleotide
ctttttgttctggtcctttttggtcga

SEQ ID NO: 2596 - DNA, 27 bp, Artificial Sequence
  Synthetic oligonucleotide
ttttgttctggtcctttttggtcgagg

SEQ ID NO: 2597 - DNA, 27 bp, Artificial Sequence
  Synthetic oligonucleotide
ttgttctggtcctttttggtcgaggag

SEQ ID NO: 2598 - DNA, 27 bp, Artificial Sequence
  Synthetic oligonucleotide
gttctggtcctttttggtcgaggagta

SEQ ID NO: 2599 - DNA, 27 bp, Artificial Sequence
  Synthetic oligonucleotide
tctggtcctttttggtcgaggagtaac

SEQ ID NO: 2600 - DNA, 27 bp, Artificial Sequence
  Synthetic oligonucleotide
tggtcctttttggtcgaggagtaacaa

SEQ ID NO: 2601 - DNA, 27 bp, Artificial Sequence
  Synthetic oligonucleotide
gtcctttttggtcgaggagtaacaata

SEQ ID NO: 2602 - DNA, 27 bp, Artificial Sequence
  Synthetic oligonucleotide
cctttttggtcgaggagtaacaataca

SEQ ID NO: 2603 - DNA, 27 bp, Artificial Sequence
  Synthetic oligonucleotide
tttttggtcgaggagtaacaatacaaa

SEQ ID NO: 2604 - DNA, 27 bp, Artificial Sequence
  Synthetic oligonucleotide
tttggtcgaggagtaacaatacaaatg

SEQ ID NO: 2605 - DNA, 27 bp, Artificial Sequence
  Synthetic oligonucleotide
tggtcgaggagtaacaatacaaatgga

SEQ ID NO: 2606 - DNA, 27 bp, Artificial Sequence
  Synthetic oligonucleotide
gtcgaggagtaacaatacaaatggatt

SEQ ID NO: 2607 - DNA, 27 bp, Artificial Sequence
  Synthetic oligonucleotide
cgaggagtaacaatacaaatggatttt

SEQ ID NO: 2608 - DNA, 27 bp, Artificial Sequence
  Synthetic oligonucleotide
aggagtaacaatacaaatggattttgg

SEQ ID NO: 2609 - DNA, 27 bp, Artificial Sequence
  Synthetic oligonucleotide
tttatcaaaccctagccttgcttgtta

SEQ ID NO: 2610 - DNA, 27 bp, Artificial Sequence
  Synthetic oligonucleotide
tatcaaaccctagccttgcttgttaaa

SEQ ID NO: 2611 - DNA, 27 bp, Artificial Sequence
  Synthetic oligonucleotide
tcaaaccctagccttgcttgttaaatt

SEQ ID NO: 2612 - DNA, 27 bp, Artificial Sequence
  Synthetic oligonucleotide
ttgagtaatggtgtagaacactaattc

SEQ ID NO: 2613 - DNA, 27 bp, Artificial Sequence
  Synthetic oligonucleotide
gagtaatggtgtagaacactaattcat

SEQ ID NO: 2614 - DNA, 27 bp, Artificial Sequence
  Synthetic oligonucleotide
gtaatggtgtagaacactaattcataa

SEQ ID NO: 2615 - DNA, 27 bp, Artificial Sequence
  Synthetic oligonucleotide
aatggtgtagaacactaattcataatc

SEQ ID NO: 2616 - DNA, 27 bp, Artificial Sequence
  Synthetic oligonucleotide
tggtgtagaacactaattcataatcac

SEQ ID NO: 2617 - DNA, 27 bp, Artificial Sequence
  Synthetic oligonucleotide
gtgtagaacactaattcataatcactc

SEQ ID NO: 2618 - DNA, 27 bp, Artificial Sequence
  Synthetic oligonucleotide
gtagaacactaattcataatcactcta

SEQ ID NO: 2619 - DNA, 27 bp, Artificial Sequence
  Synthetic oligonucleotide
agaacactaattcataatcactctaat

SEQ ID NO: 2620 - DNA, 27 bp, Artificial Sequence
  Synthetic oligonucleotide
aattagtttcctttttaatatgcttaa

SEQ ID NO: 2621 - DNA, 27 bp, Artificial Sequence
  Synthetic oligonucleotide
ttagtttcctttttaatatgcttaaaa

SEQ ID NO: 2622 - DNA, 27 bp, Artificial Sequence
  Synthetic oligonucleotide
agtttcctttttaatatgcttaaaata

SEQ ID NO: 2623 - DNA, 27 bp, Artificial Sequence
  Synthetic oligonucleotide
tttcctttttaatatgcttaaaataag

SEQ ID NO: 2624 - DNA, 27 bp, Artificial Sequence
  Synthetic oligonucleotide
tcctttttaatatgcttaaaataagca

SEQ ID NO: 2625 - DNA, 27 bp, Artificial Sequence
  Synthetic oligonucleotide
cctttttaatatgcttaaaataagcag

SEQ ID NO: 2626 - DNA, 27 bp, Artificial Sequence
  Synthetic oligonucleotide
ctttttaatatgcttaaaataagcagg

SEQ ID NO: 2627 - DNA, 27 bp, Artificial Sequence
  Synthetic oligonucleotide
ttttaatatgcttaaaataagcaggtg

SEQ ID NO: 2628 - DNA, 27 bp, Artificial Sequence
  Synthetic oligonucleotide
ttaatatgcttaaaataagcaggtgga

SEQ ID NO: 2629 - DNA, 27 bp, Artificial Sequence
  Synthetic oligonucleotide
aatatgcttaaaataagcaggtggatc

SEQ ID NO: 2630 - DNA, 27 bp, Artificial Sequence
  Synthetic oligonucleotide
tatgcttaaaataagcaggtggatcta

SEQ ID NO: 2631 - DNA, 27 bp, Artificial Sequence
  Synthetic oligonucleotide
tgcttaaaataagcaggtggatctatt

SEQ ID NO: 2632 - DNA, 27 bp, Artificial Sequence
  Synthetic oligonucleotide
cttaaaataagcaggtggatctatttc

SEQ ID NO: 2633 - DNA, 27 bp, Artificial Sequence
  Synthetic oligonucleotide
taaaataagcaggtggatctatttcat

SEQ ID NO: 2634 - DNA, 27 bp, Artificial Sequence
  Synthetic oligonucleotide
aaataagcaggtggatctatttcatgt

SEQ ID NO: 2635 - DNA, 27 bp, Artificial Sequence
  Synthetic oligonucleotide
ataagcaggtggatctatttcatgttt

SEQ ID NO: 2636 - DNA, 27 bp, Artificial Sequence
  Synthetic oligonucleotide
aagcaggtggatctatttcatgttttt

SEQ ID NO: 2637 - DNA, 27 bp, Artificial Sequence
  Synthetic oligonucleotide
gcaggtggatctatttcatgtttttga

SEQ ID NO: 2638 - DNA, 27 bp, Artificial Sequence
  Synthetic oligonucleotide
aggtggatctatttcatgtttttgatc

SEQ ID NO: 2639 - DNA, 27 bp, Artificial Sequence
  Synthetic oligonucleotide
gtggatctatttcatgtttttgatcaa

SEQ ID NO: 2640 - DNA, 27 bp, Artificial Sequence
  Synthetic oligonucleotide
ggatctatttcatgtttttgatcaaaa

SEQ ID NO: 2641 - DNA, 27 bp, Artificial Sequence
  Synthetic oligonucleotide
gggtagggtaaatcagtaagaggtgtt

SEQ ID NO: 2642 - DNA, 27 bp, Artificial Sequence
  Synthetic oligonucleotide
gtagggtaaatcagtaagaggtgttat

SEQ ID NO: 2643 - DNA, 27 bp, Artificial Sequence
  Synthetic oligonucleotide
agggtaaatcagtaagaggtgttattt

SEQ ID NO: 2644 - DNA, 27 bp, Artificial Sequence
  Synthetic oligonucleotide
ggtaaatcagtaagaggtgttatttgg

SEQ ID NO: 2645 - DNA, 27 bp, Artificial Sequence
  Synthetic oligonucleotide
taaatcagtaagaggtgttatttggaa

SEQ ID NO: 2646 - DNA, 27 bp, Artificial Sequence
  Synthetic oligonucleotide
aatcagtaagaggtgttatttggaacc

SEQ ID NO: 2647 - DNA, 27 bp, Artificial Sequence
  Synthetic oligonucleotide
tttaccagttgccttttatcccaaagt

SEQ ID NO: 2648 - DNA, 27 bp, Artificial Sequence
  Synthetic oligonucleotide
taccagttgccttttatcccaaagttg

SEQ ID NO: 2649 - DNA, 27 bp, Artificial Sequence
  Synthetic oligonucleotide
ccagttgccttttatcccaaagttgtt

SEQ ID NO: 2650 - DNA, 27 bp, Artificial Sequence
  Synthetic oligonucleotide
agttgccttttatcccaaagttgttgt

SEQ ID NO: 2651 - DNA, 27 bp, Artificial Sequence
  Synthetic oligonucleotide
ttgccttttatcccaaagttgttgtaa

SEQ ID NO: 2652 - DNA, 27 bp, Artificial Sequence
  Synthetic oligonucleotide
gccttttatcccaaagttgttgtaacc

SEQ ID NO: 2653 - DNA, 27 bp, Artificial Sequence
  Synthetic oligonucleotide
cttttatcccaaagttgttgtaacctg

SEQ ID NO: 2654 - DNA, 27 bp, Artificial Sequence
  Synthetic oligonucleotide
tttatcccaaagttgttgtaacctgct

SEQ ID NO: 2655 - DNA, 27 bp, Artificial Sequence
  Synthetic oligonucleotide
tatcccaaagttgttgtaacctgctgt

SEQ ID NO: 2656 - DNA, 27 bp, Artificial Sequence
  Synthetic oligonucleotide
tcccaaagttgttgtaacctgctgtga

SEQ ID NO: 2657 - DNA, 27 bp, Artificial Sequence
  Synthetic oligonucleotide
ccaaagttgttgtaacctgctgtgata

SEQ ID NO: 2658 - DNA, 27 bp, Artificial Sequence
  Synthetic oligonucleotide
aaagttgttgtaacctgctgtgatacg

SEQ ID NO: 2659 - DNA, 27 bp, Artificial Sequence
  Synthetic oligonucleotide
agttgttgtaacctgctgtgatacgat

SEQ ID NO: 2660 - DNA, 27 bp, Artificial Sequence
  Synthetic oligonucleotide
ttgttgtaacctgctgtgatacgatgc

SEQ ID NO: 2661 - DNA, 27 bp, Artificial Sequence
  Synthetic oligonucleotide
aaaaatggttcagaattaaacttttaa

SEQ ID NO: 2662 - DNA, 27 bp, Artificial Sequence
  Synthetic oligonucleotide
aaatggttcagaattaaacttttaatt

SEQ ID NO: 2663 - DNA, 27 bp, Artificial Sequence
  Synthetic oligonucleotide
atggttcagaattaaacttttaattca

SEQ ID NO: 2664 - DNA, 27 bp, Artificial Sequence
  Synthetic oligonucleotide
ggttcagaattaaacttttaattcatt

SEQ ID NO: 2665 - DNA, 27 bp, Artificial Sequence
  Synthetic oligonucleotide
ttcagaattaaacttttaattcattcg

SEQ ID NO: 2666 - DNA, 27 bp, Artificial Sequence
  Synthetic oligonucleotide
cagcagcagtcttacttggattctgga

SEQ ID NO: 2667 - DNA, 27 bp, Artificial Sequence
  Synthetic oligonucleotide
ttacttggattctggaatccattctgg

SEQ ID NO: 2668 - DNA, 27 bp, Artificial Sequence
  Synthetic oligonucleotide
ttgacacctcccaagtcctttatgaat

SEQ ID NO: 2669 - DNA, 27 bp, Artificial Sequence
  Synthetic oligonucleotide
cacgcaagagcaagtagctgatattga

SEQ ID NO: 2670 - DNA, 27 bp, Artificial Sequence
  Synthetic oligonucleotide
tgccatgttccctgagacgctagatga

SEQ ID NO: 2671 - DNA, 27 bp, Artificial Sequence
  Synthetic oligonucleotide
gttgaaacatgcagttgtcaatttgat

SEQ ID NO: 2672 - DNA, 27 bp, Artificial Sequence
  Synthetic oligonucleotide
aacatgcagttgtcaatttgattaact

SEQ ID NO: 2673 - DNA, 27 bp, Artificial Sequence
  Synthetic oligonucleotide
cagttgtcaatttgattaactatcagg

SEQ ID NO: 2674 - DNA, 27 bp, Artificial Sequence
  Synthetic oligonucleotide
atgaggaccaggtggtagttaataaag

SEQ ID NO: 2675 - DNA, 27 bp, Artificial Sequence
  Synthetic oligonucleotide
tgggtcaccagtggattctgtactgtt

SEQ ID NO: 2676 - DNA, 27 bp, Artificial Sequence
  Synthetic oligonucleotide
accagtggattctgtactgttctacgc

SEQ ID NO: 2677 - DNA, 27 bp, Artificial Sequence
  Synthetic oligonucleotide
tggattctgtactgttctacgccatca

SEQ ID NO: 2678 - DNA, 27 bp, Artificial Sequence
  Synthetic oligonucleotide
tggtggactgcagaaaatggttgcttt

SEQ ID NO: 2679 - DNA, 27 bp, Artificial Sequence
  Synthetic oligonucleotide
aacgtgaaattcttggctattacaaca

SEQ ID NO: 2680 - DNA, 27 bp, Artificial Sequence
  Synthetic oligonucleotide
cccaagtcagcgacttgttcaaaactg

SEQ ID NO: 2681 - DNA, 27 bp, Artificial Sequence
  Synthetic oligonucleotide
gcgacttgttcaaaactgtctttggac

SEQ ID NO: 2682 - DNA, 27 bp, Artificial Sequence
  Synthetic oligonucleotide
caaaactgtctttggactctcagaaac

SEQ ID NO: 2683 - DNA, 27 bp, Artificial Sequence
  Synthetic oligonucleotide
ctctctaacctcacttgcaataattac

SEQ ID NO: 2684 - DNA, 27 bp, Artificial Sequence
  Synthetic oligonucleotide
acctcacttgcaataattacaaaaaca

SEQ ID NO: 2685 - DNA, 27 bp, Artificial Sequence
  Synthetic oligonucleotide
cagaatgccgttcgccttcattatgga

SEQ ID NO: 2686 - DNA, 27 bp, Artificial Sequence
  Synthetic oligonucleotide
tcgccttcattatggactgcctgttgt

SEQ ID NO: 2687 - DNA, 27 bp, Artificial Sequence
  Synthetic oligonucleotide
ttcattatggactgcctgttgtggtta

SEQ ID NO: 2688 - DNA, 27 bp, Artificial Sequence
  Synthetic oligonucleotide
tggactgcctgttgtggttaaactcct

SEQ ID NO: 2689 - DNA, 27 bp, Artificial Sequence
  Synthetic oligonucleotide
gcaactgttggattgattcgaaacctt

SEQ ID NO: 2690 - DNA, 27 bp, Artificial Sequence
  Synthetic oligonucleotide
ccgaggactcaataccattccattgtt

SEQ ID NO: 2691 - DNA, 27 bp, Artificial Sequence
  Synthetic oligonucleotide
ctgaggacaagccacaggattacaaga

SEQ ID NO: 2692 - DNA, 27 bp, Artificial Sequence
  Synthetic oligonucleotide
ggatggaccctatgatggagcatgaga

SEQ ID NO: 2693 - DNA, 27 bp, Artificial Sequence
  Synthetic oligonucleotide
ttgatactgacctgtaaatcgtccttt

SEQ ID NO: 2694 - DNA, 27 bp, Artificial Sequence
  Synthetic oligonucleotide
agccagtgtgggtgaatactttactct

SEQ ID NO: 2695 - DNA, 27 bp, Artificial Sequence
  Synthetic oligonucleotide
tgccacagcttttgcagcgttatactc

SEQ ID NO: 2696 - DNA, 27 bp, Artificial Sequence
  Synthetic oligonucleotide
gcttttgcagcgttatactcagatgag

SEQ ID NO: 2697 - DNA, 27 bp, Artificial Sequence
  Synthetic oligonucleotide
cagcgttatactcagatgagtaacatt

SEQ ID NO: 2698 - DNA, 27 bp, Artificial Sequence
  Synthetic oligonucleotide
acatttgctgttttcaacattaatagc

SEQ ID NO: 2699 - DNA, 27 bp, Artificial Sequence
  Synthetic oligonucleotide
agctgtagtgtctgaacgtgcattgtg

SEQ ID NO: 2700 - DNA, 27 bp, Artificial Sequence
  Synthetic oligonucleotide
gggaacagtcgaagtacgctttttgtt

SEQ ID NO: 2701 - DNA, 27 bp, Artificial Sequence
  Synthetic oligonucleotide
cagtcgaagtacgctttttgttctggt

SEQ ID NO: 2702 - DNA, 27 bp, Artificial Sequence
  Synthetic oligonucleotide
aagtacgctttttgttctggtcctttt

SEQ ID NO: 2703 - DNA, 27 bp, Artificial Sequence
  Synthetic oligonucleotide
accctagccttgcttgttctttgtttt

SEQ ID NO: 2704 - DNA, 27 bp, Artificial Sequence
  Synthetic oligonucleotide
agccttgcttgttctttgttttaatat

SEQ ID NO: 2705 - DNA, 27 bp, Artificial Sequence
  Synthetic oligonucleotide
tgaacctgctacagcaatttctgattt

SEQ ID NO: 2706 - DNA, 27 bp, Artificial Sequence
  Synthetic oligonucleotide
tacagcaatttctgatttctaagaacc

SEQ ID NO: 2707 - DNA, 27 bp, Artificial Sequence
  Synthetic oligonucleotide
cagtaagaggtgttatttgagccttgt

SEQ ID NO: 2708 - DNA, 27 bp, Artificial Sequence
  Synthetic oligonucleotide
gaggtgttatttgagccttgttttgga

SEQ ID NO: 2709 - DNA, 27 bp, Artificial Sequence
  Synthetic oligonucleotide
gttatttgagccttgttttggacagta

SEQ ID NO: 2710 - DNA, 27 bp, Artificial Sequence
  Synthetic oligonucleotide
ttgagccttgttttggacagtatacca

SEQ ID NO: 2711 - DNA, 27 bp, Artificial Sequence
  Synthetic oligonucleotide
ttcaacagatgcggttatagaaatggt

SEQ ID NO: 2712 - DNA, 27 bp, Artificial Sequence
  Synthetic oligonucleotide
cggttatagaaatggttcagaattaaa

SEQ ID NO: 2713 - DNA, 27 bp, Artificial Sequence
  Synthetic oligonucleotide
atagaaatggttcagaattaaactttt

SEQ ID NO: 2714 - DNA, 27 bp, Artificial Sequence
  Synthetic oligonucleotide
gttgtatggtatacttcaaataccctc

SEQ ID NO: 2715 - DNA, 27 bp, Artificial Sequence
  Synthetic oligonucleotide
caaaacagttgtatggtatacttcaaa

SEQ ID NO: 2716 - DNA, 27 bp, Artificial Sequence
  Synthetic oligonucleotide
tcaaaacagttgtatggtatacttcaa

SEQ ID NO: 2717 - DNA, 27 bp, Artificial Sequence
  Synthetic oligonucleotide
tttcaaaacagttgtatggtatacttc

SEQ ID NO: 2718 - DNA, 27 bp, Artificial Sequence
  Synthetic oligonucleotide
ttttcaaaacagttgtatggtatactt

SEQ ID NO: 2719 - DNA, 27 bp, Artificial Sequence
  Synthetic oligonucleotide
attttcaaaacagttgtatggtatact

SEQ ID NO: 2720 - DNA, 27 bp, Artificial Sequence
  Synthetic oligonucleotide
ttgtccacgctggattttcaaaacagt

SEQ ID NO: 2721 - DNA, 27 bp, Artificial Sequence
  Synthetic oligonucleotide
attgtccacgctggattttcaaaacag

SEQ ID NO: 2722 - DNA, 27 bp, Artificial Sequence
  Synthetic oligonucleotide
ccatcaaatcagcttgagtagccattg

SEQ ID NO: 2723 - DNA, 27 bp, Artificial Sequence
  Synthetic oligonucleotide
tgtccaactccatcaaatcagcttgag

SEQ ID NO: 2724 - DNA, 27 bp, Artificial Sequence
  Synthetic oligonucleotide
cttcctcaggattgcctttaccactca

SEQ ID NO: 2725 - DNA, 27 bp, Artificial Sequence
  Synthetic oligonucleotide
tcttcctcaggattgcctttaccactc

SEQ ID NO: 2726 - DNA, 27 bp, Artificial Sequence
  Synthetic oligonucleotide
catcaatatcagctacttgttcttgag

SEQ ID NO: 2727 - DNA, 27 bp, Artificial Sequence
  Synthetic oligonucleotide
ccatcaatatcagctacttgttcttga

SEQ ID NO: 2728 - DNA, 27 bp, Artificial Sequence
  Synthetic oligonucleotide
actgtccatcaatatcagctacttgtt

SEQ ID NO: 2729 - DNA, 27 bp, Artificial Sequence
  Synthetic oligonucleotide
attgcatactgtccatcaatatcagct

SEQ ID NO: 2730 - DNA, 27 bp, Artificial Sequence
  Synthetic oligonucleotide
cgagtcattgcatactgtccatcaata

SEQ ID NO: 2731 - DNA, 27 bp, Artificial Sequence
  Synthetic oligonucleotide
cctcatctaatgtctcagggaacatag

SEQ ID NO: 2732 - DNA, 27 bp, Artificial Sequence
  Synthetic oligonucleotide
ttacaactgcatgtttcagcatctgtg

SEQ ID NO: 2733 - DNA, 27 bp, Artificial Sequence
  Synthetic oligonucleotide
gtttacaactgcatgtttcagcatctg

SEQ ID NO: 2734 - DNA, 27 bp, Artificial Sequence
  Synthetic oligonucleotide
agttaatcaagtttacaactgcatgtt

SEQ ID NO: 2735 - DNA, 27 bp, Artificial Sequence
  Synthetic oligonucleotide
cttgatagttaatcaagtttacaactg

SEQ ID NO: 2736 - DNA, 27 bp, Artificial Sequence
  Synthetic oligonucleotide
ctgcatcatcttgatagttaatcaagt

SEQ ID NO: 2737 - DNA, 27 bp, Artificial Sequence
  Synthetic oligonucleotide
tctgcatcatcttgatagttaatcaag

SEQ ID NO: 2738 - DNA, 27 bp, Artificial Sequence
  Synthetic oligonucleotide
ctggtcctcgtcatttagcagttttgt

SEQ ID NO: 2739 - DNA, 27 bp, Artificial Sequence
  Synthetic oligonucleotide
cataactgcagccttattaaccaccac

SEQ ID NO: 2740 - DNA, 27 bp, Artificial Sequence
  Synthetic oligonucleotide
ccataactgcagccttattaaccacca

SEQ ID NO: 2741 - DNA, 27 bp, Artificial Sequence
  Synthetic oligonucleotide
ggaccataactgcagccttattaacca

SEQ ID NO: 2742 - DNA, 27 bp, Artificial Sequence
  Synthetic oligonucleotide
cctttttagaaagctgatggaccataa

SEQ ID NO: 2743 - DNA, 27 bp, Artificial Sequence
  Synthetic oligonucleotide
atggtacgtacaatagcagacaccatc

SEQ ID NO: 2744 - DNA, 27 bp, Artificial Sequence
  Synthetic oligonucleotide
catcatttgtattctgcatggtacgta

SEQ ID NO: 2745 - DNA, 27 bp, Artificial Sequence
  Synthetic oligonucleotide
ctgtttctacatcatttgtattctgca

SEQ ID NO: 2746 - DNA, 27 bp, Artificial Sequence
  Synthetic oligonucleotide
gctgtttctacatcatttgtattctgc

SEQ ID NO: 2747 - DNA, 27 bp, Artificial Sequence
  Synthetic oligonucleotide
gtacaacgagctgtttctacatcattt

SEQ ID NO: 2748 - DNA, 27 bp, Artificial Sequence
  Synthetic oligonucleotide
cggtacaacgagctgtttctacatcat

SEQ ID NO: 2749 - DNA, 27 bp, Artificial Sequence
  Synthetic oligonucleotide
gcggtacaacgagctgtttctacatca

SEQ ID NO: 2750 - DNA, 27 bp, Artificial Sequence
  Synthetic oligonucleotide
gcataaaacaacacagaatccactggt

SEQ ID NO: 2751 - DNA, 27 bp, Artificial Sequence
  Synthetic oligonucleotide
tggcataaaacaacacagaatccactg

SEQ ID NO: 2752 - DNA, 27 bp, Artificial Sequence
  Synthetic oligonucleotide
atggcataaaacaacacagaatccact

SEQ ID NO: 2753 - DNA, 27 bp, Artificial Sequence
  Synthetic oligonucleotide
tagctccttcttgatgtaataaaaggt

SEQ ID NO: 2754 - DNA, 27 bp, Artificial Sequence
  Synthetic oligonucleotide
ttagctccttcttgatgtaataaaagg

SEQ ID NO: 2755 - DNA, 27 bp, Artificial Sequence
  Synthetic oligonucleotide
tttaacatttgttttgttgagcaaggc

SEQ ID NO: 2756 - DNA, 27 bp, Artificial Sequence
  Synthetic oligonucleotide
tagccaagaatttaacatttgttttgt

SEQ ID NO: 2757 - DNA, 27 bp, Artificial Sequence
  Synthetic oligonucleotide
cgtaatagccaagaatttaacatttgt

SEQ ID NO: 2758 - DNA, 27 bp, Artificial Sequence
  Synthetic oligonucleotide
tcgtaatagccaagaatttaacatttg

SEQ ID NO: 2759 - DNA, 27 bp, Artificial Sequence
  Synthetic oligonucleotide
taagctaaaatttgaaggcagtctgtc

SEQ ID NO: 2760 - DNA, 27 bp, Artificial Sequence
  Synthetic oligonucleotide
taggtcctcattatatttactaaagct

SEQ ID NO: 2761 - DNA, 27 bp, Artificial Sequence
  Synthetic oligonucleotide
aagtataggtcctcattatatttacta

SEQ ID NO: 2762 - DNA, 27 bp, Artificial Sequence
  Synthetic oligonucleotide
taagtataggtcctcattatatttact

SEQ ID NO: 2763 - DNA, 27 bp, Artificial Sequence
  Synthetic oligonucleotide
gtttttcgtaagtataggtcctcatta

SEQ ID NO: 2764 - DNA, 27 bp, Artificial Sequence
  Synthetic oligonucleotide
agtttttcgtaagtataggtcctcatt

SEQ ID NO: 2765 - DNA, 27 bp, Artificial Sequence
  Synthetic oligonucleotide
tagtttttcgtaagtataggtcctcat

SEQ ID NO: 2766 - DNA, 27 bp, Artificial Sequence
  Synthetic oligonucleotide
gtagtttttcgtaagtataggtcctca

SEQ ID NO: 2767 - DNA, 27 bp, Artificial Sequence
  Synthetic oligonucleotide
gtggtccacagtagtttttcgtaagta

SEQ ID NO: 2768 - DNA, 27 bp, Artificial Sequence
  Synthetic oligonucleotide
tctacaatagccggcttattactagag

SEQ ID NO: 2769 - DNA, 27 bp, Artificial Sequence
  Synthetic oligonucleotide
cttctacaatagccggcttattactag

SEQ ID NO: 2770 - DNA, 27 bp, Artificial Sequence
  Synthetic oligonucleotide
agtcctaaagcttgcattccaccagct

SEQ ID NO: 2771 - DNA, 27 bp, Artificial Sequence
  Synthetic oligonucleotide
aagtcctaaagcttgcattccaccagc

SEQ ID NO: 2772 - DNA, 27 bp, Artificial Sequence
  Synthetic oligonucleotide
gaagtcctaaagcttgcattccaccag

SEQ ID NO: 2773 - DNA, 27 bp, Artificial Sequence
  Synthetic oligonucleotide
cagttctgaacaagacgttgacttgga

SEQ ID NO: 2774 - DNA, 27 bp, Artificial Sequence
  Synthetic oligonucleotide
acagttctgaacaagacgttgacttgg

SEQ ID NO: 2775 - DNA, 27 bp, Artificial Sequence
  Synthetic oligonucleotide
gagtccaaagacagttctgaacaagac

SEQ ID NO: 2776 - DNA, 27 bp, Artificial Sequence
  Synthetic oligonucleotide
ccttcctgtttagttgcagcatctgaa

SEQ ID NO: 2777 - DNA, 27 bp, Artificial Sequence
  Synthetic oligonucleotide
ccacatttatatcatctgaacccagaa

SEQ ID NO: 2778 - DNA, 27 bp, Artificial Sequence
  Synthetic oligonucleotide
tgaccacatttatatcatctgaaccca

SEQ ID NO: 2779 - DNA, 27 bp, Artificial Sequence
  Synthetic oligonucleotide
ctgcacaggtgaccacatttatatcat

SEQ ID NO: 2780 - DNA, 27 bp, Artificial Sequence
  Synthetic oligonucleotide
gctgcacaggtgaccacatttatatca

SEQ ID NO: 2781 - DNA, 27 bp, Artificial Sequence
  Synthetic oligonucleotide
attgcaagtgaggttagaaagaattcc

SEQ ID NO: 2782 - DNA, 27 bp, Artificial Sequence
  Synthetic oligonucleotide
ttataattattgcaagtgaggttagaa

SEQ ID NO: 2783 - DNA, 27 bp, Artificial Sequence
  Synthetic oligonucleotide
catcatcttgttcttataattattgca

SEQ ID NO: 2784 - DNA, 27 bp, Artificial Sequence
  Synthetic oligonucleotide
ccatcatcttgttcttataattattgc

SEQ ID NO: 2785 - DNA, 27 bp, Artificial Sequence
  Synthetic oligonucleotide
agaccatcatcttgttcttataattat

SEQ ID NO: 2786 - DNA, 27 bp, Artificial Sequence
  Synthetic oligonucleotide
gcagaccatcatcttgttcttataatt

SEQ ID NO: 2787 - DNA, 27 bp, Artificial Sequence
  Synthetic oligonucleotide
tcaatccaacagtagcctttatcagag

SEQ ID NO: 2788 - DNA, 27 bp, Artificial Sequence
  Synthetic oligonucleotide
tcgaatcaatccaacagtagcctttat

SEQ ID NO: 2789 - DNA, 27 bp, Artificial Sequence
  Synthetic oligonucleotide
cctccacaaattgctgctgtgtcccac

SEQ ID NO: 2790 - DNA, 27 bp, Artificial Sequence
  Synthetic oligonucleotide
gtacaaccttcaactatttcttccatg

SEQ ID NO: 2791 - DNA, 27 bp, Artificial Sequence
  Synthetic oligonucleotide
ggtacaaccttcaactatttcttccat

SEQ ID NO: 2792 - DNA, 27 bp, Artificial Sequence
  Synthetic oligonucleotide
cggtacaaccttcaactatttcttcca

SEQ ID NO: 2793 - DNA, 27 bp, Artificial Sequence
  Synthetic oligonucleotide
ccggtacaaccttcaactatttcttcc

SEQ ID NO: 2794 - DNA, 27 bp, Artificial Sequence
  Synthetic oligonucleotide
gggctccggtacaaccttcaactattt

SEQ ID NO: 2795 - DNA, 27 bp, Artificial Sequence
  Synthetic oligonucleotide
taacaattcggttgtgaacatcccgag

SEQ ID NO: 2796 - DNA, 27 bp, Artificial Sequence
  Synthetic oligonucleotide
ataacaattcggttgtgaacatcccga

SEQ ID NO: 2797 - DNA, 27 bp, Artificial Sequence
  Synthetic oligonucleotide
gataacaattcggttgtgaacatcccg

SEQ ID NO: 2798 - DNA, 27 bp, Artificial Sequence
  Synthetic oligonucleotide
tgataacaattcggttgtgaacatccc

SEQ ID NO: 2799 - DNA, 27 bp, Artificial Sequence
  Synthetic oligonucleotide
ctgataacaattcggttgtgaacatcc

SEQ ID NO: 2800 - DNA, 27 bp, Artificial Sequence
  Synthetic oligonucleotide
tctgataacaattcggttgtgaacatc

SEQ ID NO: 2801 - DNA, 27 bp, Artificial Sequence
  Synthetic oligonucleotide
gtatttagtcctctgataacaattcgg

SEQ ID NO: 2802 - DNA, 27 bp, Artificial Sequence
  Synthetic oligonucleotide
ggtatttagtcctctgataacaattcg

SEQ ID NO: 2803 - DNA, 27 bp, Artificial Sequence
  Synthetic oligonucleotide
tggtatttagtcctctgataacaattc

SEQ ID NO: 2804 - DNA, 27 bp, Artificial Sequence
  Synthetic oligonucleotide
atggtatttagtcctctgataacaatt

SEQ ID NO: 2805 - DNA, 27 bp, Artificial Sequence
  Synthetic oligonucleotide
aaacaatggaatggtatttagtcctct

SEQ ID NO: 2806 - DNA, 27 bp, Artificial Sequence
  Synthetic oligonucleotide
gcacaaacaatggaatggtatttagtc

SEQ ID NO: 2807 - DNA, 27 bp, Artificial Sequence
  Synthetic oligonucleotide
ctgcacaaacaatggaatggtatttag

SEQ ID NO: 2808 - DNA, 27 bp, Artificial Sequence
  Synthetic oligonucleotide
gctgcacaaacaatggaatggtattta

SEQ ID NO: 2809 - DNA, 27 bp, Artificial Sequence
  Synthetic oligonucleotide
cagctactctttggatgttttcaatgg

SEQ ID NO: 2810 - DNA, 27 bp, Artificial Sequence
  Synthetic oligonucleotide
gcagctactctttggatgttttcaatg

SEQ ID NO: 2811 - DNA, 27 bp, Artificial Sequence
  Synthetic oligonucleotide
cagcttcaatagcttctgcagcttcct

SEQ ID NO: 2812 - DNA, 27 bp, Artificial Sequence
  Synthetic oligonucleotide
gctccctcagcttcaatagcttctgca

SEQ ID NO: 2813 - DNA, 27 bp, Artificial Sequence
  Synthetic oligonucleotide
tggctccctcagcttcaatagcttctg

SEQ ID NO: 2814 - DNA, 27 bp, Artificial Sequence
  Synthetic oligonucleotide
tcattcctagagtgaagtaactctgtc

SEQ ID NO: 2815 - DNA, 27 bp, Artificial Sequence
  Synthetic oligonucleotide
cttcattcctagagtgaagtaactctg

SEQ ID NO: 2816 - DNA, 27 bp, Artificial Sequence
  Synthetic oligonucleotide
ccttcattcctagagtgaagtaactct

SEQ ID NO: 2817 - DNA, 27 bp, Artificial Sequence
  Synthetic oligonucleotide
tgtcctcagacattcggaacaaaacag

SEQ ID NO: 2818 - DNA, 27 bp, Artificial Sequence
  Synthetic oligonucleotide
cttgtcctcagacattcggaacaaaac

SEQ ID NO: 2819 - DNA, 27 bp, Artificial Sequence
  Synthetic oligonucleotide
ccgtttcttgtaatcttgtggcttgtc

SEQ ID NO: 2820 - DNA, 27 bp, Artificial Sequence
  Synthetic oligonucleotide
actgaaagccgtttcttgtaatcttgt

SEQ ID NO: 2821 - DNA, 27 bp, Artificial Sequence
  Synthetic oligonucleotide
cagctcaactgaaagccgtttcttgta

SEQ ID NO: 2822 - DNA, 27 bp, Artificial Sequence
  Synthetic oligonucleotide
caagtccaagatcagcagtctcattcc

SEQ ID NO: 2823 - DNA, 27 bp, Artificial Sequence
  Synthetic oligonucleotide
gcaccaatatcaagtccaagatcagca

SEQ ID NO: 2824 - DNA, 27 bp, Artificial Sequence
  Synthetic oligonucleotide
aaagaacgatagctaggatcatcctgg

SEQ ID NO: 2825 - DNA, 27 bp, Artificial Sequence
  Synthetic oligonucleotide
catatccaccagagtgaaaagaacgat

SEQ ID NO: 2826 - DNA, 27 bp, Artificial Sequence
  Synthetic oligonucleotide
tgatttacaggtcagtatcaaaccagg

SEQ ID NO: 2827 - DNA, 27 bp, Artificial Sequence
  Synthetic oligonucleotide
atgatttacaggtcagtatcaaaccag

SEQ ID NO: 2828 - DNA, 27 bp, Artificial Sequence
  Synthetic oligonucleotide
gatgatttacaggtcagtatcaaacca

SEQ ID NO: 2829 - DNA, 27 bp, Artificial Sequence
  Synthetic oligonucleotide
cttcttacctaaaggatgatttacagg

SEQ ID NO: 2830 - DNA, 27 bp, Artificial Sequence
  Synthetic oligonucleotide
acttcttacctaaaggatgatttacag

SEQ ID NO: 2831 - DNA, 27 bp, Artificial Sequence
  Synthetic oligonucleotide
aaacttcttacctaaaggatgatttac

SEQ ID NO: 2832 - DNA, 27 bp, Artificial Sequence
  Synthetic oligonucleotide
gctttttaaaacttcttacctaaagga

SEQ ID NO: 2833 - DNA, 27 bp, Artificial Sequence
  Synthetic oligonucleotide
tggctttttaaaacttcttacctaaag

SEQ ID NO: 2834 - DNA, 27 bp, Artificial Sequence
  Synthetic oligonucleotide
ccaaactggctttttaaaacttcttac

SEQ ID NO: 2835 - DNA, 27 bp, Artificial Sequence
  Synthetic oligonucleotide
ttacccaaactggctttttaaaacttc

SEQ ID NO: 2836 - DNA, 27 bp, Artificial Sequence
  Synthetic oligonucleotide
tttacccaaactggctttttaaaactt

SEQ ID NO: 2837 - DNA, 27 bp, Artificial Sequence
  Synthetic oligonucleotide
ttttacccaaactggctttttaaaact

SEQ ID NO: 2838 - DNA, 27 bp, Artificial Sequence
  Synthetic oligonucleotide
attttacccaaactggctttttaaaac

SEQ ID NO: 2839 - DNA, 27 bp, Artificial Sequence
  Synthetic oligonucleotide
ccaaccaagtctttctgaagttctgta

SEQ ID NO: 2840 - DNA, 27 bp, Artificial Sequence
  Synthetic oligonucleotide
ccaccctaccaaccaagtctttctgaa

SEQ ID NO: 2841 - DNA, 27 bp, Artificial Sequence
  Synthetic oligonucleotide
atttacaaatagcctaaaccactccca

SEQ ID NO: 2842 - DNA, 27 bp, Artificial Sequence
  Synthetic oligonucleotide
gatttacaaatagcctaaaccactccc

SEQ ID NO: 2843 - DNA, 27 bp, Artificial Sequence
  Synthetic oligonucleotide
agatttacaaatagcctaaaccactcc

SEQ ID NO: 2844 - DNA, 27 bp, Artificial Sequence
  Synthetic oligonucleotide
cagatttacaaatagcctaaaccactc

SEQ ID NO: 2845 - DNA, 27 bp, Artificial Sequence
  Synthetic oligonucleotide
tgtttttgtggcagatttacaaatagc

SEQ ID NO: 2846 - DNA, 27 bp, Artificial Sequence
  Synthetic oligonucleotide
ctgtttttgtggcagatttacaaatag

SEQ ID NO: 2847 - DNA, 27 bp, Artificial Sequence
  Synthetic oligonucleotide
cctgtttttgtggcagatttacaaata

SEQ ID NO: 2848 - DNA, 27 bp, Artificial Sequence
  Synthetic oligonucleotide
atatacctgtttttgtggcagatttac

SEQ ID NO: 2849 - DNA, 27 bp, Artificial Sequence
  Synthetic oligonucleotide
ctttcaaagtatatacctgtttttgtg

SEQ ID NO: 2850 - DNA, 27 bp, Artificial Sequence
  Synthetic oligonucleotide
catctcctttcaaagtatatacctgtt

SEQ ID NO: 2851 - DNA, 27 bp, Artificial Sequence
  Synthetic oligonucleotide
acatctcctttcaaagtatatacctgt

SEQ ID NO: 2852 - DNA, 27 bp, Artificial Sequence
  Synthetic oligonucleotide
agacatctcctttcaaagtatatacct

SEQ ID NO: 2853 - DNA, 27 bp, Artificial Sequence
  Synthetic oligonucleotide
aagacatctcctttcaaagtatatacc

SEQ ID NO: 2854 - DNA, 27 bp, Artificial Sequence
  Synthetic oligonucleotide
caagacatctcctttcaaagtatatac

SEQ ID NO: 2855 - DNA, 27 bp, Artificial Sequence
  Synthetic oligonucleotide
tgttccaagacatctcctttcaaagta

SEQ ID NO: 2856 - DNA, 27 bp, Artificial Sequence
  Synthetic oligonucleotide
cattccaatgttccaagacatctcctt

SEQ ID NO: 2857 - DNA, 27 bp, Artificial Sequence
  Synthetic oligonucleotide
acattccaatgttccaagacatctcct

SEQ ID NO: 2858 - DNA, 27 bp, Artificial Sequence
  Synthetic oligonucleotide
gaacattccaatgttccaagacatctc

SEQ ID NO: 2859 - DNA, 27 bp, Artificial Sequence
  Synthetic oligonucleotide
ccagaaatctgagaacattccaatgtt

SEQ ID NO: 2860 - DNA, 27 bp, Artificial Sequence
  Synthetic oligonucleotide
acaaccagaaatctgagaacattccaa

SEQ ID NO: 2861 - DNA, 27 bp, Artificial Sequence
  Synthetic oligonucleotide
taacaaccagaaatctgagaacattcc

SEQ ID NO: 2862 - DNA, 27 bp, Artificial Sequence
  Synthetic oligonucleotide
ataacaaccagaaatctgagaacattc

SEQ ID NO: 2863 - DNA, 27 bp, Artificial Sequence
  Synthetic oligonucleotide
cataacaaccagaaatctgagaacatt

SEQ ID NO: 2864 - DNA, 27 bp, Artificial Sequence
  Synthetic oligonucleotide
tgatcacataacaaccagaaatctgag

SEQ ID NO: 2865 - DNA, 27 bp, Artificial Sequence
  Synthetic oligonucleotide
atgatcacataacaaccagaaatctga

SEQ ID NO: 2866 - DNA, 27 bp, Artificial Sequence
  Synthetic oligonucleotide
ccacacatgatcacataacaaccagaa

SEQ ID NO: 2867 - DNA, 27 bp, Artificial Sequence
  Synthetic oligonucleotide
cttccacacatgatcacataacaacca

SEQ ID NO: 2868 - DNA, 27 bp, Artificial Sequence
  Synthetic oligonucleotide
aataacttccacacatgatcacataac

SEQ ID NO: 2869 - DNA, 27 bp, Artificial Sequence
  Synthetic oligonucleotide
taataacttccacacatgatcacataa

SEQ ID NO: 2870 - DNA, 27 bp, Artificial Sequence
  Synthetic oligonucleotide
ttaataacttccacacatgatcacata

SEQ ID NO: 2871 - DNA, 27 bp, Artificial Sequence
  Synthetic oligonucleotide
gttaataacttccacacatgatcacat

SEQ ID NO: 2872 - DNA, 27 bp, Artificial Sequence
  Synthetic oligonucleotide
cattaaagttaataacttccacacatg

SEQ ID NO: 2873 - DNA, 27 bp, Artificial Sequence
  Synthetic oligonucleotide
acattaaagttaataacttccacacat

SEQ ID NO: 2874 - DNA, 27 bp, Artificial Sequence
  Synthetic oligonucleotide
aaacattaaagttaataacttccacac

SEQ ID NO: 2875 - DNA, 27 bp, Artificial Sequence
  Synthetic oligonucleotide
aaaacattaaagttaataacttccaca

SEQ ID NO: 2876 - DNA, 27 bp, Artificial Sequence
  Synthetic oligonucleotide
aaaaacattaaagttaataacttccac

SEQ ID NO: 2877 - DNA, 27 bp, Artificial Sequence
  Synthetic oligonucleotide
aaaaaacattaaagttaataacttcca

SEQ ID NO: 2878 - DNA, 27 bp, Artificial Sequence
  Synthetic oligonucleotide
caaaaaacattaaagttaataacttcc

SEQ ID NO: 2879 - DNA, 27 bp, Artificial Sequence
  Synthetic oligonucleotide
gcaaaaaacattaaagttaataacttc

SEQ ID NO: 2880 - DNA, 27 bp, Artificial Sequence
  Synthetic oligonucleotide
tggcaaaaaacattaaagttaataact

SEQ ID NO: 2881 - DNA, 27 bp, Artificial Sequence
  Synthetic oligonucleotide
gtggcaaaaaacattaaagttaataac

SEQ ID NO: 2882 - DNA, 27 bp, Artificial Sequence
  Synthetic oligonucleotide
ttgcaaaagctgtggcaaaaaacatta

SEQ ID NO: 2883 - DNA, 27 bp, Artificial Sequence
  Synthetic oligonucleotide
gttgcaaaagctgtggcaaaaaacatt

SEQ ID NO: 2884 - DNA, 27 bp, Artificial Sequence
  Synthetic oligonucleotide
actcatttgagtattaagttgcaaaag

SEQ ID NO: 2885 - DNA, 27 bp, Artificial Sequence
  Synthetic oligonucleotide
ttaaaacagcaaatgttactcatttga

SEQ ID NO: 2886 - DNA, 27 bp, Artificial Sequence
  Synthetic oligonucleotide
tttaaaacagcaaatgttactcatttg

SEQ ID NO: 2887 - DNA, 27 bp, Artificial Sequence
  Synthetic oligonucleotide
gtttaaaacagcaaatgttactcattt

SEQ ID NO: 2888 - DNA, 27 bp, Artificial Sequence
  Synthetic oligonucleotide
tgtttaaaacagcaaatgttactcatt

SEQ ID NO: 2889 - DNA, 27 bp, Artificial Sequence
  Synthetic oligonucleotide
atgtttaaaacagcaaatgttactcat

SEQ ID NO: 2890 - DNA, 27 bp, Artificial Sequence
  Synthetic oligonucleotide
aatgtttaaaacagcaaatgttactca

SEQ ID NO: 2891 - DNA, 27 bp, Artificial Sequence
  Synthetic oligonucleotide
ctattaatgtttaaaacagcaaatgtt

SEQ ID NO: 2892 - DNA, 27 bp, Artificial Sequence
  Synthetic oligonucleotide
agagaaaggctgctattaatgtttaaa

SEQ ID NO: 2893 - DNA, 27 bp, Artificial Sequence
  Synthetic oligonucleotide
caagttcagacaatacagctgtataaa

SEQ ID NO: 2894 - DNA, 27 bp, Artificial Sequence
  Synthetic oligonucleotide
tcacaatgcaagttcagacaatacagc

SEQ ID NO: 2895 - DNA, 27 bp, Artificial Sequence
  Synthetic oligonucleotide
aatcacaatgcaagttcagacaataca

SEQ ID NO: 2896 - DNA, 27 bp, Artificial Sequence
  Synthetic oligonucleotide
ccaatcacaatgcaagttcagacaata

SEQ ID NO: 2897 - DNA, 27 bp, Artificial Sequence
  Synthetic oligonucleotide
caggccaatcacaatgcaagttcagac

SEQ ID NO: 2898 - DNA, 27 bp, Artificial Sequence
  Synthetic oligonucleotide
ttgttcccataggaaactcagcttggt

SEQ ID NO: 2899 - DNA, 27 bp, Artificial Sequence
  Synthetic oligonucleotide
cttcaattgttcccataggaaactcag

SEQ ID NO: 2900 - DNA, 27 bp, Artificial Sequence
  Synthetic oligonucleotide
acttcaattgttcccataggaaactca

SEQ ID NO: 2901 - DNA, 27 bp, Artificial Sequence
  Synthetic oligonucleotide
aagtttacttcaattgttcccatagga

SEQ ID NO: 2902 - DNA, 27 bp, Artificial Sequence
  Synthetic oligonucleotide
aaagtttacttcaattgttcccatagg

SEQ ID NO: 2903 - DNA, 27 bp, Artificial Sequence
  Synthetic oligonucleotide
acaaaaagtttacttcaattgttccca

SEQ ID NO: 2904 - DNA, 27 bp, Artificial Sequence
  Synthetic oligonucleotide
cagaacaaaaagtttacttcaattgtt

SEQ ID NO: 2905 - DNA, 27 bp, Artificial Sequence
  Synthetic oligonucleotide
aggaccagaacaaaaagtttacttcaa

SEQ ID NO: 2906 - DNA, 27 bp, Artificial Sequence
  Synthetic oligonucleotide
aaggaccagaacaaaaagtttacttca

SEQ ID NO: 2907 - DNA, 27 bp, Artificial Sequence
  Synthetic oligonucleotide
cgaccaaaaaggaccagaacaaaaagt

SEQ ID NO: 2908 - DNA, 27 bp, Artificial Sequence
  Synthetic oligonucleotide
tcgaccaaaaaggaccagaacaaaaag

SEQ ID NO: 2909 - DNA, 27 bp, Artificial Sequence
  Synthetic oligonucleotide
ttactcctcgaccaaaaaggaccagaa

SEQ ID NO: 2910 - DNA, 27 bp, Artificial Sequence
  Synthetic oligonucleotide
aatccatttgtattgttactcctcgac

SEQ ID NO: 2911 - DNA, 27 bp, Artificial Sequence
  Synthetic oligonucleotide
aaatccatttgtattgttactcctcga

SEQ ID NO: 2912 - DNA, 27 bp, Artificial Sequence
  Synthetic oligonucleotide
aaaatccatttgtattgttactcctcg

SEQ ID NO: 2913 - DNA, 27 bp, Artificial Sequence
  Synthetic oligonucleotide
caaaatccatttgtattgttactcctc

SEQ ID NO: 2914 - DNA, 27 bp, Artificial Sequence
  Synthetic oligonucleotide
ccaaaatccatttgtattgttactcct

SEQ ID NO: 2915 - DNA, 27 bp, Artificial Sequence
  Synthetic oligonucleotide
tcactcccaaaatccatttgtattgtt

SEQ ID NO: 2916 - DNA, 27 bp, Artificial Sequence
  Synthetic oligonucleotide
tcttcacttcttgagtcactcccaaaa

SEQ ID NO: 2917 - DNA, 27 bp, Artificial Sequence
  Synthetic oligonucleotide
attcttcacttcttgagtcactcccaa

SEQ ID NO: 2918 - DNA, 27 bp, Artificial Sequence
  Synthetic oligonucleotide
cattcttcacttcttgagtcactccca

SEQ ID NO: 2919 - DNA, 27 bp, Artificial Sequence
  Synthetic oligonucleotide
gcattcttcacttcttgagtcactccc

SEQ ID NO: 2920 - DNA, 27 bp, Artificial Sequence
  Synthetic oligonucleotide
gtgcattcttcacttcttgagtcactc

SEQ ID NO: 2921 - DNA, 27 bp, Artificial Sequence
  Synthetic oligonucleotide
ccattcttgtgcattcttcacttcttg

SEQ ID NO: 2922 - DNA, 27 bp, Artificial Sequence
  Synthetic oligonucleotide
gatccattcttgtgcattcttcacttc

SEQ ID NO: 2923 - DNA, 27 bp, Artificial Sequence
  Synthetic oligonucleotide
tgatccattcttgtgcattcttcactt

SEQ ID NO: 2924 - DNA, 27 bp, Artificial Sequence
  Synthetic oligonucleotide
gtgatccattcttgtgcattcttcact

SEQ ID NO: 2925 - DNA, 27 bp, Artificial Sequence
  Synthetic oligonucleotide
taaattccatcttgtgatccattcttg

SEQ ID NO: 2926 - DNA, 27 bp, Artificial Sequence
  Synthetic oligonucleotide
gataaattccatcttgtgatccattct

SEQ ID NO: 2927 - DNA, 27 bp, Artificial Sequence
  Synthetic oligonucleotide
tgataaattccatcttgtgatccattc

SEQ ID NO: 2928 - DNA, 27 bp, Artificial Sequence
  Synthetic oligonucleotide
ttgataaattccatcttgtgatccatt

SEQ ID NO: 2929 - DNA, 27 bp, Artificial Sequence
  Synthetic oligonucleotide
tttgataaattccatcttgtgatccat

SEQ ID NO: 2930 - DNA, 27 bp, Artificial Sequence
  Synthetic oligonucleotide
aaggctagggtttgataaattccatct

SEQ ID NO: 2931 - DNA, 27 bp, Artificial Sequence
  Synthetic oligonucleotide
aaaaaaatttaacaagcaaggctaggg

SEQ ID NO: 2932 - DNA, 27 bp, Artificial Sequence
  Synthetic oligonucleotide
aaaaaaaaaaaaaaaatttaacaagca

SEQ ID NO: 2933 - DNA, 27 bp, Artificial Sequence
  Synthetic oligonucleotide
aaaaaaaaaaaaaaaaatttaacaagc

SEQ ID NO: 2934 - DNA, 27 bp, Artificial Sequence
  Synthetic oligonucleotide
aaaaaaaaaaaaaaaaaatttaacaag

SEQ ID NO: 2935 - DNA, 27 bp, Artificial Sequence
  Synthetic oligonucleotide
aaaaaaaaaaaaaaaaaaatttaacaa

SEQ ID NO: 2936 - DNA, 27 bp, Artificial Sequence
  Synthetic oligonucleotide
taaaaaaaaaaaaaaaaaaatttaaca

SEQ ID NO: 2937 - DNA, 27 bp, Artificial Sequence
  Synthetic oligonucleotide
ttaaaaaaaaaaaaaaaaaaatttaac

SEQ ID NO: 2938 - DNA, 27 bp, Artificial Sequence
  Synthetic oligonucleotide
cttaaaaaaaaaaaaaaaaaaatttaa

SEQ ID NO: 2939 - DNA, 27 bp, Artificial Sequence
  Synthetic oligonucleotide
tcttaaaaaaaaaaaaaaaaaaattta

SEQ ID NO: 2940 - DNA, 27 bp, Artificial Sequence
  Synthetic oligonucleotide
attcttaaaaaaaaaaaaaaaaaaatt

SEQ ID NO: 2941 - DNA, 27 bp, Artificial Sequence
  Synthetic oligonucleotide
tattcttaaaaaaaaaaaaaaaaaaat

SEQ ID NO: 2942 - DNA, 27 bp, Artificial Sequence
  Synthetic oligonucleotide
atattcttaaaaaaaaaaaaaaaaaaa

SEQ ID NO: 2943 - DNA, 27 bp, Artificial Sequence
  Synthetic oligonucleotide
gatattcttaaaaaaaaaaaaaaaaaa

SEQ ID NO: 2944 - DNA, 27 bp, Artificial Sequence
  Synthetic oligonucleotide
agatattcttaaaaaaaaaaaaaaaaa

SEQ ID NO: 2945 - DNA, 27 bp, Artificial Sequence
  Synthetic oligonucleotide
cagatattcttaaaaaaaaaaaaaaaa

SEQ ID NO: 2946 - DNA, 27 bp, Artificial Sequence
  Synthetic oligonucleotide
acagatattcttaaaaaaaaaaaaaaa

SEQ ID NO: 2947 - DNA, 27 bp, Artificial Sequence
  Synthetic oligonucleotide
cattacagatattcttaaaaaaaaaaa

SEQ ID NO: 2948 - DNA, 27 bp, Artificial Sequence
  Synthetic oligonucleotide
ccattacagatattcttaaaaaaaaaa

SEQ ID NO: 2949 - DNA, 27 bp, Artificial Sequence
  Synthetic oligonucleotide
agtaccattacagatattcttaaaaaa

SEQ ID NO: 2950 - DNA, 27 bp, Artificial Sequence
  Synthetic oligonucleotide
cagtaccattacagatattcttaaaaa

SEQ ID NO: 2951 - DNA, 27 bp, Artificial Sequence
  Synthetic oligonucleotide
tcagtaccattacagatattcttaaaa

SEQ ID NO: 2952 - DNA, 27 bp, Artificial Sequence
  Synthetic oligonucleotide
aaagtcagtaccattacagatattctt

SEQ ID NO: 2953 - DNA, 27 bp, Artificial Sequence
  Synthetic oligonucleotide
gctacttcaaagcaagcaaagtcagta

SEQ ID NO: 2954 - DNA, 27 bp, Artificial Sequence
  Synthetic oligonucleotide
aaaaaaagagctacttcaaagcaagca

SEQ ID NO: 2955 - DNA, 27 bp, Artificial Sequence
  Synthetic oligonucleotide
aaaaaaaaaaaagagctacttcaaagc

SEQ ID NO: 2956 - DNA, 27 bp, Artificial Sequence
  Synthetic oligonucleotide
aaaaaaaaaaaaagagctacttcaaag

SEQ ID NO: 2957 - DNA, 27 bp, Artificial Sequence
  Synthetic oligonucleotide
aaaaaaaaaaaaaaagagctacttcaa

SEQ ID NO: 2958 - DNA, 27 bp, Artificial Sequence
  Synthetic oligonucleotide
aaaaaaaaaaaaaaaagagctacttca

SEQ ID NO: 2959 - DNA, 27 bp, Artificial Sequence
  Synthetic oligonucleotide
aaaaaaaaaaaaaaaaagagctacttc

SEQ ID NO: 2960 - DNA, 27 bp, Artificial Sequence
  Synthetic oligonucleotide
aaaaaaaaaaaaaaaaaagagctactt

SEQ ID NO: 2961 - DNA, 27 bp, Artificial Sequence
  Synthetic oligonucleotide
aaaaaaaaaaaaaaaaaaaaaaaagag

SEQ ID NO: 2962 - DNA, 27 bp, Artificial Sequence
  Synthetic oligonucleotide
aaaaaaaaaaaaaaaaaaaaaaaaaga

SEQ ID NO: 2963 - DNA, 27 bp, Artificial Sequence
  Synthetic oligonucleotide
caaaaaaaaaaaaaaaaaaaaaaaaag

SEQ ID NO: 2964 - DNA, 27 bp, Artificial Sequence
  Synthetic oligonucleotide
gcaaaaaaaaaaaaaaaaaaaaaaaaa

SEQ ID NO: 2965 - DNA, 27 bp, Artificial Sequence
  Synthetic oligonucleotide
ctgcaaaaaaaaaaaaaaaaaaaaaaa

SEQ ID NO: 2966 - DNA, 27 bp, Artificial Sequence
  Synthetic oligonucleotide
actgcaaaaaaaaaaaaaaaaaaaaaa

SEQ ID NO: 2967 - DNA, 27 bp, Artificial Sequence
  Synthetic oligonucleotide
agttactgcaaaaaaaaaaaaaaaaaa

SEQ ID NO: 2968 - DNA, 27 bp, Artificial Sequence
  Synthetic oligonucleotide
cagttactgcaaaaaaaaaaaaaaaaa

SEQ ID NO: 2969 - DNA, 27 bp, Artificial Sequence
  Synthetic oligonucleotide
acagttactgcaaaaaaaaaaaaaaaa

SEQ ID NO: 2970 - DNA, 27 bp, Artificial Sequence
  Synthetic oligonucleotide
aaaaacagttactgcaaaaaaaaaaaa

SEQ ID NO: 2971 - DNA, 27 bp, Artificial Sequence
  Synthetic oligonucleotide
aaaaaacagttactgcaaaaaaaaaaa

SEQ ID NO: 2972 - DNA, 27 bp, Artificial Sequence
  Synthetic oligonucleotide
taaaaaacagttactgcaaaaaaaaaa

SEQ ID NO: 2973 - DNA, 27 bp, Artificial Sequence
  Synthetic oligonucleotide
cttaaaaaacagttactgcaaaaaaaa

SEQ ID NO: 2974 - DNA, 27 bp, Artificial Sequence
  Synthetic oligonucleotide
acttaaaaaacagttactgcaaaaaaa

SEQ ID NO: 2975 - DNA, 27 bp, Artificial Sequence
  Synthetic oligonucleotide
agacttaaaaaacagttactgcaaaaa

SEQ ID NO: 2976 - DNA, 27 bp, Artificial Sequence
  Synthetic oligonucleotide
acactacgagagacttaaaaaacagtt

SEQ ID NO: 2977 - DNA, 27 bp, Artificial Sequence
  Synthetic oligonucleotide
taacactacgagagacttaaaaaacag

SEQ ID NO: 2978 - DNA, 27 bp, Artificial Sequence
  Synthetic oligonucleotide
ttaacactacgagagacttaaaaaaca

SEQ ID NO: 2979 - DNA, 27 bp, Artificial Sequence
  Synthetic oligonucleotide
acttaacactacgagagacttaaaaaa

SEQ ID NO: 2980 - DNA, 27 bp, Artificial Sequence
  Synthetic oligonucleotide
ataacttaacactacgagagacttaaa

SEQ ID NO: 2981 - DNA, 27 bp, Artificial Sequence
  Synthetic oligonucleotide
tataacttaacactacgagagacttaa

SEQ ID NO: 2982 - DNA, 27 bp, Artificial Sequence
  Synthetic oligonucleotide
gtattcactataacttaacactacgag

SEQ ID NO: 2983 - DNA, 27 bp, Artificial Sequence
  Synthetic oligonucleotide
agtattcactataacttaacactacga

SEQ ID NO: 2984 - DNA, 27 bp, Artificial Sequence
  Synthetic oligonucleotide
cagtattcactataacttaacactacg

SEQ ID NO: 2985 - DNA, 27 bp, Artificial Sequence
  Synthetic oligonucleotide
gcagtattcactataacttaacactac

SEQ ID NO: 2986 - DNA, 27 bp, Artificial Sequence
  Synthetic oligonucleotide
agaaattgctgtagcagtattcactat

SEQ ID NO: 2987 - DNA, 27 bp, Artificial Sequence
  Synthetic oligonucleotide
tagaaattgctgtagcagtattcacta

SEQ ID NO: 2988 - DNA, 27 bp, Artificial Sequence
  Synthetic oligonucleotide
ttagaaattgctgtagcagtattcact

SEQ ID NO: 2989 - DNA, 27 bp, Artificial Sequence
  Synthetic oligonucleotide
actcaattcttaaaaattagaaattgc

SEQ ID NO: 2990 - DNA, 27 bp, Artificial Sequence
  Synthetic oligonucleotide
ccattactcaattcttaaaaattagaa

SEQ ID NO: 2991 - DNA, 27 bp, Artificial Sequence
  Synthetic oligonucleotide
acaccattactcaattcttaaaaatta

SEQ ID NO: 2992 - DNA, 27 bp, Artificial Sequence
  Synthetic oligonucleotide
ctacaccattactcaattcttaaaaat

SEQ ID NO: 2993 - DNA, 27 bp, Artificial Sequence
  Synthetic oligonucleotide
tctacaccattactcaattcttaaaaa

SEQ ID NO: 2994 - DNA, 27 bp, Artificial Sequence
  Synthetic oligonucleotide
gttctacaccattactcaattcttaaa

SEQ ID NO: 2995 - DNA, 27 bp, Artificial Sequence
  Synthetic oligonucleotide
gtgttctacaccattactcaattctta

SEQ ID NO: 2996 - DNA, 27 bp, Artificial Sequence
  Synthetic oligonucleotide
atgaattagtgttctacaccattactc

SEQ ID NO: 2997 - DNA, 27 bp, Artificial Sequence
  Synthetic oligonucleotide
tgattatgaattagtgttctacaccat

SEQ ID NO: 2998 - DNA, 27 bp, Artificial Sequence
  Synthetic oligonucleotide
gtgattatgaattagtgttctacacca

SEQ ID NO: 2999 - DNA, 27 bp, Artificial Sequence
  Synthetic oligonucleotide
agtgattatgaattagtgttctacacc

SEQ ID NO: 3000 - DNA, 27 bp, Artificial Sequence
  Synthetic oligonucleotide
attaattagagtgattatgaattagtg

SEQ ID NO: 3001 - DNA, 27 bp, Artificial Sequence
  Synthetic oligonucleotide
aattaattagagtgattatgaattagt

SEQ ID NO: 3002 - DNA, 27 bp, Artificial Sequence
  Synthetic oligonucleotide
caattaattagagtgattatgaattag

SEQ ID NO: 3003 - DNA, 27 bp, Artificial Sequence
  Synthetic oligonucleotide
attacaattaattagagtgattatgaa

SEQ ID NO: 3004 - DNA, 27 bp, Artificial Sequence
  Synthetic oligonucleotide
gattacaattaattagagtgattatga

SEQ ID NO: 3005 - DNA, 27 bp, Artificial Sequence
  Synthetic oligonucleotide
agattacaattaattagagtgattatg

SEQ ID NO: 3006 - DNA, 27 bp, Artificial Sequence
  Synthetic oligonucleotide
ctttattcagattacaattaattagag

SEQ ID NO: 3007 - DNA, 27 bp, Artificial Sequence
  Synthetic oligonucleotide
actttattcagattacaattaattaga

SEQ ID NO: 3008 - DNA, 27 bp, Artificial Sequence
  Synthetic oligonucleotide
ttacactttattcagattacaattaat

SEQ ID NO: 3009 - DNA, 27 bp, Artificial Sequence
  Synthetic oligonucleotide
gttacactttattcagattacaattaa

SEQ ID NO: 3010 - DNA, 27 bp, Artificial Sequence
  Synthetic oligonucleotide
tgttacactttattcagattacaatta

SEQ ID NO: 3011 - DNA, 27 bp, Artificial Sequence
  Synthetic oligonucleotide
ttgttacactttattcagattacaatt

SEQ ID NO: 3012 - DNA, 27 bp, Artificial Sequence
  Synthetic oligonucleotide
attgttacactttattcagattacaat

SEQ ID NO: 3013 - DNA, 27 bp, Artificial Sequence
  Synthetic oligonucleotide
ctacacaattgttacactttattcaga

SEQ ID NO: 3014 - DNA, 27 bp, Artificial Sequence
  Synthetic oligonucleotide
aaggctacacaattgttacactttatt

SEQ ID NO: 3015 - DNA, 27 bp, Artificial Sequence
  Synthetic oligonucleotide
acaaaaaggctacacaattgttacact

SEQ ID NO: 3016 - DNA, 27 bp, Artificial Sequence
  Synthetic oligonucleotide
ttttatacaaaaaggctacacaattgt

SEQ ID NO: 3017 - DNA, 27 bp, Artificial Sequence
  Synthetic oligonucleotide
attttatacaaaaaggctacacaattg

SEQ ID NO: 3018 - DNA, 27 bp, Artificial Sequence
  Synthetic oligonucleotide
ctattttatacaaaaaggctacacaat

SEQ ID NO: 3019 - DNA, 27 bp, Artificial Sequence
  Synthetic oligonucleotide
tctattttatacaaaaaggctacacaa

SEQ ID NO: 3020 - DNA, 27 bp, Artificial Sequence
  Synthetic oligonucleotide
tgtctattttatacaaaaaggctacac

SEQ ID NO: 3021 - DNA, 27 bp, Artificial Sequence
  Synthetic oligonucleotide
tctatttgtctattttatacaaaaagg

SEQ ID NO: 3022 - DNA, 27 bp, Artificial Sequence
  Synthetic oligonucleotide
tttctatttgtctattttatacaaaaa

SEQ ID NO: 3023 - DNA, 27 bp, Artificial Sequence
  Synthetic oligonucleotide
ttttctatttgtctattttatacaaaa

SEQ ID NO: 3024 - DNA, 27 bp, Artificial Sequence
  Synthetic oligonucleotide
attttctatttgtctattttatacaaa

SEQ ID NO: 3025 - DNA, 27 bp, Artificial Sequence
  Synthetic oligonucleotide
cattttctatttgtctattttatacaa

SEQ ID NO: 3026 - DNA, 27 bp, Artificial Sequence
  Synthetic oligonucleotide
ccattttctatttgtctattttataca

SEQ ID NO: 3027 - DNA, 27 bp, Artificial Sequence
  Synthetic oligonucleotide
ggaccattttctatttgtctattttat

SEQ ID NO: 3028 - DNA, 27 bp, Artificial Sequence
  Synthetic oligonucleotide
tggaccattttctatttgtctatttta

SEQ ID NO: 3029 - DNA, 27 bp, Artificial Sequence
  Synthetic oligonucleotide
ttggaccattttctatttgtctatttt

SEQ ID NO: 3030 - DNA, 27 bp, Artificial Sequence
  Synthetic oligonucleotide
aaactaattggaccattttctatttgt

SEQ ID NO: 3031 - DNA, 27 bp, Artificial Sequence
  Synthetic oligonucleotide
gaaactaattggaccattttctatttg

SEQ ID NO: 3032 - DNA, 27 bp, Artificial Sequence
  Synthetic oligonucleotide
ggaaactaattggaccattttctattt

SEQ ID NO: 3033 - DNA, 27 bp, Artificial Sequence
  Synthetic oligonucleotide
aggaaactaattggaccattttctatt

SEQ ID NO: 3034 - DNA, 27 bp, Artificial Sequence
  Synthetic oligonucleotide
ttaaaaaggaaactaattggaccattt

SEQ ID NO: 3035 - DNA, 27 bp, Artificial Sequence
  Synthetic oligonucleotide
attaaaaaggaaactaattggaccatt

SEQ ID NO: 3036 - DNA, 27 bp, Artificial Sequence
  Synthetic oligonucleotide
aagcatattaaaaaggaaactaattgg

SEQ ID NO: 3037 - DNA, 27 bp, Artificial Sequence
  Synthetic oligonucleotide
taagcatattaaaaaggaaactaattg

SEQ ID NO: 3038 - DNA, 27 bp, Artificial Sequence
  Synthetic oligonucleotide
attttaagcatattaaaaaggaaacta

SEQ ID NO: 3039 - DNA, 27 bp, Artificial Sequence
  Synthetic oligonucleotide
ctgcttattttaagcatattaaaaagg

SEQ ID NO: 3040 - DNA, 27 bp, Artificial Sequence
  Synthetic oligonucleotide
cctgcttattttaagcatattaaaaag

SEQ ID NO: 3041 - DNA, 27 bp, Artificial Sequence
  Synthetic oligonucleotide
gatccacctgcttattttaagcatatt

SEQ ID NO: 3042 - DNA, 27 bp, Artificial Sequence
  Synthetic oligonucleotide
caaaaacatgaaatagatccacctgct

SEQ ID NO: 3043 - DNA, 27 bp, Artificial Sequence
  Synthetic oligonucleotide
tcaaaaacatgaaatagatccacctgc

SEQ ID NO: 3044 - DNA, 27 bp, Artificial Sequence
  Synthetic oligonucleotide
gatcaaaaacatgaaatagatccacct

SEQ ID NO: 3045 - DNA, 27 bp, Artificial Sequence
  Synthetic oligonucleotide
tgatcaaaaacatgaaatagatccacc

SEQ ID NO: 3046 - DNA, 27 bp, Artificial Sequence
  Synthetic oligonucleotide
ttgatcaaaaacatgaaatagatccac

SEQ ID NO: 3047 - DNA, 27 bp, Artificial Sequence
  Synthetic oligonucleotide
agtttttgatcaaaaacatgaaataga

SEQ ID NO: 3048 - DNA, 27 bp, Artificial Sequence
  Synthetic oligonucleotide
ccaaatagtttttgatcaaaaacatga

SEQ ID NO: 3049 - DNA, 27 bp, Artificial Sequence
  Synthetic oligonucleotide
tatcccaaatagtttttgatcaaaaac

SEQ ID NO: 3050 - DNA, 27 bp, Artificial Sequence
  Synthetic oligonucleotide
atatcccaaatagtttttgatcaaaaa

SEQ ID NO: 3051 - DNA, 27 bp, Artificial Sequence
  Synthetic oligonucleotide
catatcccaaatagtttttgatcaaaa

SEQ ID NO: 3052 - DNA, 27 bp, Artificial Sequence
  Synthetic oligonucleotide
acatatcccaaatagtttttgatcaaa

SEQ ID NO: 3053 - DNA, 27 bp, Artificial Sequence
  Synthetic oligonucleotide
ccatacatatcccaaatagtttttgat

SEQ ID NO: 3054 - DNA, 27 bp, Artificial Sequence
  Synthetic oligonucleotide
ttaccctacccatacatatcccaaata

SEQ ID NO: 3055 - DNA, 27 bp, Artificial Sequence
  Synthetic oligonucleotide
tttaccctacccatacatatcccaaat

SEQ ID NO: 3056 - DNA, 27 bp, Artificial Sequence
  Synthetic oligonucleotide
atttaccctacccatacatatcccaaa

SEQ ID NO: 3057 - DNA, 27 bp, Artificial Sequence
  Synthetic oligonucleotide
acacctcttactgatttaccctaccca

SEQ ID NO: 3058 - DNA, 27 bp, Artificial Sequence
  Synthetic oligonucleotide
taacacctcttactgatttaccctacc

SEQ ID NO: 3059 - DNA, 27 bp, Artificial Sequence
  Synthetic oligonucleotide
ataacacctcttactgatttaccctac

SEQ ID NO: 3060 - DNA, 27 bp, Artificial Sequence
  Synthetic oligonucleotide
aataacacctcttactgatttacccta

SEQ ID NO: 3061 - DNA, 27 bp, Artificial Sequence
  Synthetic oligonucleotide
aaataacacctcttactgatttaccct

SEQ ID NO: 3062 - DNA, 27 bp, Artificial Sequence
  Synthetic oligonucleotide
caaataacacctcttactgatttaccc

SEQ ID NO: 3063 - DNA, 27 bp, Artificial Sequence
  Synthetic oligonucleotide
aggttccaaataacacctcttactgat

SEQ ID NO: 3064 - DNA, 27 bp, Artificial Sequence
  Synthetic oligonucleotide
aaaacaaggttccaaataacacctctt

SEQ ID NO: 3065 - DNA, 27 bp, Artificial Sequence
  Synthetic oligonucleotide
caaaacaaggttccaaataacacctct

SEQ ID NO: 3066 - DNA, 27 bp, Artificial Sequence
  Synthetic oligonucleotide
ccaaaacaaggttccaaataacacctc

SEQ ID NO: 3067 - DNA, 27 bp, Artificial Sequence
  Synthetic oligonucleotide
actgtccaaaacaaggttccaaataac

SEQ ID NO: 3068 - DNA, 27 bp, Artificial Sequence
  Synthetic oligonucleotide
gtaaactgtccaaaacaaggttccaaa

SEQ ID NO: 3069 - DNA, 27 bp, Artificial Sequence
  Synthetic oligonucleotide
ggtaaactgtccaaaacaaggttccaa

SEQ ID NO: 3070 - DNA, 27 bp, Artificial Sequence
  Synthetic oligonucleotide
aggcaactggtaaactgtccaaaacaa

SEQ ID NO: 3071 - DNA, 27 bp, Artificial Sequence
  Synthetic oligonucleotide
gggataaaaggcaactggtaaactgtc

SEQ ID NO: 3072 - DNA, 27 bp, Artificial Sequence
  Synthetic oligonucleotide
tgggataaaaggcaactggtaaactgt

SEQ ID NO: 3073 - DNA, 27 bp, Artificial Sequence
  Synthetic oligonucleotide
acaactttgggataaaaggcaactggt

SEQ ID NO: 3074 - DNA, 27 bp, Artificial Sequence
  Synthetic oligonucleotide
caacaactttgggataaaaggcaactg

SEQ ID NO: 3075 - DNA, 27 bp, Artificial Sequence
  Synthetic oligonucleotide
ggttacaacaactttgggataaaaggc

SEQ ID NO: 3076 - DNA, 27 bp, Artificial Sequence
  Synthetic oligonucleotide
aggttacaacaactttgggataaaagg

SEQ ID NO: 3077 - DNA, 27 bp, Artificial Sequence
  Synthetic oligonucleotide
caggttacaacaactttgggataaaag

SEQ ID NO: 3078 - DNA, 27 bp, Artificial Sequence
  Synthetic oligonucleotide
tatcacagcaggttacaacaactttgg

SEQ ID NO: 3079 - DNA, 27 bp, Artificial Sequence
  Synthetic oligonucleotide
gtatcacagcaggttacaacaactttg

SEQ ID NO: 3080 - DNA, 27 bp, Artificial Sequence
  Synthetic oligonucleotide
tcgtatcacagcaggttacaacaactt

SEQ ID NO: 3081 - DNA, 27 bp, Artificial Sequence
  Synthetic oligonucleotide
tttctcttgaagcatcgtatcacagca

SEQ ID NO: 3082 - DNA, 27 bp, Artificial Sequence
  Synthetic oligonucleotide
ttttctcttgaagcatcgtatcacagc

SEQ ID NO: 3083 - DNA, 27 bp, Artificial Sequence
  Synthetic oligonucleotide
cattttctcttgaagcatcgtatcaca

SEQ ID NO: 3084 - DNA, 27 bp, Artificial Sequence
  Synthetic oligonucleotide
ttttttataaccgcattttctcttgaa

SEQ ID NO: 3085 - DNA, 27 bp, Artificial Sequence
  Synthetic oligonucleotide
attttttataaccgcattttctcttga

SEQ ID NO: 3086 - DNA, 27 bp, Artificial Sequence
  Synthetic oligonucleotide
cattttttataaccgcattttctcttg

SEQ ID NO: 3087 - DNA, 27 bp, Artificial Sequence
  Synthetic oligonucleotide
ccattttttataaccgcattttctctt

SEQ ID NO: 3088 - DNA, 27 bp, Artificial Sequence
  Synthetic oligonucleotide
ctgaaccattttttataaccgcatttt

SEQ ID NO: 3089 - DNA, 27 bp, Artificial Sequence
  Synthetic oligonucleotide
taattctgaaccattttttataaccgc

SEQ ID NO: 3090 - DNA, 27 bp, Artificial Sequence
  Synthetic oligonucleotide
ttaattctgaaccattttttataaccg

SEQ ID NO: 3091 - DNA, 27 bp, Artificial Sequence
  Synthetic oligonucleotide
tttaattctgaaccattttttataacc

SEQ ID NO: 3092 - DNA, 27 bp, Artificial Sequence
  Synthetic oligonucleotide
gtttaattctgaaccattttttataac

SEQ ID NO: 3093 - DNA, 27 bp, Artificial Sequence
  Synthetic oligonucleotide
agtttaattctgaaccattttttataa

SEQ ID NO: 3094 - DNA, 27 bp, Artificial Sequence
  Synthetic oligonucleotide
aagtttaattctgaaccattttttata

SEQ ID NO: 3095 - DNA, 27 bp, Artificial Sequence
  Synthetic oligonucleotide
attaaaagtttaattctgaaccatttt

SEQ ID NO: 3096 - DNA, 27 bp, Artificial Sequence
  Synthetic oligonucleotide
aattaaaagtttaattctgaaccattt

SEQ ID NO: 3097 - DNA, 27 bp, Artificial Sequence
  Synthetic oligonucleotide
tgaattaaaagtttaattctgaaccat

SEQ ID NO: 3098 - DNA, 27 bp, Artificial Sequence
  Synthetic oligonucleotide
caatacagctaaaggatgatttacagg

SEQ ID NO: 3099 - DNA, 27 bp, Artificial Sequence
  Synthetic oligonucleotide
acaatacagctaaaggatgatttacag

SEQ ID NO: 3100 - DNA, 27 bp, Artificial Sequence
  Synthetic oligonucleotide
agacaatacagctaaaggatgatttac

SEQ ID NO: 3101 - DNA, 27 bp, Artificial Sequence
  Synthetic oligonucleotide
gttactcctaaaggatgatttacaggt

SEQ ID NO: 3102 - DNA, 27 bp, Artificial Sequence
  Synthetic oligonucleotide
tgttactcctaaaggatgatttacagg

SEQ ID NO: 3103 - DNA, 27 bp, Artificial Sequence
  Synthetic oligonucleotide
ttgttactcctaaaggatgatttacag

SEQ ID NO: 3104 - DNA, 27 bp, Artificial Sequence
  Synthetic oligonucleotide
attgttactcctaaaggatgatttaca

SEQ ID NO: 3105 - DNA, 27 bp, Artificial Sequence
  Synthetic oligonucleotide
ggattccagaatccaagtaagactgct

SEQ ID NO: 3106 - DNA, 27 bp, Artificial Sequence
  Synthetic oligonucleotide
cttgctcccattcataaaggacttggg

SEQ ID NO: 3107 - DNA, 27 bp, Artificial Sequence
  Synthetic oligonucleotide
cgtcaatatcagctacttgctcttgcg

SEQ ID NO: 3108 - DNA, 27 bp, Artificial Sequence
  Synthetic oligonucleotide
ccgtcaatatcagctacttgctcttgc

SEQ ID NO: 3109 - DNA, 27 bp, Artificial Sequence
  Synthetic oligonucleotide
actgcccgtcaatatcagctacttgct

SEQ ID NO: 3110 - DNA, 27 bp, Artificial Sequence
  Synthetic oligonucleotide
tgtttcaacatctgtgatggttcagcc

SEQ ID NO: 3111 - DNA, 27 bp, Artificial Sequence
  Synthetic oligonucleotide
atgtttcaacatctgtgatggttcagc

SEQ ID NO: 3112 - DNA, 27 bp, Artificial Sequence
  Synthetic oligonucleotide
tgacaactgcatgtttcaacatctgtg

SEQ ID NO: 3113 - DNA, 27 bp, Artificial Sequence
  Synthetic oligonucleotide
attgacaactgcatgtttcaacatctg

SEQ ID NO: 3114 - DNA, 27 bp, Artificial Sequence
  Synthetic oligonucleotide
tcaaattgacaactgcatgtttcaaca

SEQ ID NO: 3115 - DNA, 27 bp, Artificial Sequence
  Synthetic oligonucleotide
agttaatcaaattgacaactgcatgtt

SEQ ID NO: 3116 - DNA, 27 bp, Artificial Sequence
  Synthetic oligonucleotide
cctgatagttaatcaaattgacaactg

SEQ ID NO: 3117 - DNA, 27 bp, Artificial Sequence
  Synthetic oligonucleotide
cgtcatcctgatagttaatcaaattga

SEQ ID NO: 3118 - DNA, 27 bp, Artificial Sequence
  Synthetic oligonucleotide
gcgtcatcctgatagttaatcaaattg

SEQ ID NO: 3119 - DNA, 27 bp, Artificial Sequence
  Synthetic oligonucleotide
cctcatcgtttagcagttttgtcagct

SEQ ID NO: 3120 - DNA, 27 bp, Artificial Sequence
  Synthetic oligonucleotide
ctggtcctcatcgtttagcagttttgt

SEQ ID NO: 3121 - DNA, 27 bp, Artificial Sequence
  Synthetic oligonucleotide
cataacagcagctttattaactaccac

SEQ ID NO: 3122 - DNA, 27 bp, Artificial Sequence
  Synthetic oligonucleotide
ccataacagcagctttattaactacca

SEQ ID NO: 3123 - DNA, 27 bp, Artificial Sequence
  Synthetic oligonucleotide
ggaccataacagcagctttattaacta

SEQ ID NO: 3124 - DNA, 27 bp, Artificial Sequence
  Synthetic oligonucleotide
tggaccataacagcagctttattaact

SEQ ID NO: 3125 - DNA, 27 bp, Artificial Sequence
  Synthetic oligonucleotide
ctgtctctacatcatttgtattctgca

SEQ ID NO: 3126 - DNA, 27 bp, Artificial Sequence
  Synthetic oligonucleotide
gctgtctctacatcatttgtattctgc

SEQ ID NO: 3127 - DNA, 27 bp, Artificial Sequence
  Synthetic oligonucleotide
gcaaccattttctgcagtccaccagct

SEQ ID NO: 3128 - DNA, 27 bp, Artificial Sequence
  Synthetic oligonucleotide
aagcaaccattttctgcagtccaccag

SEQ ID NO: 3129 - DNA, 27 bp, Artificial Sequence
  Synthetic oligonucleotide
ttgttttgttgagcaaagcaaccattt

SEQ ID NO: 3130 - DNA, 27 bp, Artificial Sequence
  Synthetic oligonucleotide
tttgttttgttgagcaaagcaaccatt

SEQ ID NO: 3131 - DNA, 27 bp, Artificial Sequence
  Synthetic oligonucleotide
tagccaagaatttcacgtttgttttgt

SEQ ID NO: 3132 - DNA, 27 bp, Artificial Sequence
  Synthetic oligonucleotide
cttgattgccataagctaagatctgaa

SEQ ID NO: 3133 - DNA, 27 bp, Artificial Sequence
  Synthetic oligonucleotide
gctctcttgattgccataagctaagat

SEQ ID NO: 3134 - DNA, 27 bp, Artificial Sequence
  Synthetic oligonucleotide
cttctcataagtgtaggtcctcattat

SEQ ID NO: 3135 - DNA, 27 bp, Artificial Sequence
  Synthetic oligonucleotide
gcttctcataagtgtaggtcctcatta

SEQ ID NO: 3136 - DNA, 27 bp, Artificial Sequence
  Synthetic oligonucleotide
aagcttctcataagtgtaggtcctcat

SEQ ID NO: 3137 - DNA, 27 bp, Artificial Sequence
  Synthetic oligonucleotide
gaagcttctcataagtgtaggtcctca

SEQ ID NO: 3138 - DNA, 27 bp, Artificial Sequence
  Synthetic oligonucleotide
gagtccaaagacagttttgaacaagtc

SEQ ID NO: 3139 - DNA, 27 bp, Artificial Sequence
  Synthetic oligonucleotide
agagtccaaagacagttttgaacaagt

SEQ ID NO: 3140 - DNA, 27 bp, Artificial Sequence
  Synthetic oligonucleotide
ccacatttatatcatcggaacccagaa

SEQ ID NO: 3141 - DNA, 27 bp, Artificial Sequence
  Synthetic oligonucleotide
tgaccacatttatatcatcggaaccca

SEQ ID NO: 3142 - DNA, 27 bp, Artificial Sequence
  Synthetic oligonucleotide
ctgcacaggtgaccacatttatatcat

SEQ ID NO: 3143 - DNA, 27 bp, Artificial Sequence
  Synthetic oligonucleotide
gctgcacaggtgaccacatttatatca

SEQ ID NO: 3144 - DNA, 27 bp, Artificial Sequence
  Synthetic oligonucleotide
ttgtaattattgcaagtgaggttagag

SEQ ID NO: 3145 - DNA, 27 bp, Artificial Sequence
  Synthetic oligonucleotide
catcatcttgtttttgtaattattgca

SEQ ID NO: 3146 - DNA, 27 bp, Artificial Sequence
  Synthetic oligonucleotide
ccatcatcttgtttttgtaattattgc

SEQ ID NO: 3147 - DNA, 27 bp, Artificial Sequence
  Synthetic oligonucleotide
acaccatcatcttgtttttgtaattat

SEQ ID NO: 3148 - DNA, 27 bp, Artificial Sequence
  Synthetic oligonucleotide
ttggcacaccatcatcttgtttttgta

SEQ ID NO: 3149 - DNA, 27 bp, Artificial Sequence
  Synthetic oligonucleotide
tcaatccaacagttgcctttatcagag

SEQ ID NO: 3150 - DNA, 27 bp, Artificial Sequence
  Synthetic oligonucleotide
tcgaatcaatccaacagttgcctttat

SEQ ID NO: 3151 - DNA, 27 bp, Artificial Sequence
  Synthetic oligonucleotide
gctgaactagtcgtggaatagcaccct

SEQ ID NO: 3152 - DNA, 27 bp, Artificial Sequence
  Synthetic oligonucleotide
agtacacccttctactatctcctccat

SEQ ID NO: 3153 - DNA, 27 bp, Artificial Sequence
  Synthetic oligonucleotide
cagtacacccttctactatctcctcca

SEQ ID NO: 3154 - DNA, 27 bp, Artificial Sequence
  Synthetic oligonucleotide
ccagtacacccttctactatctcctcc

SEQ ID NO: 3155 - DNA, 27 bp, Artificial Sequence
  Synthetic oligonucleotide
gagctccagtacacccttctactatct

SEQ ID NO: 3156 - DNA, 27 bp, Artificial Sequence
  Synthetic oligonucleotide
aaacaatggaatggtattgagtcctcg

SEQ ID NO: 3157 - DNA, 27 bp, Artificial Sequence
  Synthetic oligonucleotide
ctgcacaaacaatggaatggtattgag

SEQ ID NO: 3158 - DNA, 27 bp, Artificial Sequence
  Synthetic oligonucleotide
actgcacaaacaatggaatggtattga

SEQ ID NO: 3159 - DNA, 27 bp, Artificial Sequence
  Synthetic oligonucleotide
aagcaactgcacaaacaatggaatggt

SEQ ID NO: 3160 - DNA, 27 bp, Artificial Sequence
  Synthetic oligonucleotide
gagaataaagcaactgcacaaacaatg

SEQ ID NO: 3161 - DNA, 27 bp, Artificial Sequence
  Synthetic oligonucleotide
tttcaatgggagaataaagcaactgca

SEQ ID NO: 3162 - DNA, 27 bp, Artificial Sequence
  Synthetic oligonucleotide
ttttcaatgggagaataaagcaactgc

SEQ ID NO: 3163 - DNA, 27 bp, Artificial Sequence
  Synthetic oligonucleotide
attttcaatgggagaataaagcaactg

SEQ ID NO: 3164 - DNA, 27 bp, Artificial Sequence
  Synthetic oligonucleotide
ggatattttcaatgggagaataaagca

SEQ ID NO: 3165 - DNA, 27 bp, Artificial Sequence
  Synthetic oligonucleotide
tggatattttcaatgggagaataaagc

SEQ ID NO: 3166 - DNA, 27 bp, Artificial Sequence
  Synthetic oligonucleotide
ttggatattttcaatgggagaataaag

SEQ ID NO: 3167 - DNA, 27 bp, Artificial Sequence
  Synthetic oligonucleotide
cagctactctttggatattttcaatgg

SEQ ID NO: 3168 - DNA, 27 bp, Artificial Sequence
  Synthetic oligonucleotide
gcagctactctttggatattttcaatg

SEQ ID NO: 3169 - DNA, 27 bp, Artificial Sequence
  Synthetic oligonucleotide
ccgcttcttgtaatcctgtggcttgtc

SEQ ID NO: 3170 - DNA, 27 bp, Artificial Sequence
  Synthetic oligonucleotide
ccagtccaagatctgcagtctcattcc

SEQ ID NO: 3171 - DNA, 27 bp, Artificial Sequence
  Synthetic oligonucleotide
cgtatccaccagagtgaaaagaacggt

SEQ ID NO: 3172 - DNA, 27 bp, Artificial Sequence
  Synthetic oligonucleotide
caggccagctgattgctatcacctggg

SEQ ID NO: 3173 - DNA, 27 bp, Artificial Sequence
  Synthetic oligonucleotide
cgatttacaggtcagtatcaaaccagg

SEQ ID NO: 3174 - DNA, 27 bp, Artificial Sequence
  Synthetic oligonucleotide
acgatttacaggtcagtatcaaaccag

SEQ ID NO: 3175 - DNA, 27 bp, Artificial Sequence
  Synthetic oligonucleotide
tttcttacctaaaggacgatttacagg

SEQ ID NO: 3176 - DNA, 27 bp, Artificial Sequence
  Synthetic oligonucleotide
gctttcttacctaaaggacgatttaca

SEQ ID NO: 3177 - DNA, 27 bp, Artificial Sequence
  Synthetic oligonucleotide
cttttataagctttcttacctaaagga

SEQ ID NO: 3178 - DNA, 27 bp, Artificial Sequence
  Synthetic oligonucleotide
gcttttataagctttcttacctaaagg

SEQ ID NO: 3179 - DNA, 27 bp, Artificial Sequence
  Synthetic oligonucleotide
ctggcttttataagctttcttacctaa

SEQ ID NO: 3180 - DNA, 27 bp, Artificial Sequence
  Synthetic oligonucleotide
ccacactggcttttataagctttctta

SEQ ID NO: 3181 - DNA, 27 bp, Artificial Sequence
  Synthetic oligonucleotide
attcacccacactggcttttataagct

SEQ ID NO: 3182 - DNA, 27 bp, Artificial Sequence
  Synthetic oligonucleotide
cctaccaagtctttctggagttctgca

SEQ ID NO: 3183 - DNA, 27 bp, Artificial Sequence
  Synthetic oligonucleotide
atttacaaacaggcctaaaaccattcc

SEQ ID NO: 3184 - DNA, 27 bp, Artificial Sequence
  Synthetic oligonucleotide
gatttacaaacaggcctaaaaccattc

SEQ ID NO: 3185 - DNA, 27 bp, Artificial Sequence
  Synthetic oligonucleotide
agatttacaaacaggcctaaaaccatt

SEQ ID NO: 3186 - DNA, 27 bp, Artificial Sequence
  Synthetic oligonucleotide
catctccttccaaggtatgtatctgtt

SEQ ID NO: 3187 - DNA, 27 bp, Artificial Sequence
  Synthetic oligonucleotide
acatctccttccaaggtatgtatctgt

SEQ ID NO: 3188 - DNA, 27 bp, Artificial Sequence
  Synthetic oligonucleotide
acttccacacatgaacatctccttcca

SEQ ID NO: 3189 - DNA, 27 bp, Artificial Sequence
  Synthetic oligonucleotide
gaaacttccacacatgaacatctcctt

SEQ ID NO: 3190 - DNA, 27 bp, Artificial Sequence
  Synthetic oligonucleotide
agaaacttccacacatgaacatctcct

SEQ ID NO: 3191 - DNA, 27 bp, Artificial Sequence
  Synthetic oligonucleotide
gagaaacttccacacatgaacatctcc

SEQ ID NO: 3192 - DNA, 27 bp, Artificial Sequence
  Synthetic oligonucleotide
tgagaaacttccacacatgaacatctc

SEQ ID NO: 3193 - DNA, 27 bp, Artificial Sequence
  Synthetic oligonucleotide
catcaacgtgagaaacttccacacatg

SEQ ID NO: 3194 - DNA, 27 bp, Artificial Sequence
  Synthetic oligonucleotide
aaacatcaacgtgagaaacttccacac

SEQ ID NO: 3195 - DNA, 27 bp, Artificial Sequence
  Synthetic oligonucleotide
aaaacatcaacgtgagaaacttccaca

SEQ ID NO: 3196 - DNA, 27 bp, Artificial Sequence
  Synthetic oligonucleotide
aaaaacatcaacgtgagaaacttccac

SEQ ID NO: 3197 - DNA, 27 bp, Artificial Sequence
  Synthetic oligonucleotide
caaaaacatcaacgtgagaaacttcca

SEQ ID NO: 3198 - DNA, 27 bp, Artificial Sequence
  Synthetic oligonucleotide
gcaaaaacatcaacgtgagaaacttcc

SEQ ID NO: 3199 - DNA, 27 bp, Artificial Sequence
  Synthetic oligonucleotide
tggcaaaaacatcaacgtgagaaactt

SEQ ID NO: 3200 - DNA, 27 bp, Artificial Sequence
  Synthetic oligonucleotide
ctgcaaaagctgtggcaaaaacatcaa

SEQ ID NO: 3201 - DNA, 27 bp, Artificial Sequence
  Synthetic oligonucleotide
gctgcaaaagctgtggcaaaaacatca

SEQ ID NO: 3202 - DNA, 27 bp, Artificial Sequence
  Synthetic oligonucleotide
actcatctgagtataacgctgcaaaag

SEQ ID NO: 3203 - DNA, 27 bp, Artificial Sequence
  Synthetic oligonucleotide
tgaaaacagcaaatgttactcatctga

SEQ ID NO: 3204 - DNA, 27 bp, Artificial Sequence
  Synthetic oligonucleotide
ttgaaaacagcaaatgttactcatctg

SEQ ID NO: 3205 - DNA, 27 bp, Artificial Sequence
  Synthetic oligonucleotide
gttgaaaacagcaaatgttactcatct

SEQ ID NO: 3206 - DNA, 27 bp, Artificial Sequence
  Synthetic oligonucleotide
ctattaatgttgaaaacagcaaatgtt

SEQ ID NO: 3207 - DNA, 27 bp, Artificial Sequence
  Synthetic oligonucleotide
acactacagctgtatagagagaaaggc

SEQ ID NO: 3208 - DNA, 27 bp, Artificial Sequence
  Synthetic oligonucleotide
caggccaatcacaatgcacgttcagac

SEQ ID NO: 3209 - DNA, 27 bp, Artificial Sequence
  Synthetic oligonucleotide
ctgttcccataggaaactcagcttggt

SEQ ID NO: 3210 - DNA, 27 bp, Artificial Sequence
  Synthetic oligonucleotide
cagaacaaaaagcgtacttcgactgtt

SEQ ID NO: 3211 - DNA, 27 bp, Artificial Sequence
  Synthetic oligonucleotide
aaggaccagaacaaaaagcgtacttcg

SEQ ID NO: 3212 - DNA, 27 bp, Artificial Sequence
  Synthetic oligonucleotide
cgaccaaaaaggaccagaacaaaaagc

SEQ ID NO: 3213 - DNA, 27 bp, Artificial Sequence
  Synthetic oligonucleotide
tcgaccaaaaaggaccagaacaaaaag

SEQ ID NO: 3214 - DNA, 27 bp, Artificial Sequence
  Synthetic oligonucleotide
ttactcctcgaccaaaaaggaccagaa

SEQ ID NO: 3215 - DNA, 27 bp, Artificial Sequence
  Synthetic oligonucleotide
aatccatttgtattgttactcctcgac

SEQ ID NO: 3216 - DNA, 27 bp, Artificial Sequence
  Synthetic oligonucleotide
aaatccatttgtattgttactcctcga

SEQ ID NO: 3217 - DNA, 27 bp, Artificial Sequence
  Synthetic oligonucleotide
caaatccatttgtattgttactcctcg

SEQ ID NO: 3218 - DNA, 27 bp, Artificial Sequence
  Synthetic oligonucleotide
ccaaatccatttgtattgttactcctc

SEQ ID NO: 3219 - DNA, 27 bp, Artificial Sequence
  Synthetic oligonucleotide
tcactccccaaatccatttgtattgtt

SEQ ID NO: 3220 - DNA, 27 bp, Artificial Sequence
  Synthetic oligonucleotide
gatccattcgtgtgcattcttcactgc

SEQ ID NO: 3221 - DNA, 27 bp, Artificial Sequence
  Synthetic oligonucleotide
tgatccattcgtgtgcattcttcactg

SEQ ID NO: 3222 - DNA, 27 bp, Artificial Sequence
  Synthetic oligonucleotide
gtgatccattcgtgtgcattcttcact

SEQ ID NO: 3223 - DNA, 27 bp, Artificial Sequence
  Synthetic oligonucleotide
taaaacaaagaacaagcaaggctaggg

SEQ ID NO: 3224 - DNA, 27 bp, Artificial Sequence
  Synthetic oligonucleotide
gcaccactacagatattaaaacaaaga

SEQ ID NO: 3225 - DNA, 27 bp, Artificial Sequence
  Synthetic oligonucleotide
cagcaccactacagatattaaaacaaa

SEQ ID NO: 3226 - DNA, 27 bp, Artificial Sequence
  Synthetic oligonucleotide
tcagcaccactacagatattaaaacaa

SEQ ID NO: 3227 - DNA, 27 bp, Artificial Sequence
  Synthetic oligonucleotide
aaaaaataaaagcaagcaaagtcagca

SEQ ID NO: 3228 - DNA, 27 bp, Artificial Sequence
  Synthetic oligonucleotide
ctgcaaaaaataaaagcaagcaaagtc

SEQ ID NO: 3229 - DNA, 27 bp, Artificial Sequence
  Synthetic oligonucleotide
agttactgcaaaaaataaaagcaagca

SEQ ID NO: 3230 - DNA, 27 bp, Artificial Sequence
  Synthetic oligonucleotide
actaacagttactgcaaaaaataaaag

SEQ ID NO: 3231 - DNA, 27 bp, Artificial Sequence
  Synthetic oligonucleotide
aaactaacagttactgcaaaaaataaa

SEQ ID NO: 3232 - DNA, 27 bp, Artificial Sequence
  Synthetic oligonucleotide
aaaaactaacagttactgcaaaaaata

SEQ ID NO: 3233 - DNA, 27 bp, Artificial Sequence
  Synthetic oligonucleotide
taaaaactaacagttactgcaaaaaat

SEQ ID NO: 3234 - DNA, 27 bp, Artificial Sequence
  Synthetic oligonucleotide
cttaaaaactaacagttactgcaaaaa

SEQ ID NO: 3235 - DNA, 27 bp, Artificial Sequence
  Synthetic oligonucleotide
actacttaaaaactaacagttactgca

SEQ ID NO: 3236 - DNA, 27 bp, Artificial Sequence
  Synthetic oligonucleotide
acactacttaaaaactaacagttactg

SEQ ID NO: 3237 - DNA, 27 bp, Artificial Sequence
  Synthetic oligonucleotide
cataacactacttaaaaactaacagtt

SEQ ID NO: 3238 - DNA, 27 bp, Artificial Sequence
  Synthetic oligonucleotide
acataacactacttaaaaactaacagt

SEQ ID NO: 3239 - DNA, 27 bp, Artificial Sequence
  Synthetic oligonucleotide
gaacataacactacttaaaaactaaca

SEQ ID NO: 3240 - DNA, 27 bp, Artificial Sequence
  Synthetic oligonucleotide
agaacataacactacttaaaaactaac

SEQ ID NO: 3241 - DNA, 27 bp, Artificial Sequence
  Synthetic oligonucleotide
tagaacataacactacttaaaaactaa

SEQ ID NO: 3242 - DNA, 27 bp, Artificial Sequence
  Synthetic oligonucleotide
ctagaacataacactacttaaaaacta

SEQ ID NO: 3243 - DNA, 27 bp, Artificial Sequence
  Synthetic oligonucleotide
gttcactagaacataacactacttaaa

SEQ ID NO: 3244 - DNA, 27 bp, Artificial Sequence
  Synthetic oligonucleotide
aggttcactagaacataacactactta

SEQ ID NO: 3245 - DNA, 27 bp, Artificial Sequence
  Synthetic oligonucleotide
caggttcactagaacataacactactt

SEQ ID NO: 3246 - DNA, 27 bp, Artificial Sequence
  Synthetic oligonucleotide
ccattactcggttcttagaaatcagaa

SEQ ID NO: 3247 - DNA, 27 bp, Artificial Sequence
  Synthetic oligonucleotide
acaccattactcggttcttagaaatca

SEQ ID NO: 3248 - DNA, 27 bp, Artificial Sequence
  Synthetic oligonucleotide
gttctacaccattactcggttcttaga

SEQ ID NO: 3249 - DNA, 27 bp, Artificial Sequence
  Synthetic oligonucleotide
atgaattagtgttctacaccattactc

SEQ ID NO: 3250 - DNA, 27 bp, Artificial Sequence
  Synthetic oligonucleotide
tgattatgaattagtgttctacaccat

SEQ ID NO: 3251 - DNA, 27 bp, Artificial Sequence
  Synthetic oligonucleotide
gtgattatgaattagtgttctacacca

SEQ ID NO: 3252 - DNA, 27 bp, Artificial Sequence
  Synthetic oligonucleotide
cgtgattatgaattagtgttctacacc

SEQ ID NO: 3253 - DNA, 27 bp, Artificial Sequence
  Synthetic oligonucleotide
ttacaattagcgtgattatgaattagt

SEQ ID NO: 3254 - DNA, 27 bp, Artificial Sequence
  Synthetic oligonucleotide
attacaattagcgtgattatgaattag

SEQ ID NO: 3255 - DNA, 27 bp, Artificial Sequence
  Synthetic oligonucleotide
ccagattacaattagcgtgattatgaa

SEQ ID NO: 3256 - DNA, 27 bp, Artificial Sequence
  Synthetic oligonucleotide
gttacacgtctccagattacaattagc

SEQ ID NO: 3257 - DNA, 27 bp, Artificial Sequence
  Synthetic oligonucleotide
atgttacacgtctccagattacaatta

SEQ ID NO: 3258 - DNA, 27 bp, Artificial Sequence
  Synthetic oligonucleotide
gctacacaatgttacacgtctccagat

SEQ ID NO: 3259 - DNA, 27 bp, Artificial Sequence
  Synthetic oligonucleotide
aggctacacaatgttacacgtctccag

SEQ ID NO: 3260 - DNA, 27 bp, Artificial Sequence
  Synthetic oligonucleotide
atacaaaaggctacacaatgttacacg

SEQ ID NO: 3261 - DNA, 27 bp, Artificial Sequence
  Synthetic oligonucleotide
tatacaaaaggctacacaatgttacac

SEQ ID NO: 3262 - DNA, 27 bp, Artificial Sequence
  Synthetic oligonucleotide
tatttatacaaaaggctacacaatgtt

SEQ ID NO: 3263 - DNA, 27 bp, Artificial Sequence
  Synthetic oligonucleotide
ctatttatacaaaaggctacacaatgt

SEQ ID NO: 3264 - DNA, 27 bp, Artificial Sequence
  Synthetic oligonucleotide
tgtctatttatacaaaaggctacacaa

SEQ ID NO: 3265 - DNA, 27 bp, Artificial Sequence
  Synthetic oligonucleotide
ctgtctatttatacaaaaggctacaca

SEQ ID NO: 3266 - DNA, 27 bp, Artificial Sequence
  Synthetic oligonucleotide
tctgtctatttatacaaaaggctacac

SEQ ID NO: 3267 - DNA, 27 bp, Artificial Sequence
  Synthetic oligonucleotide
tttctatctgtctatttatacaaaagg

SEQ ID NO: 3268 - DNA, 27 bp, Artificial Sequence
  Synthetic oligonucleotide
atttctatctgtctatttatacaaaag

SEQ ID NO: 3269 - DNA, 27 bp, Artificial Sequence
  Synthetic oligonucleotide
catttctatctgtctatttatacaaaa

SEQ ID NO: 3270 - DNA, 27 bp, Artificial Sequence
  Synthetic oligonucleotide
ccatttctatctgtctatttatacaaa

SEQ ID NO: 3271 - DNA, 27 bp, Artificial Sequence
  Synthetic oligonucleotide
cggaccatttctatctgtctatttata

SEQ ID NO: 3272 - DNA, 27 bp, Artificial Sequence
  Synthetic oligonucleotide
tcggaccatttctatctgtctatttat

SEQ ID NO: 3273 - DNA, 27 bp, Artificial Sequence
  Synthetic oligonucleotide
aaactaatcggaccatttctatctgtc

SEQ ID NO: 3274 - DNA, 27 bp, Artificial Sequence
  Synthetic oligonucleotide
gaaactaatcggaccatttctatctgt

SEQ ID NO: 3275 - DNA, 27 bp, Artificial Sequence
  Synthetic oligonucleotide
ggaaactaatcggaccatttctatctg

SEQ ID NO: 3276 - DNA, 27 bp, Artificial Sequence
  Synthetic oligonucleotide
aggaaactaatcggaccatttctatct

SEQ ID NO: 3277 - DNA, 27 bp, Artificial Sequence
  Synthetic oligonucleotide
attaaaaaggaaactaatcggaccatt

SEQ ID NO: 3278 - DNA, 27 bp, Artificial Sequence
  Synthetic oligonucleotide
aagcatattaaaaaggaaactaatcgg

SEQ ID NO: 3279 - DNA, 27 bp, Artificial Sequence
  Synthetic oligonucleotide
taagcatattaaaaaggaaactaatcg

SEQ ID NO: 3280 - DNA, 27 bp, Artificial Sequence
  Synthetic oligonucleotide
attttaagcatattaaaaaggaaacta

SEQ ID NO: 3281 - DNA, 27 bp, Artificial Sequence
  Synthetic oligonucleotide
ctgcttattttaagcatattaaaaagg

SEQ ID NO: 3282 - DNA, 27 bp, Artificial Sequence
  Synthetic oligonucleotide
cctgcttattttaagcatattaaaaag

SEQ ID NO: 3283 - DNA, 27 bp, Artificial Sequence
  Synthetic oligonucleotide
gatccacctgcttattttaagcatatt

SEQ ID NO: 3284 - DNA, 27 bp, Artificial Sequence
  Synthetic oligonucleotide
caaaaacatgaaatagatccacctgct

SEQ ID NO: 3285 - DNA, 27 bp, Artificial Sequence
  Synthetic oligonucleotide
tcaaaaacatgaaatagatccacctgc

SEQ ID NO: 3286 - DNA, 27 bp, Artificial Sequence
  Synthetic oligonucleotide
gttcaaaaacatgaaatagatccacct

SEQ ID NO: 3287 - DNA, 27 bp, Artificial Sequence
  Synthetic oligonucleotide
tgttcaaaaacatgaaatagatccacc

SEQ ID NO: 3288 - DNA, 27 bp, Artificial Sequence
  Synthetic oligonucleotide
ttgttcaaaaacatgaaatagatccac

SEQ ID NO: 3289 - DNA, 27 bp, Artificial Sequence
  Synthetic oligonucleotide
agtttttgttcaaaaacatgaaataga

SEQ ID NO: 3290 - DNA, 27 bp, Artificial Sequence
  Synthetic oligonucleotide
cgataaagtttttgttcaaaaacatga

SEQ ID NO: 3291 - DNA, 27 bp, Artificial Sequence
  Synthetic oligonucleotide
tatccccgataaagtttttgttcaaaa

SEQ ID NO: 3292 - DNA, 27 bp, Artificial Sequence
  Synthetic oligonucleotide
gtatccccgataaagtttttgttcaaa

SEQ ID NO: 3293 - DNA, 27 bp, Artificial Sequence
  Synthetic oligonucleotide
acacctcttactgatttaccctaccgc

SEQ ID NO: 3294 - DNA, 27 bp, Artificial Sequence
  Synthetic oligonucleotide
taacacctcttactgatttaccctacc

SEQ ID NO: 3295 - DNA, 27 bp, Artificial Sequence
  Synthetic oligonucleotide
ataacacctcttactgatttaccctac

SEQ ID NO: 3296 - DNA, 27 bp, Artificial Sequence
  Synthetic oligonucleotide
aataacacctcttactgatttacccta

SEQ ID NO: 3297 - DNA, 27 bp, Artificial Sequence
  Synthetic oligonucleotide
aaataacacctcttactgatttaccct

SEQ ID NO: 3298 - DNA, 27 bp, Artificial Sequence
  Synthetic oligonucleotide
caaataacacctcttactgatttaccc

SEQ ID NO: 3299 - DNA, 27 bp, Artificial Sequence
  Synthetic oligonucleotide
aaggctcaaataacacctcttactgat

SEQ ID NO: 3300 - DNA, 27 bp, Artificial Sequence
  Synthetic oligonucleotide
aaaacaaggctcaaataacacctctta

SEQ ID NO: 3301 - DNA, 27 bp, Artificial Sequence
  Synthetic oligonucleotide
caaaacaaggctcaaataacacctctt

SEQ ID NO: 3302 - DNA, 27 bp, Artificial Sequence
  Synthetic oligonucleotide
ccaaaacaaggctcaaataacacctct

SEQ ID NO: 3303 - DNA, 27 bp, Artificial Sequence
  Synthetic oligonucleotide
tgtccaaaacaaggctcaaataacacc

SEQ ID NO: 3304 - DNA, 27 bp, Artificial Sequence
  Synthetic oligonucleotide
actgtccaaaacaaggctcaaataaca

SEQ ID NO: 3305 - DNA, 27 bp, Artificial Sequence
  Synthetic oligonucleotide
ggtatactgtccaaaacaaggctcaaa

SEQ ID NO: 3306 - DNA, 27 bp, Artificial Sequence
  Synthetic oligonucleotide
aggcaactggtatactgtccaaaacaa

SEQ ID NO: 3307 - DNA, 27 bp, Artificial Sequence
  Synthetic oligonucleotide
gggataaaaggcaactggtatactgtc

SEQ ID NO: 3308 - DNA, 27 bp, Artificial Sequence
  Synthetic oligonucleotide
tgggataaaaggcaactggtatactgt

SEQ ID NO: 3309 - DNA, 27 bp, Artificial Sequence
  Synthetic oligonucleotide
acaactttgggataaaaggcaactggt

SEQ ID NO: 3310 - DNA, 27 bp, Artificial Sequence
  Synthetic oligonucleotide
caacaactttgggataaaaggcaactg

SEQ ID NO: 3311 - DNA, 27 bp, Artificial Sequence
  Synthetic oligonucleotide
ggttacaacaactttgggataaaaggc

SEQ ID NO: 3312 - DNA, 27 bp, Artificial Sequence
  Synthetic oligonucleotide
aggttacaacaactttgggataaaagg

SEQ ID NO: 3313 - DNA, 27 bp, Artificial Sequence
  Synthetic oligonucleotide
caggttacaacaactttgggataaaag

SEQ ID NO: 3314 - DNA, 27 bp, Artificial Sequence
  Synthetic oligonucleotide
tatcacagcaggttacaacaactttgg

SEQ ID NO: 3315 - DNA, 27 bp, Artificial Sequence
  Synthetic oligonucleotide
gtatcacagcaggttacaacaactttg

SEQ ID NO: 3316 - DNA, 27 bp, Artificial Sequence
  Synthetic oligonucleotide
ttgtatcacagcaggttacaacaactt

SEQ ID NO: 3317 - DNA, 27 bp, Artificial Sequence
  Synthetic oligonucleotide
ccgcatctgttgaagcattgtatcaca

SEQ ID NO: 3318 - DNA, 27 bp, Artificial Sequence
  Synthetic oligonucleotide
tctgaaccatttctataaccgcatctg

SEQ ID NO: 3319 - DNA, 27 bp, Artificial Sequence
  Synthetic oligonucleotide
taattctgaaccatttctataaccgca

SEQ ID NO: 3320 - DNA, 27 bp, Artificial Sequence
  Synthetic oligonucleotide
tttaattctgaaccatttctataaccg

SEQ ID NO: 3321 - DNA, 27 bp, Artificial Sequence
  Synthetic oligonucleotide
gtttaattctgaaccatttctataacc

SEQ ID NO: 3322 - DNA, 27 bp, Artificial Sequence
  Synthetic oligonucleotide
agtttaattctgaaccatttctataac

SEQ ID NO: 3323 - DNA, 27 bp, Artificial Sequence
  Synthetic oligonucleotide
aagtttaattctgaaccatttctataa

SEQ ID NO: 3324 - DNA, 27 bp, Artificial Sequence
  Synthetic oligonucleotide
attaaaagtttaattctgaaccatttc

SEQ ID NO: 3325 - DNA, 27 bp, Artificial Sequence
  Synthetic oligonucleotide
aattaaaagtttaattctgaaccattt

SEQ ID NO: 3326 - DNA, 27 bp, Artificial Sequence
  Synthetic oligonucleotide
tgaattaaaagtttaattctgaaccat

SEQ ID NO: 3327 - DNA, 27 bp, Artificial Sequence
  Synthetic oligonucleotide
tttgaatgaattaaaagtttaattctg

SEQ ID NO: 3328 - DNA, 27 bp, Artificial Sequence
  Synthetic oligonucleotide
tttttttgaatgaattaaaagtttaat

SEQ ID NO: 3329 - DNA, 27 bp, Artificial Sequence
  Synthetic oligonucleotide
tttttttttttgaatgaattaaaagtt

SEQ ID NO: 3330 - DNA, 27 bp, Artificial Sequence
  Synthetic oligonucleotide
ttttttttttttgaatgaattaaaagt

SEQ ID NO: 3331 - DNA, 27 bp, Artificial Sequence
  Synthetic oligonucleotide
tttttttttttttgaatgaattaaaag

SEQ ID NO: 3332 - DNA, 27 bp, Artificial Sequence
  Synthetic oligonucleotide
ttttttttttttttgaatgaattaaaa

SEQ ID NO: 3333 - DNA, 27 bp, Artificial Sequence
  Synthetic oligonucleotide
tttttttttttttttgaatgaattaaa

SEQ ID NO: 3334 - DNA, 27 bp, Artificial Sequence
  Synthetic oligonucleotide
ttttttttttttttttgaatgaattaa

SEQ ID NO: 3335 - RNA, 25 nt, Artificial Sequence
  Synthetic oligonucleotide
cugaggguauuugaaguauaccaua

SEQ ID NO: 3336 - RNA, 25 nt, Artificial Sequence
  Synthetic oligonucleotide
ggguauuugaaguauaccauacaac

SEQ ID NO: 3337 - RNA, 25 nt, Artificial Sequence
  Synthetic oligonucleotide
aaguauaccauacaacuguuuugaa

SEQ ID NO: 3338 - RNA, 25 nt, Artificial Sequence
  Synthetic oligonucleotide
accauacaacuguuuugaaaaucca

SEQ ID NO: 3339 - RNA, 25 nt, Artificial Sequence
  Synthetic oligonucleotide
acaacuguuuugaaaauccagcgug

SEQ ID NO: 3340 - RNA, 25 nt, Artificial Sequence
  Synthetic oligonucleotide
gggauuuucucaguccuucacucaa

SEQ ID NO: 3341 - RNA, 25 nt, Artificial Sequence
  Synthetic oligonucleotide
cucaagaacaaguagcugauauuga

SEQ ID NO: 3342 - RNA, 25 nt, Artificial Sequence
  Synthetic oligonucleotide
aacaaguagcugauauugauggaca

SEQ ID NO: 3343 - RNA, 25 nt, Artificial Sequence
  Synthetic oligonucleotide
caaguagcugauauugauggacagu

SEQ ID NO: 3344 - RNA, 25 nt, Artificial Sequence
  Synthetic oligonucleotide
auggacaguaugcaaugacucgagc

SEQ ID NO: 3345 - RNA, 25 nt, Artificial Sequence
  Synthetic oligonucleotide
cuauguucccugagacauuagauga

SEQ ID NO: 3346 - RNA, 25 nt, Artificial Sequence
  Synthetic oligonucleotide
cugaaacaugcaguuguaaacuuga

SEQ ID NO: 3347 - RNA, 25 nt, Artificial Sequence
  Synthetic oligonucleotide
caugcaguuguaaacuugauuaacu

SEQ ID NO: 3348 - RNA, 25 nt, Artificial Sequence
  Synthetic oligonucleotide
aguuguaaacuugauuaacuaucaa

SEQ ID NO: 3349 - RNA, 25 nt, Artificial Sequence
  Synthetic oligonucleotide
uugauuaacuaucaagaugaugcag

SEQ ID NO: 3350 - RNA, 25 nt, Artificial Sequence
  Synthetic oligonucleotide
cugaacugacaaaacugcuaaauga

SEQ ID NO: 3351 - RNA, 25 nt, Artificial Sequence
  Synthetic oligonucleotide
agauggugucugcuauuguacguac

SEQ ID NO: 3352 - RNA, 25 nt, Artificial Sequence
  Synthetic oligonucleotide
acguaccaugcagaauacaaaugau

SEQ ID NO: 3353 - RNA, 25 nt, Artificial Sequence
  Synthetic oligonucleotide
uacaacucuccacaaccuuuuauua

SEQ ID NO: 3354 - RNA, 25 nt, Artificial Sequence
  Synthetic oligonucleotide
cucuccacaaccuuuuauuacauca

SEQ ID NO: 3355 - RNA, 25 nt, Artificial Sequence
  Synthetic oligonucleotide
cacaaccuuuuauuacaucaagaag

SEQ ID NO: 3356 - RNA, 25 nt, Artificial Sequence
  Synthetic oligonucleotide
cuuuuauuacaucaagaaggagcua

SEQ ID NO: 3357 - RNA, 25 nt, Artificial Sequence
  Synthetic oligonucleotide
aaaacaaauguuaaauucuuggcua

SEQ ID NO: 3358 - RNA, 25 nt, Artificial Sequence
  Synthetic oligonucleotide
uacgacagacugccuucaaauuuua

SEQ ID NO: 3359 - RNA, 25 nt, Artificial Sequence
  Synthetic oligonucleotide
cagacugccuucaaauuuuagcuua

SEQ ID NO: 3360 - RNA, 25 nt, Artificial Sequence
  Synthetic oligonucleotide
cuuuaguaaauauaaugaggaccua

SEQ ID NO: 3361 - RNA, 25 nt, Artificial Sequence
  Synthetic oligonucleotide
aaaacuacuguggaccacaagcaga

SEQ ID NO: 3362 - RNA, 25 nt, Artificial Sequence
  Synthetic oligonucleotide
agucaacgucuuguucagaacuguc

SEQ ID NO: 3363 - RNA, 25 nt, Artificial Sequence
  Synthetic oligonucleotide
cgucuuguucagaacugucuuugga

SEQ ID NO: 3364 - RNA, 25 nt, Artificial Sequence
  Synthetic oligonucleotide
uguucagaacugucuuuggacucuc

SEQ ID NO: 3365 - RNA, 25 nt, Artificial Sequence
  Synthetic oligonucleotide
gguucagaugauauaaaugugguca

SEQ ID NO: 3366 - RNA, 25 nt, Artificial Sequence
  Synthetic oligonucleotide
ucuuucuaaccucacuugcaauaau

SEQ ID NO: 3367 - RNA, 25 nt, Artificial Sequence
  Synthetic oligonucleotide
cucacuugcaauaauuauaagaaca

SEQ ID NO: 3368 - RNA, 25 nt, Artificial Sequence
  Synthetic oligonucleotide
caauaauuauaagaacaagaugaug

SEQ ID NO: 3369 - RNA, 25 nt, Artificial Sequence
  Synthetic oligonucleotide
guauagaggcucuugugcguacugu

SEQ ID NO: 3370 - RNA, 25 nt, Artificial Sequence
  Synthetic oligonucleotide
ggcuacuguuggauugauucgaaau

SEQ ID NO: 3371 - RNA, 25 nt, Artificial Sequence
  Synthetic oligonucleotide
cauggaagaaauaguugaagguugu

SEQ ID NO: 3372 - RNA, 25 nt, Artificial Sequence
  Synthetic oligonucleotide
uggaagaaauaguugaagguuguac

SEQ ID NO: 3373 - RNA, 25 nt, Artificial Sequence
  Synthetic oligonucleotide
auugaaaacauccaaagaguagcug

SEQ ID NO: 3374 - RNA, 25 nt, Artificial Sequence
  Synthetic oligonucleotide
gaggacaagccacaagauuacaaga

SEQ ID NO: 3375 - RNA, 25 nt, Artificial Sequence
  Synthetic oligonucleotide
gauacugaccuguaaaucauccuuu

SEQ ID NO: 3376 - RNA, 25 nt, Artificial Sequence
  Synthetic oligonucleotide
uuagguaagaaguuuuaaaaagcca

SEQ ID NO: 3377 - RNA, 25 nt, Artificial Sequence
  Synthetic oligonucleotide
cagguauauacuuugaaaggagaug

SEQ ID NO: 3378 - RNA, 25 nt, Artificial Sequence
  Synthetic oligonucleotide
gaaguuauuaacuuuaauguuuuuu

SEQ ID NO: 3379 - RNA, 25 nt, Artificial Sequence
  Synthetic oligonucleotide
ccacagcuuuugcaacuuaauacuc

SEQ ID NO: 3380 - RNA, 25 nt, Artificial Sequence
  Synthetic oligonucleotide
cauuugcuguuuuaaacauuaauag

SEQ ID NO: 3381 - RNA, 25 nt, Artificial Sequence
  Synthetic oligonucleotide
caauugaaguaaacuuuuuguucug

SEQ ID NO: 3382 - RNA, 25 nt, Artificial Sequence
  Synthetic oligonucleotide
acccuagccuugcuuguuaaauuuu

SEQ ID NO: 3383 - RNA, 25 nt, Artificial Sequence
  Synthetic oligonucleotide
gccuugcuuguuaaauuuuuuuuuu

SEQ ID NO: 3384 - RNA, 25 nt, Artificial Sequence
  Synthetic oligonucleotide
gaaguagcucuuuuuuuuuuuuuuu

SEQ ID NO: 3385 - RNA, 25 nt, Artificial Sequence
  Synthetic oligonucleotide
guaguguuaaguuauagugaauacu

SEQ ID NO: 3386 - RNA, 25 nt, Artificial Sequence
  Synthetic oligonucleotide
gugaauacugcuacagcaauuucua

SEQ ID NO: 3387 - RNA, 25 nt, Artificial Sequence
  Synthetic oligonucleotide
uacugcuacagcaauuucuaauuuu

SEQ ID NO: 3388 - RNA, 25 nt, Artificial Sequence
  Synthetic oligonucleotide
cuaauuuuuaagaauugaguaaugg

SEQ ID NO: 3389 - RNA, 25 nt, Artificial Sequence
  Synthetic oligonucleotide
uuuuaagaauugaguaaugguguag

SEQ ID NO: 3390 - RNA, 25 nt, Artificial Sequence
  Synthetic oligonucleotide
cauaaucacucuaauuaauuguaau

SEQ ID NO: 3391 - RNA, 25 nt, Artificial Sequence
  Synthetic oligonucleotide
uaauuguaaucugaauaaaguguaa

SEQ ID NO: 3392 - RNA, 25 nt, Artificial Sequence
  Synthetic oligonucleotide
guaaucugaauaaaguguaacaauu

SEQ ID NO: 3393 - RNA, 25 nt, Artificial Sequence
  Synthetic oligonucleotide
ugaauaaaguguaacaauuguguag

SEQ ID NO: 3394 - RNA, 25 nt, Artificial Sequence
  Synthetic oligonucleotide
guagccuuuuuguauaaaauagaca

SEQ ID NO: 3395 - RNA, 25 nt, Artificial Sequence
  Synthetic oligonucleotide
uguauaaaauagacaaauagaaaau

SEQ ID NO: 3396 - RNA, 25 nt, Artificial Sequence
  Synthetic oligonucleotide
aaaaugguccaauuaguuuccuuuu

SEQ ID NO: 3397 - RNA, 25 nt, Artificial Sequence
  Synthetic oligonucleotide
ccaauuaguuuccuuuuuaauaugc

SEQ ID NO: 3398 - RNA, 25 nt, Artificial Sequence
  Synthetic oligonucleotide
uuugaucaaaaacuauuugggauau

SEQ ID NO: 3399 - RNA, 25 nt, Artificial Sequence
  Synthetic oligonucleotide
gagguguuauuuggaaccuuguuuu

SEQ ID NO: 3400 - RNA, 25 nt, Artificial Sequence
  Synthetic oligonucleotide
guuauuuggaaccuuguuuuggaca

SEQ ID NO: 3401 - RNA, 25 nt, Artificial Sequence
  Synthetic oligonucleotide
accuuguuuuggacaguuuaccagu

SEQ ID NO: 3402 - RNA, 25 nt, Artificial Sequence
  Synthetic oligonucleotide
gauacgaugcuucaagagaaaaugc

SEQ ID NO: 3403 - RNA, 25 nt, Artificial Sequence
  Synthetic oligonucleotide
caagagaaaaugcgguuauaaaaaa

SEQ ID NO: 3404 - RNA, 25 nt, Artificial Sequence
  Synthetic oligonucleotide
gaaaaugcgguuauaaaaaaugguu

SEQ ID NO: 3405 - RNA, 25 nt, Artificial Sequence
  Synthetic oligonucleotide
guuauaaaaaaugguucagaauuaa

SEQ ID NO: 3406 - RNA, 25 nt, Artificial Sequence
  Synthetic oligonucleotide
aaaaugguucagaauuaaacuuuua

SEQ ID NO: 3407 - RNA, 25 nt, Artificial Sequence
  Synthetic oligonucleotide
gcguggacaauggcuacucaagcug

SEQ ID NO: 3408 - RNA, 25 nt, Artificial Sequence
  Synthetic oligonucleotide
cguggacaauggcuacucaagcuga

SEQ ID NO: 3409 - RNA, 25 nt, Artificial Sequence
  Synthetic oligonucleotide
guggacaauggcuacucaagcugau

SEQ ID NO: 3410 - RNA, 25 nt, Artificial Sequence
  Synthetic oligonucleotide
uggacaauggcuacucaagcugauu

SEQ ID NO: 3411 - RNA, 25 nt, Artificial Sequence
  Synthetic oligonucleotide
ggacaauggcuacucaagcugauuu

SEQ ID NO: 3412 - RNA, 25 nt, Artificial Sequence
  Synthetic oligonucleotide
gacaauggcuacucaagcugauuug

SEQ ID NO: 3413 - RNA, 25 nt, Artificial Sequence
  Synthetic oligonucleotide
acaauggcuacucaagcugauuuga

SEQ ID NO: 3414 - RNA, 25 nt, Artificial Sequence
  Synthetic oligonucleotide
caauggcuacucaagcugauuugau

SEQ ID NO: 3415 - RNA, 25 nt, Artificial Sequence
  Synthetic oligonucleotide
ugauggaguuggacauggccaugga

SEQ ID NO: 3416 - RNA, 25 nt, Artificial Sequence
  Synthetic oligonucleotide
gauggaguuggacauggccauggaa

SEQ ID NO: 3417 - RNA, 25 nt, Artificial Sequence
  Synthetic oligonucleotide
auggaguuggacauggccauggaac

SEQ ID NO: 3418 - RNA, 25 nt, Artificial Sequence
  Synthetic oligonucleotide
uggaguuggacauggccauggaacc

SEQ ID NO: 3419 - RNA, 25 nt, Artificial Sequence
  Synthetic oligonucleotide
ggaguuggacauggccauggaacca

SEQ ID NO: 3420 - RNA, 25 nt, Artificial Sequence
  Synthetic oligonucleotide
gaguuggacauggccauggaaccag

SEQ ID NO: 3421 - RNA, 25 nt, Artificial Sequence
  Synthetic oligonucleotide
aguuggacauggccauggaaccaga

SEQ ID NO: 3422 - RNA, 25 nt, Artificial Sequence
  Synthetic oligonucleotide
ucuggaauccauucuggugccacua

SEQ ID NO: 3423 - RNA, 25 nt, Artificial Sequence
  Synthetic oligonucleotide
cuggaauccauucuggugccacuac

SEQ ID NO: 3424 - RNA, 25 nt, Artificial Sequence
  Synthetic oligonucleotide
uggaauccauucuggugccacuacc

SEQ ID NO: 3425 - RNA, 25 nt, Artificial Sequence
  Synthetic oligonucleotide
ggaauccauucuggugccacuacca

SEQ ID NO: 3426 - RNA, 25 nt, Artificial Sequence
  Synthetic oligonucleotide
gaauccauucuggugccacuaccac

SEQ ID NO: 3427 - RNA, 25 nt, Artificial Sequence
  Synthetic oligonucleotide
uagaugagggcaugcagaucccauc

SEQ ID NO: 3428 - RNA, 25 nt, Artificial Sequence
  Synthetic oligonucleotide
agaugagggcaugcagaucccaucu

SEQ ID NO: 3429 - RNA, 25 nt, Artificial Sequence
  Synthetic oligonucleotide
gaugagggcaugcagaucccaucua

SEQ ID NO: 3430 - RNA, 25 nt, Artificial Sequence
  Synthetic oligonucleotide
augagggcaugcagaucccaucuac

SEQ ID NO: 3431 - RNA, 25 nt, Artificial Sequence
  Synthetic oligonucleotide
ugagggcaugcagaucccaucuaca

SEQ ID NO: 3432 - RNA, 25 nt, Artificial Sequence
  Synthetic oligonucleotide
gagggcaugcagaucccaucuacac

SEQ ID NO: 3433 - RNA, 25 nt, Artificial Sequence
  Synthetic oligonucleotide
gcugcucaucccacuaauguccagc

SEQ ID NO: 3434 - RNA, 25 nt, Artificial Sequence
  Synthetic oligonucleotide
cugcucaucccacuaauguccagcg

SEQ ID NO: 3435 - RNA, 25 nt, Artificial Sequence
  Synthetic oligonucleotide
ugcucaucccacuaauguccagcgu

SEQ ID NO: 3436 - RNA, 25 nt, Artificial Sequence
  Synthetic oligonucleotide
gcucaucccacuaauguccagcguu

SEQ ID NO: 3437 - RNA, 25 nt, Artificial Sequence
  Synthetic oligonucleotide
cucaucccacuaauguccagcguuu

SEQ ID NO: 3438 - RNA, 25 nt, Artificial Sequence
  Synthetic oligonucleotide
ucaucccacuaauguccagcguuug

SEQ ID NO: 3439 - RNA, 25 nt, Artificial Sequence
  Synthetic oligonucleotide
caucccacuaauguccagcguuugg

SEQ ID NO: 3440 - RNA, 25 nt, Artificial Sequence
  Synthetic oligonucleotide
aucccacuaauguccagcguuuggc

SEQ ID NO: 3441 - RNA, 25 nt, Artificial Sequence
  Synthetic oligonucleotide
uuggcugaaccaucacagaugcuga

SEQ ID NO: 3442 - RNA, 25 nt, Artificial Sequence
  Synthetic oligonucleotide
uggcugaaccaucacagaugcugaa

SEQ ID NO: 3443 - RNA, 25 nt, Artificial Sequence
  Synthetic oligonucleotide
ggcugaaccaucacagaugcugaaa

SEQ ID NO: 3444 - RNA, 25 nt, Artificial Sequence
  Synthetic oligonucleotide
gaacuugccacacgugcaaucccug

SEQ ID NO: 3445 - RNA, 25 nt, Artificial Sequence
  Synthetic oligonucleotide
aacuugccacacgugcaaucccuga

SEQ ID NO: 3446 - RNA, 25 nt, Artificial Sequence
  Synthetic oligonucleotide
guuaugguccaucagcuuucuaaaa

SEQ ID NO: 3447 - RNA, 25 nt, Artificial Sequence
  Synthetic oligonucleotide
uuaugguccaucagcuuucuaaaaa

SEQ ID NO: 3448 - RNA, 25 nt, Artificial Sequence
  Synthetic oligonucleotide
aaaaaggaagcuuccagacacgcua

SEQ ID NO: 3449 - RNA, 25 nt, Artificial Sequence
  Synthetic oligonucleotide
aaaaggaagcuuccagacacgcuau

SEQ ID NO: 3450 - RNA, 25 nt, Artificial Sequence
  Synthetic oligonucleotide
accaugcagaauacaaaugauguag

SEQ ID NO: 3451 - RNA, 25 nt, Artificial Sequence
  Synthetic oligonucleotide
ccaugcagaauacaaaugauguaga

SEQ ID NO: 3452 - RNA, 25 nt, Artificial Sequence
  Synthetic oligonucleotide
caugcagaauacaaaugauguagaa

SEQ ID NO: 3453 - RNA, 25 nt, Artificial Sequence
  Synthetic oligonucleotide
augcagaauacaaaugauguagaaa

SEQ ID NO: 3454 - RNA, 25 nt, Artificial Sequence
  Synthetic oligonucleotide
ugcagaauacaaaugauguagaaac

SEQ ID NO: 3455 - RNA, 25 nt, Artificial Sequence
  Synthetic oligonucleotide
gcagaauacaaaugauguagaaaca

SEQ ID NO: 3456 - RNA, 25 nt, Artificial Sequence
  Synthetic oligonucleotide
cagaauacaaaugauguagaaacag

SEQ ID NO: 3457 - RNA, 25 nt, Artificial Sequence
  Synthetic oligonucleotide
agaauacaaaugauguagaaacagc

SEQ ID NO: 3458 - RNA, 25 nt, Artificial Sequence
  Synthetic oligonucleotide
cuggccaucuuuaagucuggaggca

SEQ ID NO: 3459 - RNA, 25 nt, Artificial Sequence
  Synthetic oligonucleotide
uggccaucuuuaagucuggaggcau

SEQ ID NO: 3460 - RNA, 25 nt, Artificial Sequence
  Synthetic oligonucleotide
gaaggagcuaaaauggcagugcguu

SEQ ID NO: 3461 - RNA, 25 nt, Artificial Sequence
  Synthetic oligonucleotide
aaggagcuaaaauggcagugcguuu

SEQ ID NO: 3462 - RNA, 25 nt, Artificial Sequence
  Synthetic oligonucleotide
aggagcuaaaauggcagugcguuua

SEQ ID NO: 3463 - RNA, 25 nt, Artificial Sequence
  Synthetic oligonucleotide
ggagcuaaaauggcagugcguuuag

SEQ ID NO: 3464 - RNA, 25 nt, Artificial Sequence
  Synthetic oligonucleotide
gagcuaaaauggcagugcguuuagc

SEQ ID NO: 3465 - RNA, 25 nt, Artificial Sequence
  Synthetic oligonucleotide
cuguggaccacaagcagagugcuga

SEQ ID NO: 3466 - RNA, 25 nt, Artificial Sequence
  Synthetic oligonucleotide
uguggaccacaagcagagugcugaa

SEQ ID NO: 3467 - RNA, 25 nt, Artificial Sequence
  Synthetic oligonucleotide
guggaccacaagcagagugcugaag

SEQ ID NO: 3468 - RNA, 25 nt, Artificial Sequence
  Synthetic oligonucleotide
uggaccacaagcagagugcugaagg

SEQ ID NO: 3469 - RNA, 25 nt, Artificial Sequence
  Synthetic oligonucleotide
ggaccacaagcagagugcugaaggu

SEQ ID NO: 3470 - RNA, 25 nt, Artificial Sequence
  Synthetic oligonucleotide
gaccacaagcagagugcugaaggug

SEQ ID NO: 3471 - RNA, 25 nt, Artificial Sequence
  Synthetic oligonucleotide
accacaagcagagugcugaaggugc

SEQ ID NO: 3472 - RNA, 25 nt, Artificial Sequence
  Synthetic oligonucleotide
ccacaagcagagugcugaaggugcu

SEQ ID NO: 3473 - RNA, 25 nt, Artificial Sequence
  Synthetic oligonucleotide
cacaagcagagugcugaaggugcua

SEQ ID NO: 3474 - RNA, 25 nt, Artificial Sequence
  Synthetic oligonucleotide
acaagcagagugcugaaggugcuau

SEQ ID NO: 3475 - RNA, 25 nt, Artificial Sequence
  Synthetic oligonucleotide
caagcagagugcugaaggugcuauc

SEQ ID NO: 3476 - RNA, 25 nt, Artificial Sequence
  Synthetic oligonucleotide
aagcagagugcugaaggugcuaucu

SEQ ID NO: 3477 - RNA, 25 nt, Artificial Sequence
  Synthetic oligonucleotide
agcagagugcugaaggugcuaucug

SEQ ID NO: 3478 - RNA, 25 nt, Artificial Sequence
  Synthetic oligonucleotide
gcagagugcugaaggugcuaucugu

SEQ ID NO: 3479 - RNA, 25 nt, Artificial Sequence
  Synthetic oligonucleotide
aacugucuuuggacucucaggaauc

SEQ ID NO: 3480 - RNA, 25 nt, Artificial Sequence
  Synthetic oligonucleotide
acugucuuuggacucucaggaaucu

SEQ ID NO: 3481 - RNA, 25 nt, Artificial Sequence
  Synthetic oligonucleotide
gaugauauaaauguggucaccugug

SEQ ID NO: 3482 - RNA, 25 nt, Artificial Sequence
  Synthetic oligonucleotide
augauauaaauguggucaccugugc

SEQ ID NO: 3483 - RNA, 25 nt, Artificial Sequence
  Synthetic oligonucleotide
ugauauaaauguggucaccugugca

SEQ ID NO: 3484 - RNA, 25 nt, Artificial Sequence
  Synthetic oligonucleotide
gauauaaauguggucaccugugcag

SEQ ID NO: 3485 - RNA, 25 nt, Artificial Sequence
  Synthetic oligonucleotide
auauaaauguggucaccugugcagc

SEQ ID NO: 3486 - RNA, 25 nt, Artificial Sequence
  Synthetic oligonucleotide
uauaaauguggucaccugugcagcu

SEQ ID NO: 3487 - RNA, 25 nt, Artificial Sequence
  Synthetic oligonucleotide
auaaauguggucaccugugcagcug

SEQ ID NO: 3488 - RNA, 25 nt, Artificial Sequence
  Synthetic oligonucleotide
uaaauguggucaccugugcagcugg

SEQ ID NO: 3489 - RNA, 25 nt, Artificial Sequence
  Synthetic oligonucleotide
aaauguggucaccugugcagcugga

SEQ ID NO: 3490 - RNA, 25 nt, Artificial Sequence
  Synthetic oligonucleotide
aauguggucaccugugcagcuggaa

SEQ ID NO: 3491 - RNA, 25 nt, Artificial Sequence
  Synthetic oligonucleotide
auguggucaccugugcagcuggaau

SEQ ID NO: 3492 - RNA, 25 nt, Artificial Sequence
  Synthetic oligonucleotide
uguggucaccugugcagcuggaauu

SEQ ID NO: 3493 - RNA, 25 nt, Artificial Sequence
  Synthetic oligonucleotide
guggucaccugugcagcuggaauuc

SEQ ID NO: 3494 - RNA, 25 nt, Artificial Sequence
  Synthetic oligonucleotide
uggucaccugugcagcuggaauucu

SEQ ID NO: 3495 - RNA, 25 nt, Artificial Sequence
  Synthetic oligonucleotide
ggucaccugugcagcuggaauucuu

SEQ ID NO: 3496 - RNA, 25 nt, Artificial Sequence
  Synthetic oligonucleotide
gucaccugugcagcuggaauucuuu

SEQ ID NO: 3497 - RNA, 25 nt, Artificial Sequence
  Synthetic oligonucleotide
ucaccugugcagcuggaauucuuuc

SEQ ID NO: 3498 - RNA, 25 nt, Artificial Sequence
  Synthetic oligonucleotide
caccugugcagcuggaauucuuucu

SEQ ID NO: 3499 - RNA, 25 nt, Artificial Sequence
  Synthetic oligonucleotide
accugugcagcuggaauucuuucua

SEQ ID NO: 3500 - RNA, 25 nt, Artificial Sequence
  Synthetic oligonucleotide
ccugugcagcuggaauucuuucuaa

SEQ ID NO: 3501 - RNA, 25 nt, Artificial Sequence
  Synthetic oligonucleotide
ucuaaccucacuugcaauaauuaua

SEQ ID NO: 3502 - RNA, 25 nt, Artificial Sequence
  Synthetic oligonucleotide
cuaaccucacuugcaauaauuauaa

SEQ ID NO: 3503 - RNA, 25 nt, Artificial Sequence
  Synthetic oligonucleotide
uaaccucacuugcaauaauuauaag

SEQ ID NO: 3504 - RNA, 25 nt, Artificial Sequence
  Synthetic oligonucleotide
aaccucacuugcaauaauuauaaga

SEQ ID NO: 3505 - RNA, 25 nt, Artificial Sequence
  Synthetic oligonucleotide
accucacuugcaauaauuauaagaa

SEQ ID NO: 3506 - RNA, 25 nt, Artificial Sequence
  Synthetic oligonucleotide
gcuggugacagggaagacaucacug

SEQ ID NO: 3507 - RNA, 25 nt, Artificial Sequence
  Synthetic oligonucleotide
cuggugacagggaagacaucacuga

SEQ ID NO: 3508 - RNA, 25 nt, Artificial Sequence
  Synthetic oligonucleotide
uggugacagggaagacaucacugag

SEQ ID NO: 3509 - RNA, 25 nt, Artificial Sequence
  Synthetic oligonucleotide
ggugacagggaagacaucacugagc

SEQ ID NO: 3510 - RNA, 25 nt, Artificial Sequence
  Synthetic oligonucleotide
gugacagggaagacaucacugagcc

SEQ ID NO: 3511 - RNA, 25 nt, Artificial Sequence
  Synthetic oligonucleotide
ugacagggaagacaucacugagccu

SEQ ID NO: 3512 - RNA, 25 nt, Artificial Sequence
  Synthetic oligonucleotide
gacagggaagacaucacugagccug

SEQ ID NO: 3513 - RNA, 25 nt, Artificial Sequence
  Synthetic oligonucleotide
acagggaagacaucacugagccugc

SEQ ID NO: 3514 - RNA, 25 nt, Artificial Sequence
  Synthetic oligonucleotide
cagggaagacaucacugagccugcc

SEQ ID NO: 3515 - RNA, 25 nt, Artificial Sequence
  Synthetic oligonucleotide
agggaagacaucacugagccugcca

SEQ ID NO: 3516 - RNA, 25 nt, Artificial Sequence
  Synthetic oligonucleotide
gggaagacaucacugagccugccau

SEQ ID NO: 3517 - RNA, 25 nt, Artificial Sequence
  Synthetic oligonucleotide
ggaagacaucacugagccugccauc

SEQ ID NO: 3518 - RNA, 25 nt, Artificial Sequence
  Synthetic oligonucleotide
gaagacaucacugagccugccaucu

SEQ ID NO: 3519 - RNA, 25 nt, Artificial Sequence
  Synthetic oligonucleotide
aagacaucacugagccugccaucug

SEQ ID NO: 3520 - RNA, 25 nt, Artificial Sequence
  Synthetic oligonucleotide
agacaucacugagccugccaucugu

SEQ ID NO: 3521 - RNA, 25 nt, Artificial Sequence
  Synthetic oligonucleotide
gacaucacugagccugccaucugug

SEQ ID NO: 3522 - RNA, 25 nt, Artificial Sequence
  Synthetic oligonucleotide
acaucacugagccugccaucugugc

SEQ ID NO: 3523 - RNA, 25 nt, Artificial Sequence
  Synthetic oligonucleotide
caucacugagccugccaucugugcu

SEQ ID NO: 3524 - RNA, 25 nt, Artificial Sequence
  Synthetic oligonucleotide
aucacugagccugccaucugugcuc

SEQ ID NO: 3525 - RNA, 25 nt, Artificial Sequence
  Synthetic oligonucleotide
ucacugagccugccaucugugcucu

SEQ ID NO: 3526 - RNA, 25 nt, Artificial Sequence
  Synthetic oligonucleotide
cacugagccugccaucugugcucuu

SEQ ID NO: 3527 - RNA, 25 nt, Artificial Sequence
  Synthetic oligonucleotide
acugagccugccaucugugcucuuc

SEQ ID NO: 3528 - RNA, 25 nt, Artificial Sequence
  Synthetic oligonucleotide
cugagccugccaucugugcucuucg

SEQ ID NO: 3529 - RNA, 25 nt, Artificial Sequence
  Synthetic oligonucleotide
ugagccugccaucugugcucuucgu

SEQ ID NO: 3530 - RNA, 25 nt, Artificial Sequence
  Synthetic oligonucleotide
gagccugccaucugugcucuucguc

SEQ ID NO: 3531 - RNA, 25 nt, Artificial Sequence
  Synthetic oligonucleotide
agccugccaucugugcucuucguca

SEQ ID NO: 3532 - RNA, 25 nt, Artificial Sequence
  Synthetic oligonucleotide
gccugccaucugugcucuucgucau

SEQ ID NO: 3533 - RNA, 25 nt, Artificial Sequence
  Synthetic oligonucleotide
ccugccaucugugcucuucgucauc

SEQ ID NO: 3534 - RNA, 25 nt, Artificial Sequence
  Synthetic oligonucleotide
cugccaucugugcucuucgucaucu

SEQ ID NO: 3535 - RNA, 25 nt, Artificial Sequence
  Synthetic oligonucleotide
ugccaucugugcucuucgucaucug

SEQ ID NO: 3536 - RNA, 25 nt, Artificial Sequence
  Synthetic oligonucleotide
gccaucugugcucuucgucaucuga

SEQ ID NO: 3537 - RNA, 25 nt, Artificial Sequence
  Synthetic oligonucleotide
ccaucugugcucuucgucaucugac

SEQ ID NO: 3538 - RNA, 25 nt, Artificial Sequence
  Synthetic oligonucleotide
caucugugcucuucgucaucugacc

SEQ ID NO: 3539 - RNA, 25 nt, Artificial Sequence
  Synthetic oligonucleotide
aucugugcucuucgucaucugacca

SEQ ID NO: 3540 - RNA, 25 nt, Artificial Sequence
  Synthetic oligonucleotide
ucugugcucuucgucaucugaccag

SEQ ID NO: 3541 - RNA, 25 nt, Artificial Sequence
  Synthetic oligonucleotide
cugugcucuucgucaucugaccagc

SEQ ID NO: 3542 - RNA, 25 nt, Artificial Sequence
  Synthetic oligonucleotide
ugugcucuucgucaucugaccagcc

SEQ ID NO: 3543 - RNA, 25 nt, Artificial Sequence
  Synthetic oligonucleotide
gugcucuucgucaucugaccagccg

SEQ ID NO: 3544 - RNA, 25 nt, Artificial Sequence
  Synthetic oligonucleotide
ugcucuucgucaucugaccagccga

SEQ ID NO: 3545 - RNA, 25 nt, Artificial Sequence
  Synthetic oligonucleotide
gcucuucgucaucugaccagccgac

SEQ ID NO: 3546 - RNA, 25 nt, Artificial Sequence
  Synthetic oligonucleotide
cucuucgucaucugaccagccgaca

SEQ ID NO: 3547 - RNA, 25 nt, Artificial Sequence
  Synthetic oligonucleotide
ucuucgucaucugaccagccgacac

SEQ ID NO: 3548 - RNA, 25 nt, Artificial Sequence
  Synthetic oligonucleotide
cuucgucaucugaccagccgacacc

SEQ ID NO: 3549 - RNA, 25 nt, Artificial Sequence
  Synthetic oligonucleotide
uucgucaucugaccagccgacacca

SEQ ID NO: 3550 - RNA, 25 nt, Artificial Sequence
  Synthetic oligonucleotide
cacccaccaucccacuggccucuga

SEQ ID NO: 3551 - RNA, 25 nt, Artificial Sequence
  Synthetic oligonucleotide
acccaccaucccacuggccucugau

SEQ ID NO: 3552 - RNA, 25 nt, Artificial Sequence
  Synthetic oligonucleotide
cccaccaucccacuggccucugaua

SEQ ID NO: 3553 - RNA, 25 nt, Artificial Sequence
  Synthetic oligonucleotide
ccaccaucccacuggccucugauaa

SEQ ID NO: 3554 - RNA, 25 nt, Artificial Sequence
  Synthetic oligonucleotide
caccaucccacuggccucugauaaa

SEQ ID NO: 3555 - RNA, 25 nt, Artificial Sequence
  Synthetic oligonucleotide
accaucccacuggccucugauaaag

SEQ ID NO: 3556 - RNA, 25 nt, Artificial Sequence
  Synthetic oligonucleotide
ccaucccacuggccucugauaaagg

SEQ ID NO: 3557 - RNA, 25 nt, Artificial Sequence
  Synthetic oligonucleotide
caucccacuggccucugauaaaggc

SEQ ID NO: 3558 - RNA, 25 nt, Artificial Sequence
  Synthetic oligonucleotide
aucccacuggccucugauaaaggcu

SEQ ID NO: 3559 - RNA, 25 nt, Artificial Sequence
  Synthetic oligonucleotide
ucccacuggccucugauaaaggcua

SEQ ID NO: 3560 - RNA, 25 nt, Artificial Sequence
  Synthetic oligonucleotide
cccacuggccucugauaaaggcuac

SEQ ID NO: 3561 - RNA, 25 nt, Artificial Sequence
  Synthetic oligonucleotide
ccacuggccucugauaaaggcuacu

SEQ ID NO: 3562 - RNA, 25 nt, Artificial Sequence
  Synthetic oligonucleotide
cacuggccucugauaaaggcuacug

SEQ ID NO: 3563 - RNA, 25 nt, Artificial Sequence
  Synthetic oligonucleotide
acuggccucugauaaaggcuacugu

SEQ ID NO: 3564 - RNA, 25 nt, Artificial Sequence
  Synthetic oligonucleotide
acuguuggauugauucgaaaucuug

SEQ ID NO: 3565 - RNA, 25 nt, Artificial Sequence
  Synthetic oligonucleotide
cuguuggauugauucgaaaucuugc

SEQ ID NO: 3566 - RNA, 25 nt, Artificial Sequence
  Synthetic oligonucleotide
aauaccauuccauuguuugugcagc

SEQ ID NO: 3567 - RNA, 25 nt, Artificial Sequence
  Synthetic oligonucleotide
auaccauuccauuguuugugcagcu

SEQ ID NO: 3568 - RNA, 25 nt, Artificial Sequence
  Synthetic oligonucleotide
uaccauuccauuguuugugcagcug

SEQ ID NO: 3569 - RNA, 25 nt, Artificial Sequence
  Synthetic oligonucleotide
accauuccauuguuugugcagcugc

SEQ ID NO: 3570 - RNA, 25 nt, Artificial Sequence
  Synthetic oligonucleotide
ccauuccauuguuugugcagcugcu

SEQ ID NO: 3571 - RNA, 25 nt, Artificial Sequence
  Synthetic oligonucleotide
cauuccauuguuugugcagcugcuu

SEQ ID NO: 3572 - RNA, 25 nt, Artificial Sequence
  Synthetic oligonucleotide
ugcuuuauucucccauugaaaacau

SEQ ID NO: 3573 - RNA, 25 nt, Artificial Sequence
  Synthetic oligonucleotide
gcuuuauucucccauugaaaacauc

SEQ ID NO: 3574 - RNA, 25 nt, Artificial Sequence
  Synthetic oligonucleotide
cuuuauucucccauugaaaacaucc

SEQ ID NO: 3575 - RNA, 25 nt, Artificial Sequence
  Synthetic oligonucleotide
uuuauucucccauugaaaacaucca

SEQ ID NO: 3576 - RNA, 25 nt, Artificial Sequence
  Synthetic oligonucleotide
guccucugugaacuugcucaggaca

SEQ ID NO: 3577 - RNA, 25 nt, Artificial Sequence
  Synthetic oligonucleotide
uccucugugaacuugcucaggacaa

SEQ ID NO: 3578 - RNA, 25 nt, Artificial Sequence
  Synthetic oligonucleotide
ccucugugaacuugcucaggacaag

SEQ ID NO: 3579 - RNA, 25 nt, Artificial Sequence
  Synthetic oligonucleotide
cucugugaacuugcucaggacaagg

SEQ ID NO: 3580 - RNA, 25 nt, Artificial Sequence
  Synthetic oligonucleotide
ucugugaacuugcucaggacaagga

SEQ ID NO: 3581 - RNA, 25 nt, Artificial Sequence
  Synthetic oligonucleotide
cugugaacuugcucaggacaaggaa

SEQ ID NO: 3582 - RNA, 25 nt, Artificial Sequence
  Synthetic oligonucleotide
ugugaacuugcucaggacaaggaag

SEQ ID NO: 3583 - RNA, 25 nt, Artificial Sequence
  Synthetic oligonucleotide
gugaacuugcucaggacaaggaagc

SEQ ID NO: 3584 - RNA, 25 nt, Artificial Sequence
  Synthetic oligonucleotide
ugaacuugcucaggacaaggaagcu

SEQ ID NO: 3585 - RNA, 25 nt, Artificial Sequence
  Synthetic oligonucleotide
gaacuugcucaggacaaggaagcug

SEQ ID NO: 3586 - RNA, 25 nt, Artificial Sequence
  Synthetic oligonucleotide
aacuugcucaggacaaggaagcugc

SEQ ID NO: 3587 - RNA, 25 nt, Artificial Sequence
  Synthetic oligonucleotide
auugaagcugagggagccacagcuc

SEQ ID NO: 3588 - RNA, 25 nt, Artificial Sequence
  Synthetic oligonucleotide
uugaagcugagggagccacagcucc

SEQ ID NO: 3589 - RNA, 25 nt, Artificial Sequence
  Synthetic oligonucleotide
ugaagcugagggagccacagcuccu

SEQ ID NO: 3590 - RNA, 25 nt, Artificial Sequence
  Synthetic oligonucleotide
uuccgaaugucugaggacaagccac

SEQ ID NO: 3591 - RNA, 25 nt, Artificial Sequence
  Synthetic oligonucleotide
uccgaaugucugaggacaagccaca

SEQ ID NO: 3592 - RNA, 25 nt, Artificial Sequence
  Synthetic oligonucleotide
ccgaaugucugaggacaagccacaa

SEQ ID NO: 3593 - RNA, 25 nt, Artificial Sequence
  Synthetic oligonucleotide
cgaaugucugaggacaagccacaag

SEQ ID NO: 3594 - RNA, 25 nt, Artificial Sequence
  Synthetic oligonucleotide
gaaugucugaggacaagccacaaga

SEQ ID NO: 3595 - RNA, 25 nt, Artificial Sequence
  Synthetic oligonucleotide
aaugucugaggacaagccacaagau

SEQ ID NO: 3596 - RNA, 25 nt, Artificial Sequence
  Synthetic oligonucleotide
augucugaggacaagccacaagauu

SEQ ID NO: 3597 - RNA, 25 nt, Artificial Sequence
  Synthetic oligonucleotide
ugucugaggacaagccacaagauua

SEQ ID NO: 3598 - RNA, 25 nt, Artificial Sequence
  Synthetic oligonucleotide
acagagccaauggcuuggaaugaga

SEQ ID NO: 3599 - RNA, 25 nt, Artificial Sequence
  Synthetic oligonucleotide
cagagccaauggcuuggaaugagac

SEQ ID NO: 3600 - RNA, 25 nt, Artificial Sequence
  Synthetic oligonucleotide
agagccaauggcuuggaaugagacu

SEQ ID NO: 3601 - RNA, 25 nt, Artificial Sequence
  Synthetic oligonucleotide
gagccaauggcuuggaaugagacug

SEQ ID NO: 3602 - RNA, 25 nt, Artificial Sequence
  Synthetic oligonucleotide
agccaauggcuuggaaugagacugc

SEQ ID NO: 3603 - RNA, 25 nt, Artificial Sequence
  Synthetic oligonucleotide
gccaauggcuuggaaugagacugcu

SEQ ID NO: 3604 - RNA, 25 nt, Artificial Sequence
  Synthetic oligonucleotide
ccaauggcuuggaaugagacugcug

SEQ ID NO: 3605 - RNA, 25 nt, Artificial Sequence
  Synthetic oligonucleotide
caauggcuuggaaugagacugcuga

SEQ ID NO: 3606 - RNA, 25 nt, Artificial Sequence
  Synthetic oligonucleotide
aauggcuuggaaugagacugcugau

SEQ ID NO: 3607 - RNA, 25 nt, Artificial Sequence
  Synthetic oligonucleotide
auggcuuggaaugagacugcugauc

SEQ ID NO: 3608 - RNA, 25 nt, Artificial Sequence
  Synthetic oligonucleotide
uggcuuggaaugagacugcugaucu

SEQ ID NO: 3609 - RNA, 25 nt, Artificial Sequence
  Synthetic oligonucleotide
cuuggauaucgccaggaugauccua

SEQ ID NO: 3610 - RNA, 25 nt, Artificial Sequence
  Synthetic oligonucleotide
uuggauaucgccaggaugauccuag

SEQ ID NO: 3611 - RNA, 25 nt, Artificial Sequence
  Synthetic oligonucleotide
uggauaucgccaggaugauccuagc

SEQ ID NO: 3612 - RNA, 25 nt, Artificial Sequence
  Synthetic oligonucleotide
ggauaucgccaggaugauccuagcu

SEQ ID NO: 3613 - RNA, 25 nt, Artificial Sequence
  Synthetic oligonucleotide
gauaucgccaggaugauccuagcua

SEQ ID NO: 3614 - RNA, 25 nt, Artificial Sequence
  Synthetic oligonucleotide
cguucuuuucacucugguggauaug

SEQ ID NO: 3615 - RNA, 25 nt, Artificial Sequence
  Synthetic oligonucleotide
guucuuuucacucugguggauaugg

SEQ ID NO: 3616 - RNA, 25 nt, Artificial Sequence
  Synthetic oligonucleotide
uucuuuucacucugguggauauggc

SEQ ID NO: 3617 - RNA, 25 nt, Artificial Sequence
  Synthetic oligonucleotide
ucuuuucacucugguggauauggcc

SEQ ID NO: 3618 - RNA, 25 nt, Artificial Sequence
  Synthetic oligonucleotide
cuuuucacucugguggauauggcca

SEQ ID NO: 3619 - RNA, 25 nt, Artificial Sequence
  Synthetic oligonucleotide
caugagauggguggccaccacccug

SEQ ID NO: 3620 - RNA, 25 nt, Artificial Sequence
  Synthetic oligonucleotide
augagauggguggccaccacccugg

SEQ ID NO: 3621 - RNA, 25 nt, Artificial Sequence
  Synthetic oligonucleotide
ugagauggguggccaccacccuggu

SEQ ID NO: 3622 - RNA, 25 nt, Artificial Sequence
  Synthetic oligonucleotide
gagauggguggccaccacccuggug

SEQ ID NO: 3623 - RNA, 25 nt, Artificial Sequence
  Synthetic oligonucleotide
agauggguggccaccacccuggugc

SEQ ID NO: 3624 - RNA, 25 nt, Artificial Sequence
  Synthetic oligonucleotide
gauggguggccaccacccuggugcu

SEQ ID NO: 3625 - RNA, 25 nt, Artificial Sequence
  Synthetic oligonucleotide
auggguggccaccacccuggugcug

SEQ ID NO: 3626 - RNA, 25 nt, Artificial Sequence
  Synthetic oligonucleotide
uggguggccaccacccuggugcuga

SEQ ID NO: 3627 - RNA, 25 nt, Artificial Sequence
  Synthetic oligonucleotide
ggguggccaccacccuggugcugac

SEQ ID NO: 3628 - RNA, 25 nt, Artificial Sequence
  Synthetic oligonucleotide
gguggccaccacccuggugcugacu

SEQ ID NO: 3629 - RNA, 25 nt, Artificial Sequence
  Synthetic oligonucleotide
guggccaccacccuggugcugacua

SEQ ID NO: 3630 - RNA, 25 nt, Artificial Sequence
  Synthetic oligonucleotide
uggccaccacccuggugcugacuau

SEQ ID NO: 3631 - RNA, 25 nt, Artificial Sequence
  Synthetic oligonucleotide
ggccaccacccuggugcugacuauc

SEQ ID NO: 3632 - RNA, 25 nt, Artificial Sequence
  Synthetic oligonucleotide
gccaccacccuggugcugacuaucc

SEQ ID NO: 3633 - RNA, 25 nt, Artificial Sequence
  Synthetic oligonucleotide
ccaccacccuggugcugacuaucca

SEQ ID NO: 3634 - RNA, 25 nt, Artificial Sequence
  Synthetic oligonucleotide
caccacccuggugcugacuauccag

SEQ ID NO: 3635 - RNA, 25 nt, Artificial Sequence
  Synthetic oligonucleotide
accacccuggugcugacuauccagu

SEQ ID NO: 3636 - RNA, 25 nt, Artificial Sequence
  Synthetic oligonucleotide
ccacccuggugcugacuauccaguu

SEQ ID NO: 3637 - RNA, 25 nt, Artificial Sequence
  Synthetic oligonucleotide
cacccuggugcugacuauccaguug

SEQ ID NO: 3638 - RNA, 25 nt, Artificial Sequence
  Synthetic oligonucleotide
acccuggugcugacuauccaguuga

SEQ ID NO: 3639 - RNA, 25 nt, Artificial Sequence
  Synthetic oligonucleotide
cccuggugcugacuauccaguugau

SEQ ID NO: 3640 - RNA, 25 nt, Artificial Sequence
  Synthetic oligonucleotide
ccuggugcugacuauccaguugaug

SEQ ID NO: 3641 - RNA, 25 nt, Artificial Sequence
  Synthetic oligonucleotide
cuggugcugacuauccaguugaugg

SEQ ID NO: 3642 - RNA, 25 nt, Artificial Sequence
  Synthetic oligonucleotide
uggugcugacuauccaguugauggg

SEQ ID NO: 3643 - RNA, 25 nt, Artificial Sequence
  Synthetic oligonucleotide
ggugcugacuauccaguugaugggc

SEQ ID NO: 3644 - RNA, 25 nt, Artificial Sequence
  Synthetic oligonucleotide
gugcugacuauccaguugaugggcu

SEQ ID NO: 3645 - RNA, 25 nt, Artificial Sequence
  Synthetic oligonucleotide
ugcugacuauccaguugaugggcug

SEQ ID NO: 3646 - RNA, 25 nt, Artificial Sequence
  Synthetic oligonucleotide
gcugacuauccaguugaugggcugc

SEQ ID NO: 3647 - RNA, 25 nt, Artificial Sequence
  Synthetic oligonucleotide
cugacuauccaguugaugggcugcc

SEQ ID NO: 3648 - RNA, 25 nt, Artificial Sequence
  Synthetic oligonucleotide
ugacuauccaguugaugggcugcca

SEQ ID NO: 3649 - RNA, 25 nt, Artificial Sequence
  Synthetic oligonucleotide
gacuauccaguugaugggcugccag

SEQ ID NO: 3650 - RNA, 25 nt, Artificial Sequence
  Synthetic oligonucleotide
acuauccaguugaugggcugccaga

SEQ ID NO: 3651 - RNA, 25 nt, Artificial Sequence
  Synthetic oligonucleotide
cuauccaguugaugggcugccagau

SEQ ID NO: 3652 - RNA, 25 nt, Artificial Sequence
  Synthetic oligonucleotide
uauccaguugaugggcugccagauc

SEQ ID NO: 3653 - RNA, 25 nt, Artificial Sequence
  Synthetic oligonucleotide
auccaguugaugggcugccagaucu

SEQ ID NO: 3654 - RNA, 25 nt, Artificial Sequence
  Synthetic oligonucleotide
gcccaggaccucauggaugggcugc

SEQ ID NO: 3655 - RNA, 25 nt, Artificial Sequence
  Synthetic oligonucleotide
cccaggaccucauggaugggcugcc

SEQ ID NO: 3656 - RNA, 25 nt, Artificial Sequence
  Synthetic oligonucleotide
ccaggaccucauggaugggcugccu

SEQ ID NO: 3657 - RNA, 25 nt, Artificial Sequence
  Synthetic oligonucleotide
agcaaucagcuggccugguuugaua

SEQ ID NO: 3658 - RNA, 25 nt, Artificial Sequence
  Synthetic oligonucleotide
gcaaucagcuggccugguuugauac

SEQ ID NO: 3659 - RNA, 25 nt, Artificial Sequence
  Synthetic oligonucleotide
caaucagcuggccugguuugauacu

SEQ ID NO: 3660 - RNA, 25 nt, Artificial Sequence
  Synthetic oligonucleotide
aaucagcuggccugguuugauacug

SEQ ID NO: 3661 - RNA, 25 nt, Artificial Sequence
  Synthetic oligonucleotide
aucagcuggccugguuugauacuga

SEQ ID NO: 3662 - RNA, 25 nt, Artificial Sequence
  Synthetic oligonucleotide
ucagcuggccugguuugauacugac

SEQ ID NO: 3663 - RNA, 25 nt, Artificial Sequence
  Synthetic oligonucleotide
cagcuggccugguuugauacugacc

SEQ ID NO: 3664 - RNA, 25 nt, Artificial Sequence
  Synthetic oligonucleotide
agcuggccugguuugauacugaccu

SEQ ID NO: 3665 - RNA, 25 nt, Artificial Sequence
  Synthetic oligonucleotide
gcuggccugguuugauacugaccug

SEQ ID NO: 3666 - RNA, 25 nt, Artificial Sequence
  Synthetic oligonucleotide
cuggccugguuugauacugaccugu

SEQ ID NO: 3667 - RNA, 25 nt, Artificial Sequence
  Synthetic oligonucleotide
uggccugguuugauacugaccugua

SEQ ID NO: 3668 - RNA, 25 nt, Artificial Sequence
  Synthetic oligonucleotide
ggccugguuugauacugaccuguaa

SEQ ID NO: 3669 - RNA, 25 nt, Artificial Sequence
  Synthetic oligonucleotide
gccugguuugauacugaccuguaaa

SEQ ID NO: 3670 - RNA, 25 nt, Artificial Sequence
  Synthetic oligonucleotide
ccugguuugauacugaccuguaaau

SEQ ID NO: 3671 - RNA, 25 nt, Artificial Sequence
  Synthetic oligonucleotide
cugguuugauacugaccuguaaauc

SEQ ID NO: 3672 - RNA, 25 nt, Artificial Sequence
  Synthetic oligonucleotide
ugguuugauacugaccuguaaauca

SEQ ID NO: 3673 - RNA, 25 nt, Artificial Sequence
  Synthetic oligonucleotide
gguuugauacugaccuguaaaucau

SEQ ID NO: 3674 - RNA, 25 nt, Artificial Sequence
  Synthetic oligonucleotide
guuugauacugaccuguaaaucauc

SEQ ID NO: 3675 - RNA, 25 nt, Artificial Sequence
  Synthetic oligonucleotide
uuugauacugaccuguaaaucaucc

SEQ ID NO: 3676 - RNA, 25 nt, Artificial Sequence
  Synthetic oligonucleotide
uugauacugaccuguaaaucauccu

SEQ ID NO: 3677 - RNA, 25 nt, Artificial Sequence
  Synthetic oligonucleotide
ugauacugaccuguaaaucauccuu

SEQ ID NO: 3678 - RNA, 25 nt, Artificial Sequence
  Synthetic oligonucleotide
uuuugccacagcuuuugcaacuuaa

SEQ ID NO: 3679 - RNA, 25 nt, Artificial Sequence
  Synthetic oligonucleotide
ugaguaacauuugcuguuuuaaaca

SEQ ID NO: 3680 - RNA, 25 nt, Artificial Sequence
  Synthetic oligonucleotide
aacauuaauagcagccuuucucucu

SEQ ID NO: 3681 - RNA, 25 nt, Artificial Sequence
  Synthetic oligonucleotide
cauuaauagcagccuuucucucuuu

SEQ ID NO: 3682 - RNA, 25 nt, Artificial Sequence
  Synthetic oligonucleotide
uuaauagcagccuuucucucuuuau

SEQ ID NO: 3683 - RNA, 25 nt, Artificial Sequence
  Synthetic oligonucleotide
aauagcagccuuucucucuuuauac

SEQ ID NO: 3684 - RNA, 25 nt, Artificial Sequence
  Synthetic oligonucleotide
gcauugugauuggccuguagaguug

SEQ ID NO: 3685 - RNA, 25 nt, Artificial Sequence
  Synthetic oligonucleotide
auugugauuggccuguagaguugcu

SEQ ID NO: 3686 - RNA, 25 nt, Artificial Sequence
  Synthetic oligonucleotide
ugugauuggccuguagaguugcuga

SEQ ID NO: 3687 - RNA, 25 nt, Artificial Sequence
  Synthetic oligonucleotide
ugauuggccuguagaguugcugaga

SEQ ID NO: 3688 - RNA, 25 nt, Artificial Sequence
  Synthetic oligonucleotide
auuggccuguagaguugcugagagg

SEQ ID NO: 3689 - RNA, 25 nt, Artificial Sequence
  Synthetic oligonucleotide
uggccuguagaguugcugagagggc

SEQ ID NO: 3690 - RNA, 25 nt, Artificial Sequence
  Synthetic oligonucleotide
gccuguagaguugcugagagggcuc

SEQ ID NO: 3691 - RNA, 25 nt, Artificial Sequence
  Synthetic oligonucleotide
cuguagaguugcugagagggcucga

SEQ ID NO: 3692 - RNA, 25 nt, Artificial Sequence
  Synthetic oligonucleotide
guagaguugcugagagggcucgagg

SEQ ID NO: 3693 - RNA, 25 nt, Artificial Sequence
  Synthetic oligonucleotide
gugggcugguaucucagaaagugcc

SEQ ID NO: 3694 - RNA, 25 nt, Artificial Sequence
  Synthetic oligonucleotide
gggcugguaucucagaaagugccug

SEQ ID NO: 3695 - RNA, 25 nt, Artificial Sequence
  Synthetic oligonucleotide
gcugguaucucagaaagugccugac

SEQ ID NO: 3696 - RNA, 25 nt, Artificial Sequence
  Synthetic oligonucleotide
ugguaucucagaaagugccugacac

SEQ ID NO: 3697 - RNA, 25 nt, Artificial Sequence
  Synthetic oligonucleotide
acuaaccaagcugaguuuccuaugg

SEQ ID NO: 3698 - RNA, 25 nt, Artificial Sequence
  Synthetic oligonucleotide
uaaccaagcugaguuuccuauggga

SEQ ID NO: 3699 - RNA, 25 nt, Artificial Sequence
  Synthetic oligonucleotide
accaagcugaguuuccuaugggaac

SEQ ID NO: 3700 - RNA, 25 nt, Artificial Sequence
  Synthetic oligonucleotide
caagcugaguuuccuaugggaacaa

SEQ ID NO: 3701 - RNA, 25 nt, Artificial Sequence
  Synthetic oligonucleotide
agcugaguuuccuaugggaacaauu

SEQ ID NO: 3702 - RNA, 25 nt, Artificial Sequence
  Synthetic oligonucleotide
cugaguuuccuaugggaacaauuga

SEQ ID NO: 3703 - RNA, 25 nt, Artificial Sequence
  Synthetic oligonucleotide
cuuuuuguucugguccuuuuugguc

SEQ ID NO: 3704 - RNA, 25 nt, Artificial Sequence
  Synthetic oligonucleotide
uuuuguucugguccuuuuuggucga

SEQ ID NO: 3705 - RNA, 25 nt, Artificial Sequence
  Synthetic oligonucleotide
uuguucugguccuuuuuggucgagg

SEQ ID NO: 3706 - RNA, 25 nt, Artificial Sequence
  Synthetic oligonucleotide
guucugguccuuuuuggucgaggag

SEQ ID NO: 3707 - RNA, 25 nt, Artificial Sequence
  Synthetic oligonucleotide
ucugguccuuuuuggucgaggagua

SEQ ID NO: 3708 - RNA, 25 nt, Artificial Sequence
  Synthetic oligonucleotide
ugguccuuuuuggucgaggaguaac

SEQ ID NO: 3709 - RNA, 25 nt, Artificial Sequence
  Synthetic oligonucleotide
guccuuuuuggucgaggaguaacaa

SEQ ID NO: 3710 - RNA, 25 nt, Artificial Sequence
  Synthetic oligonucleotide
ccuuuuuggucgaggaguaacaaua

SEQ ID NO: 3711 - RNA, 25 nt, Artificial Sequence
  Synthetic oligonucleotide
uuuuuggucgaggaguaacaauaca

SEQ ID NO: 3712 - RNA, 25 nt, Artificial Sequence
  Synthetic oligonucleotide
uuuggucgaggaguaacaauacaaa

SEQ ID NO: 3713 - RNA, 25 nt, Artificial Sequence
  Synthetic oligonucleotide
uggucgaggaguaacaauacaaaug

SEQ ID NO: 3714 - RNA, 25 nt, Artificial Sequence
  Synthetic oligonucleotide
gucgaggaguaacaauacaaaugga

SEQ ID NO: 3715 - RNA, 25 nt, Artificial Sequence
  Synthetic oligonucleotide
cgaggaguaacaauacaaauggauu

SEQ ID NO: 3716 - RNA, 25 nt, Artificial Sequence
  Synthetic oligonucleotide
aggaguaacaauacaaauggauuuu

SEQ ID NO: 3717 - RNA, 25 nt, Artificial Sequence
  Synthetic oligonucleotide
gaguaacaauacaaauggauuuugg

SEQ ID NO: 3718 - RNA, 25 nt, Artificial Sequence
  Synthetic oligonucleotide
uaucaaacccuagccuugcuuguua

SEQ ID NO: 3719 - RNA, 25 nt, Artificial Sequence
  Synthetic oligonucleotide
ucaaacccuagccuugcuuguuaaa

SEQ ID NO: 3720 - RNA, 25 nt, Artificial Sequence
  Synthetic oligonucleotide
aaacccuagccuugcuuguuaaauu

SEQ ID NO: 3721 - RNA, 25 nt, Artificial Sequence
  Synthetic oligonucleotide
gaguaaugguguagaacacuaauuc

SEQ ID NO: 3722 - RNA, 25 nt, Artificial Sequence
  Synthetic oligonucleotide
guaaugguguagaacacuaauucau

SEQ ID NO: 3723 - RNA, 25 nt, Artificial Sequence
  Synthetic oligonucleotide
aaugguguagaacacuaauucauaa

SEQ ID NO: 3724 - RNA, 25 nt, Artificial Sequence
  Synthetic oligonucleotide
ugguguagaacacuaauucauaauc

SEQ ID NO: 3725 - RNA, 25 nt, Artificial Sequence
  Synthetic oligonucleotide
guguagaacacuaauucauaaucac

SEQ ID NO: 3726 - RNA, 25 nt, Artificial Sequence
  Synthetic oligonucleotide
guagaacacuaauucauaaucacuc

SEQ ID NO: 3727 - RNA, 25 nt, Artificial Sequence
  Synthetic oligonucleotide
agaacacuaauucauaaucacucua

SEQ ID NO: 3728 - RNA, 25 nt, Artificial Sequence
  Synthetic oligonucleotide
aacacuaauucauaaucacucuaau

SEQ ID NO: 3729 - RNA, 25 nt, Artificial Sequence
  Synthetic oligonucleotide
uuaguuuccuuuuuaauaugcuuaa

SEQ ID NO: 3730 - RNA, 25 nt, Artificial Sequence
  Synthetic oligonucleotide
aguuuccuuuuuaauaugcuuaaaa

SEQ ID NO: 3731 - RNA, 25 nt, Artificial Sequence
  Synthetic oligonucleotide
uuuccuuuuuaauaugcuuaaaaua

SEQ ID NO: 3732 - RNA, 25 nt, Artificial Sequence
  Synthetic oligonucleotide
uccuuuuuaauaugcuuaaaauaag

SEQ ID NO: 3733 - RNA, 25 nt, Artificial Sequence
  Synthetic oligonucleotide
cuuuuuaauaugcuuaaaauaagca

SEQ ID NO: 3734 - RNA, 25 nt, Artificial Sequence
  Synthetic oligonucleotide
uuuuuaauaugcuuaaaauaagcag

SEQ ID NO: 3735 - RNA, 25 nt, Artificial Sequence
  Synthetic oligonucleotide
uuuuaauaugcuuaaaauaagcagg

SEQ ID NO: 3736 - RNA, 25 nt, Artificial Sequence
  Synthetic oligonucleotide
uuaauaugcuuaaaauaagcaggug

SEQ ID NO: 3737 - RNA, 25 nt, Artificial Sequence
  Synthetic oligonucleotide
aauaugcuuaaaauaagcaggugga

SEQ ID NO: 3738 - RNA, 25 nt, Artificial Sequence
  Synthetic oligonucleotide
uaugcuuaaaauaagcagguggauc

SEQ ID NO: 3739 - RNA, 25 nt, Artificial Sequence
  Synthetic oligonucleotide
ugcuuaaaauaagcagguggaucua

SEQ ID NO: 3740 - RNA, 25 nt, Artificial Sequence
  Synthetic oligonucleotide
cuuaaaauaagcagguggaucuauu

SEQ ID NO: 3741 - RNA, 25 nt, Artificial Sequence
  Synthetic oligonucleotide
uaaaauaagcagguggaucuauuuc

SEQ ID NO: 3742 - RNA, 25 nt, Artificial Sequence
  Synthetic oligonucleotide
aaauaagcagguggaucuauuucau

SEQ ID NO: 3743 - RNA, 25 nt, Artificial Sequence
  Synthetic oligonucleotide
auaagcagguggaucuauuucaugu

SEQ ID NO: 3744 - RNA, 25 nt, Artificial Sequence
  Synthetic oligonucleotide
aagcagguggaucuauuucauguuu

SEQ ID NO: 3745 - RNA, 25 nt, Artificial Sequence
  Synthetic oligonucleotide
gcagguggaucuauuucauguuuuu

SEQ ID NO: 3746 - RNA, 25 nt, Artificial Sequence
  Synthetic oligonucleotide
agguggaucuauuucauguuuuuga

SEQ ID NO: 3747 - RNA, 25 nt, Artificial Sequence
  Synthetic oligonucleotide
guggaucuauuucauguuuuugauc

SEQ ID NO: 3748 - RNA, 25 nt, Artificial Sequence
  Synthetic oligonucleotide
ggaucuauuucauguuuuugaucaa

SEQ ID NO: 3749 - RNA, 25 nt, Artificial Sequence
  Synthetic oligonucleotide
aucuauuucauguuuuugaucaaaa

SEQ ID NO: 3750 - RNA, 25 nt, Artificial Sequence
  Synthetic oligonucleotide
guaggguaaaucaguaagagguguu

SEQ ID NO: 3751 - RNA, 25 nt, Artificial Sequence
  Synthetic oligonucleotide
aggguaaaucaguaagagguguuau

SEQ ID NO: 3752 - RNA, 25 nt, Artificial Sequence
  Synthetic oligonucleotide
gguaaaucaguaagagguguuauuu

SEQ ID NO: 3753 - RNA, 25 nt, Artificial Sequence
  Synthetic oligonucleotide
uaaaucaguaagagguguuauuugg

SEQ ID NO: 3754 - RNA, 25 nt, Artificial Sequence
  Synthetic oligonucleotide
aaucaguaagagguguuauuuggaa

SEQ ID NO: 3755 - RNA, 25 nt, Artificial Sequence
  Synthetic oligonucleotide
ucaguaagagguguuauuuggaacc

SEQ ID NO: 3756 - RNA, 25 nt, Artificial Sequence
  Synthetic oligonucleotide
uaccaguugccuuuuaucccaaagu

SEQ ID NO: 3757 - RNA, 25 nt, Artificial Sequence
  Synthetic oligonucleotide
ccaguugccuuuuaucccaaaguug

SEQ ID NO: 3758 - RNA, 25 nt, Artificial Sequence
  Synthetic oligonucleotide
aguugccuuuuaucccaaaguuguu

SEQ ID NO: 3759 - RNA, 25 nt, Artificial Sequence
  Synthetic oligonucleotide
uugccuuuuaucccaaaguuguugu

SEQ ID NO: 3760 - RNA, 25 nt, Artificial Sequence
  Synthetic oligonucleotide
gccuuuuaucccaaaguuguuguaa

SEQ ID NO: 3761 - RNA, 25 nt, Artificial Sequence
  Synthetic oligonucleotide
cuuuuaucccaaaguuguuguaacc

SEQ ID NO: 3762 - RNA, 25 nt, Artificial Sequence
  Synthetic oligonucleotide
uuuaucccaaaguuguuguaaccug

SEQ ID NO: 3763 - RNA, 25 nt, Artificial Sequence
  Synthetic oligonucleotide
uaucccaaaguuguuguaaccugcu

SEQ ID NO: 3764 - RNA, 25 nt, Artificial Sequence
  Synthetic oligonucleotide
ucccaaaguuguuguaaccugcugu

SEQ ID NO: 3765 - RNA, 25 nt, Artificial Sequence
  Synthetic oligonucleotide
ccaaaguuguuguaaccugcuguga

SEQ ID NO: 3766 - RNA, 25 nt, Artificial Sequence
  Synthetic oligonucleotide
aaaguuguuguaaccugcugugaua

SEQ ID NO: 3767 - RNA, 25 nt, Artificial Sequence
  Synthetic oligonucleotide
aguuguuguaaccugcugugauacg

SEQ ID NO: 3768 - RNA, 25 nt, Artificial Sequence
  Synthetic oligonucleotide
uuguuguaaccugcugugauacgau

SEQ ID NO: 3769 - RNA, 25 nt, Artificial Sequence
  Synthetic oligonucleotide
guuguaaccugcugugauacgaugc

SEQ ID NO: 3770 - RNA, 25 nt, Artificial Sequence
  Synthetic oligonucleotide
aaaugguucagaauuaaacuuuuaa

SEQ ID NO: 3771 - RNA, 25 nt, Artificial Sequence
  Synthetic oligonucleotide
augguucagaauuaaacuuuuaauu

SEQ ID NO: 3772 - RNA, 25 nt, Artificial Sequence
  Synthetic oligonucleotide
gguucagaauuaaacuuuuaauuca

SEQ ID NO: 3773 - RNA, 25 nt, Artificial Sequence
  Synthetic oligonucleotide
uucagaauuaaacuuuuaauucauu

SEQ ID NO: 3774 - RNA, 25 nt, Artificial Sequence
  Synthetic oligonucleotide
cagaauuaaacuuuuaauucauucg

SEQ ID NO: 3775 - RNA, 25 nt, Artificial Sequence
  Synthetic oligonucleotide
gcagcagucuuacuuggauucugga

SEQ ID NO: 3776 - RNA, 25 nt, Artificial Sequence
  Synthetic oligonucleotide
acuuggauucuggaauccauucugg

SEQ ID NO: 3777 - RNA, 25 nt, Artificial Sequence
  Synthetic oligonucleotide
gacaccucccaaguccuuuaugaau

SEQ ID NO: 3778 - RNA, 25 nt, Artificial Sequence
  Synthetic oligonucleotide
cgcaagagcaaguagcugauauuga

SEQ ID NO: 3779 - RNA, 25 nt, Artificial Sequence
  Synthetic oligonucleotide
ccauguucccugagacgcuagauga

SEQ ID NO: 3780 - RNA, 25 nt, Artificial Sequence
  Synthetic oligonucleotide
ugaaacaugcaguugucaauuugau

SEQ ID NO: 3781 - RNA, 25 nt, Artificial Sequence
  Synthetic oligonucleotide
caugcaguugucaauuugauuaacu

SEQ ID NO: 3782 - RNA, 25 nt, Artificial Sequence
  Synthetic oligonucleotide
guugucaauuugauuaacuaucagg

SEQ ID NO: 3783 - RNA, 25 nt, Artificial Sequence
  Synthetic oligonucleotide
gaggaccaggugguaguuaauaaag

SEQ ID NO: 3784 - RNA, 25 nt, Artificial Sequence
  Synthetic oligonucleotide
ggucaccaguggauucuguacuguu

SEQ ID NO: 3785 - RNA, 25 nt, Artificial Sequence
  Synthetic oligonucleotide
caguggauucuguacuguucuacgc

SEQ ID NO: 3786 - RNA, 25 nt, Artificial Sequence
  Synthetic oligonucleotide
gauucuguacuguucuacgccauca

SEQ ID NO: 3787 - RNA, 25 nt, Artificial Sequence
  Synthetic oligonucleotide
guggacugcagaaaaugguugcuuu

SEQ ID NO: 3788 - RNA, 25 nt, Artificial Sequence
  Synthetic oligonucleotide
cgugaaauucuuggcuauuacaaca

SEQ ID NO: 3789 - RNA, 25 nt, Artificial Sequence
  Synthetic oligonucleotide
caagucagcgacuuguucaaaacug

SEQ ID NO: 3790 - RNA, 25 nt, Artificial Sequence
  Synthetic oligonucleotide
gacuuguucaaaacugucuuuggac

SEQ ID NO: 3791 - RNA, 25 nt, Artificial Sequence
  Synthetic oligonucleotide
aaacugucuuuggacucucagaaac

SEQ ID NO: 3792 - RNA, 25 nt, Artificial Sequence
  Synthetic oligonucleotide
cucuaaccucacuugcaauaauuac

SEQ ID NO: 3793 - RNA, 25 nt, Artificial Sequence
  Synthetic oligonucleotide
cucacuugcaauaauuacaaaaaca

SEQ ID NO: 3794 - RNA, 25 nt, Artificial Sequence
  Synthetic oligonucleotide
gaaugccguucgccuucauuaugga

SEQ ID NO: 3795 - RNA, 25 nt, Artificial Sequence
  Synthetic oligonucleotide
gccuucauuauggacugccuguugu

SEQ ID NO: 3796 - RNA, 25 nt, Artificial Sequence
  Synthetic oligonucleotide
cauuauggacugccuguugugguua

SEQ ID NO: 3797 - RNA, 25 nt, Artificial Sequence
  Synthetic oligonucleotide
gacugccuguugugguuaaacuccu

SEQ ID NO: 3798 - RNA, 25 nt, Artificial Sequence
  Synthetic oligonucleotide
aacuguuggauugauucgaaaccuu

SEQ ID NO: 3799 - RNA, 25 nt, Artificial Sequence
  Synthetic oligonucleotide
gaggacucaauaccauuccauuguu

SEQ ID NO: 3800 - RNA, 25 nt, Artificial Sequence
  Synthetic oligonucleotide
gaggacaagccacaggauuacaaga

SEQ ID NO: 3801 - RNA, 25 nt, Artificial Sequence
  Synthetic oligonucleotide
auggacccuaugauggagcaugaga

SEQ ID NO: 3802 - RNA, 25 nt, Artificial Sequence
  Synthetic oligonucleotide
gauacugaccuguaaaucguccuuu

SEQ ID NO: 3803 - RNA, 25 nt, Artificial Sequence
  Synthetic oligonucleotide
ccagugugggugaauacuuuacucu

SEQ ID NO: 3804 - RNA, 25 nt, Artificial Sequence
  Synthetic oligonucleotide
ccacagcuuuugcagcguuauacuc

SEQ ID NO: 3805 - RNA, 25 nt, Artificial Sequence
  Synthetic oligonucleotide
uuuugcagcguuauacucagaugag

SEQ ID NO: 3806 - RNA, 25 nt, Artificial Sequence
  Synthetic oligonucleotide
gcguuauacucagaugaguaacauu

SEQ ID NO: 3807 - RNA, 25 nt, Artificial Sequence
  Synthetic oligonucleotide
auuugcuguuuucaacauuaauagc

SEQ ID NO: 3808 - RNA, 25 nt, Artificial Sequence
  Synthetic oligonucleotide
cuguagugucugaacgugcauugug

SEQ ID NO: 3809 - RNA, 25 nt, Artificial Sequence
  Synthetic oligonucleotide
gaacagucgaaguacgcuuuuuguu

SEQ ID NO: 3810 - RNA, 25 nt, Artificial Sequence
  Synthetic oligonucleotide
gucgaaguacgcuuuuuguucuggu

SEQ ID NO: 3811 - RNA, 25 nt, Artificial Sequence
  Synthetic oligonucleotide
guacgcuuuuuguucugguccuuuu

SEQ ID NO: 3812 - RNA, 25 nt, Artificial Sequence
  Synthetic oligonucleotide
ccuagccuugcuuguucuuuguuuu

SEQ ID NO: 3813 - RNA, 25 nt, Artificial Sequence
  Synthetic oligonucleotide
ccuugcuuguucuuuguuuuaauau

SEQ ID NO: 3814 - RNA, 25 nt, Artificial Sequence
  Synthetic oligonucleotide
aaccugcuacagcaauuucugauuu

SEQ ID NO: 3815 - RNA, 25 nt, Artificial Sequence
  Synthetic oligonucleotide
cagcaauuucugauuucuaagaacc

SEQ ID NO: 3816 - RNA, 25 nt, Artificial Sequence
  Synthetic oligonucleotide
guaagagguguuauuugagccuugu

SEQ ID NO: 3817 - RNA, 25 nt, Artificial Sequence
  Synthetic oligonucleotide
gguguuauuugagccuuguuuugga

SEQ ID NO: 3818 - RNA, 25 nt, Artificial Sequence
  Synthetic oligonucleotide
uauuugagccuuguuuuggacagua

SEQ ID NO: 3819 - RNA, 25 nt, Artificial Sequence
  Synthetic oligonucleotide
gagccuuguuuuggacaguauacca

SEQ ID NO: 3820 - RNA, 25 nt, Artificial Sequence
  Synthetic oligonucleotide
caacagaugcgguuauagaaauggu

SEQ ID NO: 3821 - RNA, 25 nt, Artificial Sequence
  Synthetic oligonucleotide
guuauagaaaugguucagaauuaaa

SEQ ID NO: 3822 - RNA, 25 nt, Artificial Sequence
  Synthetic oligonucleotide
agaaaugguucagaauuaaacuuuu

SEQ ID NO: 3823 - RNA, 25 nt, Artificial Sequence
  Synthetic oligonucleotide
uguaugguauacuucaaauacccuc

SEQ ID NO: 3824 - RNA, 25 nt, Artificial Sequence
  Synthetic oligonucleotide
aaacaguuguaugguauacuucaaa

SEQ ID NO: 3825 - RNA, 25 nt, Artificial Sequence
  Synthetic oligonucleotide
aaaacaguuguaugguauacuucaa

SEQ ID NO: 3826 - RNA, 25 nt, Artificial Sequence
  Synthetic oligonucleotide
ucaaaacaguuguaugguauacuuc

SEQ ID NO: 3827 - RNA, 25 nt, Artificial Sequence
  Synthetic oligonucleotide
uucaaaacaguuguaugguauacuu

SEQ ID NO: 3828 - RNA, 25 nt, Artificial Sequence
  Synthetic oligonucleotide
uuucaaaacaguuguaugguauacu

SEQ ID NO: 3829 - RNA, 25 nt, Artificial Sequence
  Synthetic oligonucleotide
guccacgcuggauuuucaaaacagu

SEQ ID NO: 3830 - RNA, 25 nt, Artificial Sequence
  Synthetic oligonucleotide
uguccacgcuggauuuucaaaacag

SEQ ID NO: 3831 - RNA, 25 nt, Artificial Sequence
  Synthetic oligonucleotide
aucaaaucagcuugaguagccauug

SEQ ID NO: 3832 - RNA, 25 nt, Artificial Sequence
  Synthetic oligonucleotide
uccaacuccaucaaaucagcuugag

SEQ ID NO: 3833 - RNA, 25 nt, Artificial Sequence
  Synthetic oligonucleotide
uccucaggauugccuuuaccacuca

SEQ ID NO: 3834 - RNA, 25 nt, Artificial Sequence
  Synthetic oligonucleotide
uuccucaggauugccuuuaccacuc

SEQ ID NO: 3835 - RNA, 25 nt, Artificial Sequence
  Synthetic oligonucleotide
ucaauaucagcuacuuguucuugag

SEQ ID NO: 3836 - RNA, 25 nt, Artificial Sequence
  Synthetic oligonucleotide
aucaauaucagcuacuuguucuuga

SEQ ID NO: 3837 - RNA, 25 nt, Artificial Sequence
  Synthetic oligonucleotide
uguccaucaauaucagcuacuuguu

SEQ ID NO: 3838 - RNA, 25 nt, Artificial Sequence
  Synthetic oligonucleotide
ugcauacuguccaucaauaucagcu

SEQ ID NO: 3839 - RNA, 25 nt, Artificial Sequence
  Synthetic oligonucleotide
agucauugcauacuguccaucaaua

SEQ ID NO: 3840 - RNA, 25 nt, Artificial Sequence
  Synthetic oligonucleotide
ucaucuaaugucucagggaacauag

SEQ ID NO: 3841 - RNA, 25 nt, Artificial Sequence
  Synthetic oligonucleotide
acaacugcauguuucagcaucugug

SEQ ID NO: 3842 - RNA, 25 nt, Artificial Sequence
  Synthetic oligonucleotide
uuacaacugcauguuucagcaucug

SEQ ID NO: 3843 - RNA, 25 nt, Artificial Sequence
  Synthetic oligonucleotide
uuaaucaaguuuacaacugcauguu

SEQ ID NO: 3844 - RNA, 25 nt, Artificial Sequence
  Synthetic oligonucleotide
ugauaguuaaucaaguuuacaacug

SEQ ID NO: 3845 - RNA, 25 nt, Artificial Sequence
  Synthetic oligonucleotide
gcaucaucuugauaguuaaucaagu

SEQ ID NO: 3846 - RNA, 25 nt, Artificial Sequence
  Synthetic oligonucleotide
ugcaucaucuugauaguuaaucaag

SEQ ID NO: 3847 - RNA, 25 nt, Artificial Sequence
  Synthetic oligonucleotide
gguccucgucauuuagcaguuuugu

SEQ ID NO: 3848 - RNA, 25 nt, Artificial Sequence
  Synthetic oligonucleotide
uaacugcagccuuauuaaccaccac

SEQ ID NO: 3849 - RNA, 25 nt, Artificial Sequence
  Synthetic oligonucleotide
auaacugcagccuuauuaaccacca

SEQ ID NO: 3850 - RNA, 25 nt, Artificial Sequence
  Synthetic oligonucleotide
accauaacugcagccuuauuaacca

SEQ ID NO: 3851 - RNA, 25 nt, Artificial Sequence
  Synthetic oligonucleotide
uuuuuagaaagcugauggaccauaa

SEQ ID NO: 3852 - RNA, 25 nt, Artificial Sequence
  Synthetic oligonucleotide
gguacguacaauagcagacaccauc

SEQ ID NO: 3853 - RNA, 25 nt, Artificial Sequence
  Synthetic oligonucleotide
ucauuuguauucugcaugguacgua

SEQ ID NO: 3854 - RNA, 25 nt, Artificial Sequence
  Synthetic oligonucleotide
guuucuacaucauuuguauucugca

SEQ ID NO: 3855 - RNA, 25 nt, Artificial Sequence
  Synthetic oligonucleotide
uguuucuacaucauuuguauucugc

SEQ ID NO: 3856 - RNA, 25 nt, Artificial Sequence
  Synthetic oligonucleotide
acaacgagcuguuucuacaucauuu

SEQ ID NO: 3857 - RNA, 25 nt, Artificial Sequence
  Synthetic oligonucleotide
guacaacgagcuguuucuacaucau

SEQ ID NO: 3858 - RNA, 25 nt, Artificial Sequence
  Synthetic oligonucleotide
gguacaacgagcuguuucuacauca

SEQ ID NO: 3859 - RNA, 25 nt, Artificial Sequence
  Synthetic oligonucleotide
auaaaacaacacagaauccacuggu

SEQ ID NO: 3860 - RNA, 25 nt, Artificial Sequence
  Synthetic oligonucleotide
gcauaaaacaacacagaauccacug

SEQ ID NO: 3861 - RNA, 25 nt, Artificial Sequence
  Synthetic oligonucleotide
ggcauaaaacaacacagaauccacu

SEQ ID NO: 3862 - RNA, 25 nt, Artificial Sequence
  Synthetic oligonucleotide
gcuccuucuugauguaauaaaaggu

SEQ ID NO: 3863 - RNA, 25 nt, Artificial Sequence
  Synthetic oligonucleotide
agcuccuucuugauguaauaaaagg

SEQ ID NO: 3864 - RNA, 25 nt, Artificial Sequence
  Synthetic oligonucleotide
uaacauuuguuuuguugagcaaggc

SEQ ID NO: 3865 - RNA, 25 nt, Artificial Sequence
  Synthetic oligonucleotide
gccaagaauuuaacauuuguuuugu

SEQ ID NO: 3866 - RNA, 25 nt, Artificial Sequence
  Synthetic oligonucleotide
uaauagccaagaauuuaacauuugu

SEQ ID NO: 3867 - RNA, 25 nt, Artificial Sequence
  Synthetic oligonucleotide
guaauagccaagaauuuaacauuug

SEQ ID NO: 3868 - RNA, 25 nt, Artificial Sequence
  Synthetic oligonucleotide
agcuaaaauuugaaggcagucuguc

SEQ ID NO: 3869 - RNA, 25 nt, Artificial Sequence
  Synthetic oligonucleotide
gguccucauuauauuuacuaaagcu

SEQ ID NO: 3870 - RNA, 25 nt, Artificial Sequence
  Synthetic oligonucleotide
guauagguccucauuauauuuacua

SEQ ID NO: 3871 - RNA, 25 nt, Artificial Sequence
  Synthetic oligonucleotide
aguauagguccucauuauauuuacu

SEQ ID NO: 3872 - RNA, 25 nt, Artificial Sequence
  Synthetic oligonucleotide
uuuucguaaguauagguccucauua

SEQ ID NO: 3873 - RNA, 25 nt, Artificial Sequence
  Synthetic oligonucleotide
uuuuucguaaguauagguccucauu

SEQ ID NO: 3874 - RNA, 25 nt, Artificial Sequence
  Synthetic oligonucleotide
guuuuucguaaguauagguccucau

SEQ ID NO: 3875 - RNA, 25 nt, Artificial Sequence
  Synthetic oligonucleotide
aguuuuucguaaguauagguccuca

SEQ ID NO: 3876 - RNA, 25 nt, Artificial Sequence
  Synthetic oligonucleotide
gguccacaguaguuuuucguaagua

SEQ ID NO: 3877 - RNA, 25 nt, Artificial Sequence
  Synthetic oligonucleotide
uacaauagccggcuuauuacuagag

SEQ ID NO: 3878 - RNA, 25 nt, Artificial Sequence
  Synthetic oligonucleotide
ucuacaauagccggcuuauuacuag

SEQ ID NO: 3879 - RNA, 25 nt, Artificial Sequence
  Synthetic oligonucleotide
uccuaaagcuugcauuccaccagcu

SEQ ID NO: 3880 - RNA, 25 nt, Artificial Sequence
  Synthetic oligonucleotide
guccuaaagcuugcauuccaccagc

SEQ ID NO: 3881 - RNA, 25 nt, Artificial Sequence
  Synthetic oligonucleotide
aguccuaaagcuugcauuccaccag

SEQ ID NO: 3882 - RNA, 25 nt, Artificial Sequence
  Synthetic oligonucleotide
guucugaacaagacguugacuugga

SEQ ID NO: 3883 - RNA, 25 nt, Artificial Sequence
  Synthetic oligonucleotide
aguucugaacaagacguugacuugg

SEQ ID NO: 3884 - RNA, 25 nt, Artificial Sequence
  Synthetic oligonucleotide
guccaaagacaguucugaacaagac

SEQ ID NO: 3885 - RNA, 25 nt, Artificial Sequence
  Synthetic oligonucleotide
uuccuguuuaguugcagcaucugaa

SEQ ID NO: 3886 - RNA, 25 nt, Artificial Sequence
  Synthetic oligonucleotide
acauuuauaucaucugaacccagaa

SEQ ID NO: 3887 - RNA, 25 nt, Artificial Sequence
  Synthetic oligonucleotide
accacauuuauaucaucugaaccca

SEQ ID NO: 3888 - RNA, 25 nt, Artificial Sequence
  Synthetic oligonucleotide
gcacaggugaccacauuuauaucau

SEQ ID NO: 3889 - RNA, 25 nt, Artificial Sequence
  Synthetic oligonucleotide
ugcacaggugaccacauuuauauca

SEQ ID NO: 3890 - RNA, 25 nt, Artificial Sequence
  Synthetic oligonucleotide
ugcaagugagguuagaaagaauucc

SEQ ID NO: 3891 - RNA, 25 nt, Artificial Sequence
  Synthetic oligonucleotide
auaauuauugcaagugagguuagaa

SEQ ID NO: 3892 - RNA, 25 nt, Artificial Sequence
  Synthetic oligonucleotide
ucaucuuguucuuauaauuauugca

SEQ ID NO: 3893 - RNA, 25 nt, Artificial Sequence
  Synthetic oligonucleotide
aucaucuuguucuuauaauuauugc

SEQ ID NO: 3894 - RNA, 25 nt, Artificial Sequence
  Synthetic oligonucleotide
accaucaucuuguucuuauaauuau

SEQ ID NO: 3895 - RNA, 25 nt, Artificial Sequence
  Synthetic oligonucleotide
agaccaucaucuuguucuuauaauu

SEQ ID NO: 3896 - RNA, 25 nt, Artificial Sequence
  Synthetic oligonucleotide
aauccaacaguagccuuuaucagag

SEQ ID NO: 3897 - RNA, 25 nt, Artificial Sequence
  Synthetic oligonucleotide
gaaucaauccaacaguagccuuuau

SEQ ID NO: 3898 - RNA, 25 nt, Artificial Sequence
  Synthetic oligonucleotide
uccacaaauugcugcugugucccac

SEQ ID NO: 3899 - RNA, 25 nt, Artificial Sequence
  Synthetic oligonucleotide
acaaccuucaacuauuucuuccaug

SEQ ID NO: 3900 - RNA, 25 nt, Artificial Sequence
  Synthetic oligonucleotide
uacaaccuucaacuauuucuuccau

SEQ ID NO: 3901 - RNA, 25 nt, Artificial Sequence
  Synthetic oligonucleotide
guacaaccuucaacuauuucuucca

SEQ ID NO: 3902 - RNA, 25 nt, Artificial Sequence
  Synthetic oligonucleotide
gguacaaccuucaacuauuucuucc

SEQ ID NO: 3903 - RNA, 25 nt, Artificial Sequence
  Synthetic oligonucleotide
gcuccgguacaaccuucaacuauuu

SEQ ID NO: 3904 - RNA, 25 nt, Artificial Sequence
  Synthetic oligonucleotide
acaauucgguugugaacaucccgag

SEQ ID NO: 3905 - RNA, 25 nt, Artificial Sequence
  Synthetic oligonucleotide
aacaauucgguugugaacaucccga

SEQ ID NO: 3906 - RNA, 25 nt, Artificial Sequence
  Synthetic oligonucleotide
uaacaauucgguugugaacaucccg

SEQ ID NO: 3907 - RNA, 25 nt, Artificial Sequence
  Synthetic oligonucleotide
auaacaauucgguugugaacauccc

SEQ ID NO: 3908 - RNA, 25 nt, Artificial Sequence
  Synthetic oligonucleotide
gauaacaauucgguugugaacaucc

SEQ ID NO: 3909 - RNA, 25 nt, Artificial Sequence
  Synthetic oligonucleotide
ugauaacaauucgguugugaacauc

SEQ ID NO: 3910 - RNA, 25 nt, Artificial Sequence
  Synthetic oligonucleotide
auuuaguccucugauaacaauucgg

SEQ ID NO: 3911 - RNA, 25 nt, Artificial Sequence
  Synthetic oligonucleotide
uauuuaguccucugauaacaauucg

SEQ ID NO: 3912 - RNA, 25 nt, Artificial Sequence
  Synthetic oligonucleotide
guauuuaguccucugauaacaauuc

SEQ ID NO: 3913 - RNA, 25 nt, Artificial Sequence
  Synthetic oligonucleotide
gguauuuaguccucugauaacaauu

SEQ ID NO: 3914 - RNA, 25 nt, Artificial Sequence
  Synthetic oligonucleotide
acaauggaaugguauuuaguccucu

SEQ ID NO: 3915 - RNA, 25 nt, Artificial Sequence
  Synthetic oligonucleotide
acaaacaauggaaugguauuuaguc

SEQ ID NO: 3916 - RNA, 25 nt, Artificial Sequence
  Synthetic oligonucleotide
gcacaaacaauggaaugguauuuag

SEQ ID NO: 3917 - RNA, 25 nt, Artificial Sequence
  Synthetic oligonucleotide
ugcacaaacaauggaaugguauuua

SEQ ID NO: 3918 - RNA, 25 nt, Artificial Sequence
  Synthetic oligonucleotide
gcuacucuuuggauguuuucaaugg

SEQ ID NO: 3919 - RNA, 25 nt, Artificial Sequence
  Synthetic oligonucleotide
agcuacucuuuggauguuuucaaug

SEQ ID NO: 3920 - RNA, 25 nt, Artificial Sequence
  Synthetic oligonucleotide
gcuucaauagcuucugcagcuuccu

SEQ ID NO: 3921 - RNA, 25 nt, Artificial Sequence
  Synthetic oligonucleotide
ucccucagcuucaauagcuucugca

SEQ ID NO: 3922 - RNA, 25 nt, Artificial Sequence
  Synthetic oligonucleotide
gcucccucagcuucaauagcuucug

SEQ ID NO: 3923 - RNA, 25 nt, Artificial Sequence
  Synthetic oligonucleotide
auuccuagagugaaguaacucuguc

SEQ ID NO: 3924 - RNA, 25 nt, Artificial Sequence
  Synthetic oligonucleotide
ucauuccuagagugaaguaacucug

SEQ ID NO: 3925 - RNA, 25 nt, Artificial Sequence
  Synthetic oligonucleotide
uucauuccuagagugaaguaacucu

SEQ ID NO: 3926 - RNA, 25 nt, Artificial Sequence
  Synthetic oligonucleotide
uccucagacauucggaacaaaacag

SEQ ID NO: 3927 - RNA, 25 nt, Artificial Sequence
  Synthetic oligonucleotide
uguccucagacauucggaacaaaac

SEQ ID NO: 3928 - RNA, 25 nt, Artificial Sequence
  Synthetic oligonucleotide
guuucuuguaaucuuguggcuuguc

SEQ ID NO: 3929 - RNA, 25 nt, Artificial Sequence
  Synthetic oligonucleotide
ugaaagccguuucuuguaaucuugu

SEQ ID NO: 3930 - RNA, 25 nt, Artificial Sequence
  Synthetic oligonucleotide
gcucaacugaaagccguuucuugua

SEQ ID NO: 3931 - RNA, 25 nt, Artificial Sequence
  Synthetic oligonucleotide
aguccaagaucagcagucucauucc

SEQ ID NO: 3932 - RNA, 25 nt, Artificial Sequence
  Synthetic oligonucleotide
accaauaucaaguccaagaucagca

SEQ ID NO: 3933 - RNA, 25 nt, Artificial Sequence
  Synthetic oligonucleotide
agaacgauagcuaggaucauccugg

SEQ ID NO: 3934 - RNA, 25 nt, Artificial Sequence
  Synthetic oligonucleotide
uauccaccagagugaaaagaacgau

SEQ ID NO: 3935 - RNA, 25 nt, Artificial Sequence
  Synthetic oligonucleotide
auuuacaggucaguaucaaaccagg

SEQ ID NO: 3936 - RNA, 25 nt, Artificial Sequence
  Synthetic oligonucleotide
gauuuacaggucaguaucaaaccag

SEQ ID NO: 3937 - RNA, 25 nt, Artificial Sequence
  Synthetic oligonucleotide
ugauuuacaggucaguaucaaacca

SEQ ID NO: 3938 - RNA, 25 nt, Artificial Sequence
  Synthetic oligonucleotide
ucuuaccuaaaggaugauuuacagg

SEQ ID NO: 3939 - RNA, 25 nt, Artificial Sequence
  Synthetic oligonucleotide
uucuuaccuaaaggaugauuuacag

SEQ ID NO: 3940 - RNA, 25 nt, Artificial Sequence
  Synthetic oligonucleotide
acuucuuaccuaaaggaugauuuac

SEQ ID NO: 3941 - RNA, 25 nt, Artificial Sequence
  Synthetic oligonucleotide
uuuuuaaaacuucuuaccuaaagga

SEQ ID NO: 3942 - RNA, 25 nt, Artificial Sequence
  Synthetic oligonucleotide
gcuuuuuaaaacuucuuaccuaaag

SEQ ID NO: 3943 - RNA, 25 nt, Artificial Sequence
  Synthetic oligonucleotide
aaacuggcuuuuuaaaacuucuuac

SEQ ID NO: 3944 - RNA, 25 nt, Artificial Sequence
  Synthetic oligonucleotide
acccaaacuggcuuuuuaaaacuuc

SEQ ID NO: 3945 - RNA, 25 nt, Artificial Sequence
  Synthetic oligonucleotide
uacccaaacuggcuuuuuaaaacuu

SEQ ID NO: 3946 - RNA, 25 nt, Artificial Sequence
  Synthetic oligonucleotide
uuacccaaacuggcuuuuuaaaacu

SEQ ID NO: 3947 - RNA, 25 nt, Artificial Sequence
  Synthetic oligonucleotide
uuuacccaaacuggcuuuuuaaaac

SEQ ID NO: 3948 - RNA, 25 nt, Artificial Sequence
  Synthetic oligonucleotide
aaccaagucuuucugaaguucugua

SEQ ID NO: 3949 - RNA, 25 nt, Artificial Sequence
  Synthetic oligonucleotide
acccuaccaaccaagucuuucugaa

SEQ ID NO: 3950 - RNA, 25 nt, Artificial Sequence
  Synthetic oligonucleotide
uuacaaauagccuaaaccacuccca

SEQ ID NO: 3951 - RNA, 25 nt, Artificial Sequence
  Synthetic oligonucleotide
uuuacaaauagccuaaaccacuccc

SEQ ID NO: 3952 - RNA, 25 nt, Artificial Sequence
  Synthetic oligonucleotide
auuuacaaauagccuaaaccacucc

SEQ ID NO: 3953 - RNA, 25 nt, Artificial Sequence
  Synthetic oligonucleotide
gauuuacaaauagccuaaaccacuc

SEQ ID NO: 3954 - RNA, 25 nt, Artificial Sequence
  Synthetic oligonucleotide
uuuuuguggcagauuuacaaauagc

SEQ ID NO: 3955 - RNA, 25 nt, Artificial Sequence
  Synthetic oligonucleotide
guuuuuguggcagauuuacaaauag

SEQ ID NO: 3956 - RNA, 25 nt, Artificial Sequence
  Synthetic oligonucleotide
uguuuuuguggcagauuuacaaaua

SEQ ID NO: 3957 - RNA, 25 nt, Artificial Sequence
  Synthetic oligonucleotide
auaccuguuuuuguggcagauuuac

SEQ ID NO: 3958 - RNA, 25 nt, Artificial Sequence
  Synthetic oligonucleotide
uucaaaguauauaccuguuuuugug

SEQ ID NO: 3959 - RNA, 25 nt, Artificial Sequence
  Synthetic oligonucleotide
ucuccuuucaaaguauauaccuguu

SEQ ID NO: 3960 - RNA, 25 nt, Artificial Sequence
  Synthetic oligonucleotide
aucuccuuucaaaguauauaccugu

SEQ ID NO: 3961 - RNA, 25 nt, Artificial Sequence
  Synthetic oligonucleotide
acaucuccuuucaaaguauauaccu

SEQ ID NO: 3962 - RNA, 25 nt, Artificial Sequence
  Synthetic oligonucleotide
gacaucuccuuucaaaguauauacc

SEQ ID NO: 3963 - RNA, 25 nt, Artificial Sequence
  Synthetic oligonucleotide
agacaucuccuuucaaaguauauac

SEQ ID NO: 3964 - RNA, 25 nt, Artificial Sequence
  Synthetic oligonucleotide
uuccaagacaucuccuuucaaagua

SEQ ID NO: 3965 - RNA, 25 nt, Artificial Sequence
  Synthetic oligonucleotide
uuccaauguuccaagacaucuccuu

SEQ ID NO: 3966 - RNA, 25 nt, Artificial Sequence
  Synthetic oligonucleotide
auuccaauguuccaagacaucuccu

SEQ ID NO: 3967 - RNA, 25 nt, Artificial Sequence
  Synthetic oligonucleotide
acauuccaauguuccaagacaucuc

SEQ ID NO: 3968 - RNA, 25 nt, Artificial Sequence
  Synthetic oligonucleotide
agaaaucugagaacauuccaauguu

SEQ ID NO: 3969 - RNA, 25 nt, Artificial Sequence
  Synthetic oligonucleotide
aaccagaaaucugagaacauuccaa

SEQ ID NO: 3970 - RNA, 25 nt, Artificial Sequence
  Synthetic oligonucleotide
acaaccagaaaucugagaacauucc

SEQ ID NO: 3971 - RNA, 25 nt, Artificial Sequence
  Synthetic oligonucleotide
aacaaccagaaaucugagaacauuc

SEQ ID NO: 3972 - RNA, 25 nt, Artificial Sequence
  Synthetic oligonucleotide
uaacaaccagaaaucugagaacauu

SEQ ID NO: 3973 - RNA, 25 nt, Artificial Sequence
  Synthetic oligonucleotide
aucacauaacaaccagaaaucugag

SEQ ID NO: 3974 - RNA, 25 nt, Artificial Sequence
  Synthetic oligonucleotide
gaucacauaacaaccagaaaucuga

SEQ ID NO: 3975 - RNA, 25 nt, Artificial Sequence
  Synthetic oligonucleotide
acacaugaucacauaacaaccagaa

SEQ ID NO: 3976 - RNA, 25 nt, Artificial Sequence
  Synthetic oligonucleotide
uccacacaugaucacauaacaacca

SEQ ID NO: 3977 - RNA, 25 nt, Artificial Sequence
  Synthetic oligonucleotide
uaacuuccacacaugaucacauaac

SEQ ID NO: 3978 - RNA, 25 nt, Artificial Sequence
  Synthetic oligonucleotide
auaacuuccacacaugaucacauaa

SEQ ID NO: 3979 - RNA, 25 nt, Artificial Sequence
  Synthetic oligonucleotide
aauaacuuccacacaugaucacaua

SEQ ID NO: 3980 - RNA, 25 nt, Artificial Sequence
  Synthetic oligonucleotide
uaauaacuuccacacaugaucacau

SEQ ID NO: 3981 - RNA, 25 nt, Artificial Sequence
  Synthetic oligonucleotide
uuaaaguuaauaacuuccacacaug

SEQ ID NO: 3982 - RNA, 25 nt, Artificial Sequence
  Synthetic oligonucleotide
auuaaaguuaauaacuuccacacau

SEQ ID NO: 3983 - RNA, 25 nt, Artificial Sequence
  Synthetic oligonucleotide
acauuaaaguuaauaacuuccacac

SEQ ID NO: 3984 - RNA, 25 nt, Artificial Sequence
  Synthetic oligonucleotide
aacauuaaaguuaauaacuuccaca

SEQ ID NO: 3985 - RNA, 25 nt, Artificial Sequence
  Synthetic oligonucleotide
aaacauuaaaguuaauaacuuccac

SEQ ID NO: 3986 - RNA, 25 nt, Artificial Sequence
  Synthetic oligonucleotide
aaaacauuaaaguuaauaacuucca

SEQ ID NO: 3987 - RNA, 25 nt, Artificial Sequence
  Synthetic oligonucleotide
aaaaacauuaaaguuaauaacuucc

SEQ ID NO: 3988 - RNA, 25 nt, Artificial Sequence
  Synthetic oligonucleotide
aaaaaacauuaaaguuaauaacuuc

SEQ ID NO: 3989 - RNA, 25 nt, Artificial Sequence
  Synthetic oligonucleotide
gcaaaaaacauuaaaguuaauaacu

SEQ ID NO: 3990 - RNA, 25 nt, Artificial Sequence
  Synthetic oligonucleotide
ggcaaaaaacauuaaaguuaauaac

SEQ ID NO: 3991 - RNA, 25 nt, Artificial Sequence
  Synthetic oligonucleotide
gcaaaagcuguggcaaaaaacauua

SEQ ID NO: 3992 - RNA, 25 nt, Artificial Sequence
  Synthetic oligonucleotide
ugcaaaagcuguggcaaaaaacauu

SEQ ID NO: 3993 - RNA, 25 nt, Artificial Sequence
  Synthetic oligonucleotide
ucauuugaguauuaaguugcaaaag

SEQ ID NO: 3994 - RNA, 25 nt, Artificial Sequence
  Synthetic oligonucleotide
aaaacagcaaauguuacucauuuga

SEQ ID NO: 3995 - RNA, 25 nt, Artificial Sequence
  Synthetic oligonucleotide
uaaaacagcaaauguuacucauuug

SEQ ID NO: 3996 - RNA, 25 nt, Artificial Sequence
  Synthetic oligonucleotide
uuaaaacagcaaauguuacucauuu

SEQ ID NO: 3997 - RNA, 25 nt, Artificial Sequence
  Synthetic oligonucleotide
uuuaaaacagcaaauguuacucauu

SEQ ID NO: 3998 - RNA, 25 nt, Artificial Sequence
  Synthetic oligonucleotide
guuuaaaacagcaaauguuacucau

SEQ ID NO: 3999 - RNA, 25 nt, Artificial Sequence
  Synthetic oligonucleotide
uguuuaaaacagcaaauguuacuca

SEQ ID NO: 4000 - RNA, 25 nt, Artificial Sequence
  Synthetic oligonucleotide
auuaauguuuaaaacagcaaauguu

SEQ ID NO: 4001 - RNA, 25 nt, Artificial Sequence
  Synthetic oligonucleotide
agaaaggcugcuauuaauguuuaaa

SEQ ID NO: 4002 - RNA, 25 nt, Artificial Sequence
  Synthetic oligonucleotide
aguucagacaauacagcuguauaaa

SEQ ID NO: 4003 - RNA, 25 nt, Artificial Sequence
  Synthetic oligonucleotide
acaaugcaaguucagacaauacagc

SEQ ID NO: 4004 - RNA, 25 nt, Artificial Sequence
  Synthetic oligonucleotide
ucacaaugcaaguucagacaauaca

SEQ ID NO: 4005 - RNA, 25 nt, Artificial Sequence
  Synthetic oligonucleotide
aaucacaaugcaaguucagacaaua

SEQ ID NO: 4006 - RNA, 25 nt, Artificial Sequence
  Synthetic oligonucleotide
ggccaaucacaaugcaaguucagac

SEQ ID NO: 4007 - RNA, 25 nt, Artificial Sequence
  Synthetic oligonucleotide
guucccauaggaaacucagcuuggu

SEQ ID NO: 4008 - RNA, 25 nt, Artificial Sequence
  Synthetic oligonucleotide
ucaauuguucccauaggaaacucag

SEQ ID NO: 4009 - RNA, 25 nt, Artificial Sequence
  Synthetic oligonucleotide
uucaauuguucccauaggaaacuca

SEQ ID NO: 4010 - RNA, 25 nt, Artificial Sequence
  Synthetic oligonucleotide
guuuacuucaauuguucccauagga

SEQ ID NO: 4011 - RNA, 25 nt, Artificial Sequence
  Synthetic oligonucleotide
aguuuacuucaauuguucccauagg

SEQ ID NO: 4012 - RNA, 25 nt, Artificial Sequence
  Synthetic oligonucleotide
aaaaaguuuacuucaauuguuccca

SEQ ID NO: 4013 - RNA, 25 nt, Artificial Sequence
  Synthetic oligonucleotide
gaacaaaaaguuuacuucaauuguu

SEQ ID NO: 4014 - RNA, 25 nt, Artificial Sequence
  Synthetic oligonucleotide
gaccagaacaaaaaguuuacuucaa

SEQ ID NO: 4015 - RNA, 25 nt, Artificial Sequence
  Synthetic oligonucleotide
ggaccagaacaaaaaguuuacuuca

SEQ ID NO: 4016 - RNA, 25 nt, Artificial Sequence
  Synthetic oligonucleotide
accaaaaaggaccagaacaaaaagu

SEQ ID NO: 4017 - RNA, 25 nt, Artificial Sequence
  Synthetic oligonucleotide
gaccaaaaaggaccagaacaaaaag

SEQ ID NO: 4018 - RNA, 25 nt, Artificial Sequence
  Synthetic oligonucleotide
acuccucgaccaaaaaggaccagaa

SEQ ID NO: 4019 - RNA, 25 nt, Artificial Sequence
  Synthetic oligonucleotide
uccauuuguauuguuacuccucgac

SEQ ID NO: 4020 - RNA, 25 nt, Artificial Sequence
  Synthetic oligonucleotide
auccauuuguauuguuacuccucga

SEQ ID NO: 4021 - RNA, 25 nt, Artificial Sequence
  Synthetic oligonucleotide
aauccauuuguauuguuacuccucg

SEQ ID NO: 4022 - RNA, 25 nt, Artificial Sequence
  Synthetic oligonucleotide
aaauccauuuguauuguuacuccuc

SEQ ID NO: 4023 - RNA, 25 nt, Artificial Sequence
  Synthetic oligonucleotide
aaaauccauuuguauuguuacuccu

SEQ ID NO: 4024 - RNA, 25 nt, Artificial Sequence
  Synthetic oligonucleotide
acucccaaaauccauuuguauuguu

SEQ ID NO: 4025 - RNA, 25 nt, Artificial Sequence
  Synthetic oligonucleotide
uucacuucuugagucacucccaaaa

SEQ ID NO: 4026 - RNA, 25 nt, Artificial Sequence
  Synthetic oligonucleotide
ucuucacuucuugagucacucccaa

SEQ ID NO: 4027 - RNA, 25 nt, Artificial Sequence
  Synthetic oligonucleotide
uucuucacuucuugagucacuccca

SEQ ID NO: 4028 - RNA, 25 nt, Artificial Sequence
  Synthetic oligonucleotide
auucuucacuucuugagucacuccc

SEQ ID NO: 4029 - RNA, 25 nt, Artificial Sequence
  Synthetic oligonucleotide
gcauucuucacuucuugagucacuc

SEQ ID NO: 4030 - RNA, 25 nt, Artificial Sequence
  Synthetic oligonucleotide
auucuugugcauucuucacuucuug

SEQ ID NO: 4031 - RNA, 25 nt, Artificial Sequence
  Synthetic oligonucleotide
uccauucuugugcauucuucacuuc

SEQ ID NO: 4032 - RNA, 25 nt, Artificial Sequence
  Synthetic oligonucleotide
auccauucuugugcauucuucacuu

SEQ ID NO: 4033 - RNA, 25 nt, Artificial Sequence
  Synthetic oligonucleotide
gauccauucuugugcauucuucacu

SEQ ID NO: 4034 - RNA, 25 nt, Artificial Sequence
  Synthetic oligonucleotide
aauuccaucuugugauccauucuug

SEQ ID NO: 4035 - RNA, 25 nt, Artificial Sequence
  Synthetic oligonucleotide
uaaauuccaucuugugauccauucu

SEQ ID NO: 4036 - RNA, 25 nt, Artificial Sequence
  Synthetic oligonucleotide
auaaauuccaucuugugauccauuc

SEQ ID NO: 4037 - RNA, 25 nt, Artificial Sequence
  Synthetic oligonucleotide
gauaaauuccaucuugugauccauu

SEQ ID NO: 4038 - RNA, 25 nt, Artificial Sequence
  Synthetic oligonucleotide
ugauaaauuccaucuugugauccau

SEQ ID NO: 4039 - RNA, 25 nt, Artificial Sequence
  Synthetic oligonucleotide
ggcuaggguuugauaaauuccaucu

SEQ ID NO: 4040 - RNA, 25 nt, Artificial Sequence
  Synthetic oligonucleotide
aaaaauuuaacaagcaaggcuaggg

SEQ ID NO: 4041 - RNA, 25 nt, Artificial Sequence
  Synthetic oligonucleotide
aaaaaaaaaaaaaauuuaacaagca

SEQ ID NO: 4042 - RNA, 25 nt, Artificial Sequence
  Synthetic oligonucleotide
aaaaaaaaaaaaaaauuuaacaagc

SEQ ID NO: 4043 - RNA, 25 nt, Artificial Sequence
  Synthetic oligonucleotide
aaaaaaaaaaaaaaaauuuaacaag

SEQ ID NO: 4044 - RNA, 25 nt, Artificial Sequence
  Synthetic oligonucleotide
aaaaaaaaaaaaaaaaauuuaacaa

SEQ ID NO: 4045 - RNA, 25 nt, Artificial Sequence
  Synthetic oligonucleotide
aaaaaaaaaaaaaaaaaauuuaaca

SEQ ID NO: 4046 - RNA, 25 nt, Artificial Sequence
  Synthetic oligonucleotide
aaaaaaaaaaaaaaaaaaauuuaac

SEQ ID NO: 4047 - RNA, 25 nt, Artificial Sequence
  Synthetic oligonucleotide
uaaaaaaaaaaaaaaaaaaauuuaa

SEQ ID NO: 4048 - RNA, 25 nt, Artificial Sequence
  Synthetic oligonucleotide
uuaaaaaaaaaaaaaaaaaaauuua

SEQ ID NO: 4049 - RNA, 25 nt, Artificial Sequence
  Synthetic oligonucleotide
ucuuaaaaaaaaaaaaaaaaaaauu

SEQ ID NO: 4050 - RNA, 25 nt, Artificial Sequence
  Synthetic oligonucleotide
uucuuaaaaaaaaaaaaaaaaaaau

SEQ ID NO: 4051 - RNA, 25 nt, Artificial Sequence
  Synthetic oligonucleotide
auucuuaaaaaaaaaaaaaaaaaaa

SEQ ID NO: 4052 - RNA, 25 nt, Artificial Sequence
  Synthetic oligonucleotide
uauucuuaaaaaaaaaaaaaaaaaa

SEQ ID NO: 4053 - RNA, 25 nt, Artificial Sequence
  Synthetic oligonucleotide
auauucuuaaaaaaaaaaaaaaaaa

SEQ ID NO: 4054 - RNA, 25 nt, Artificial Sequence
  Synthetic oligonucleotide
gauauucuuaaaaaaaaaaaaaaaa

SEQ ID NO: 4055 - RNA, 25 nt, Artificial Sequence
  Synthetic oligonucleotide
agauauucuuaaaaaaaaaaaaaaa

SEQ ID NO: 4056 - RNA, 25 nt, Artificial Sequence
  Synthetic oligonucleotide
uuacagauauucuuaaaaaaaaaaa

SEQ ID NO: 4057 - RNA, 25 nt, Artificial Sequence
  Synthetic oligonucleotide
auuacagauauucuuaaaaaaaaaa

SEQ ID NO: 4058 - RNA, 25 nt, Artificial Sequence
  Synthetic oligonucleotide
uaccauuacagauauucuuaaaaaa

SEQ ID NO: 4059 - RNA, 25 nt, Artificial Sequence
  Synthetic oligonucleotide
guaccauuacagauauucuuaaaaa

SEQ ID NO: 4060 - RNA, 25 nt, Artificial Sequence
  Synthetic oligonucleotide
aguaccauuacagauauucuuaaaa

SEQ ID NO: 4061 - RNA, 25 nt, Artificial Sequence
  Synthetic oligonucleotide
agucaguaccauuacagauauucuu

SEQ ID NO: 4062 - RNA, 25 nt, Artificial Sequence
  Synthetic oligonucleotide
uacuucaaagcaagcaaagucagua

SEQ ID NO: 4063 - RNA, 25 nt, Artificial Sequence
  Synthetic oligonucleotide
aaaaagagcuacuucaaagcaagca

SEQ ID NO: 4064 - RNA, 25 nt, Artificial Sequence
  Synthetic oligonucleotide
aaaaaaaaaagagcuacuucaaagc

SEQ ID NO: 4065 - RNA, 25 nt, Artificial Sequence
  Synthetic oligonucleotide
aaaaaaaaaaagagcuacuucaaag

SEQ ID NO: 4066 - RNA, 25 nt, Artificial Sequence
  Synthetic oligonucleotide
aaaaaaaaaaaaagagcuacuucaa

SEQ ID NO: 4067 - RNA, 25 nt, Artificial Sequence
  Synthetic oligonucleotide
aaaaaaaaaaaaaagagcuacuuca

SEQ ID NO: 4068 - RNA, 25 nt, Artificial Sequence
  Synthetic oligonucleotide
aaaaaaaaaaaaaaagagcuacuuc

SEQ ID NO: 4069 - RNA, 25 nt, Artificial Sequence
  Synthetic oligonucleotide
aaaaaaaaaaaaaaaagagcuacuu

SEQ ID NO: 4070 - RNA, 25 nt, Artificial Sequence
  Synthetic oligonucleotide
aaaaaaaaaaaaaaaaaaaaaagag

SEQ ID NO: 4071 - RNA, 25 nt, Artificial Sequence
  Synthetic oligonucleotide
aaaaaaaaaaaaaaaaaaaaaaaga

SEQ ID NO: 4072 - RNA, 25 nt, Artificial Sequence
  Synthetic oligonucleotide
aaaaaaaaaaaaaaaaaaaaaaaag

SEQ ID NO: 4073 - RNA, 25 nt, Artificial Sequence
  Synthetic oligonucleotide
aaaaaaaaaaaaaaaaaaaaaaaaa

SEQ ID NO: 4074 - RNA, 25 nt, Artificial Sequence
  Synthetic oligonucleotide
gcaaaaaaaaaaaaaaaaaaaaaaa

SEQ ID NO: 4075 - RNA, 25 nt, Artificial Sequence
  Synthetic oligonucleotide
ugcaaaaaaaaaaaaaaaaaaaaaa

SEQ ID NO: 4076 - RNA, 25 nt, Artificial Sequence
  Synthetic oligonucleotide
uuacugcaaaaaaaaaaaaaaaaaa

SEQ ID NO: 4077 - RNA, 25 nt, Artificial Sequence
  Synthetic oligonucleotide
guuacugcaaaaaaaaaaaaaaaaa

SEQ ID NO: 4078 - RNA, 25 nt, Artificial Sequence
  Synthetic oligonucleotide
aguuacugcaaaaaaaaaaaaaaaa

SEQ ID NO: 4079 - RNA, 25 nt, Artificial Sequence
  Synthetic oligonucleotide
aaacaguuacugcaaaaaaaaaaaa

SEQ ID NO: 4080 - RNA, 25 nt, Artificial Sequence
  Synthetic oligonucleotide
aaaacaguuacugcaaaaaaaaaaa

SEQ ID NO: 4081 - RNA, 25 nt, Artificial Sequence
  Synthetic oligonucleotide
aaaaacaguuacugcaaaaaaaaaa

SEQ ID NO: 4082 - RNA, 25 nt, Artificial Sequence
  Synthetic oligonucleotide
uaaaaaacaguuacugcaaaaaaaa

SEQ ID NO: 4083 - RNA, 25 nt, Artificial Sequence
  Synthetic oligonucleotide
uuaaaaaacaguuacugcaaaaaaa

SEQ ID NO: 4084 - RNA, 25 nt, Artificial Sequence
  Synthetic oligonucleotide
acuuaaaaaacaguuacugcaaaaa

SEQ ID NO: 4085 - RNA, 25 nt, Artificial Sequence
  Synthetic oligonucleotide
acuacgagagacuuaaaaaacaguu

SEQ ID NO: 4086 - RNA, 25 nt, Artificial Sequence
  Synthetic oligonucleotide
acacuacgagagacuuaaaaaacag

SEQ ID NO: 4087 - RNA, 25 nt, Artificial Sequence
  Synthetic oligonucleotide
aacacuacgagagacuuaaaaaaca

SEQ ID NO: 4088 - RNA, 25 nt, Artificial Sequence
  Synthetic oligonucleotide
uuaacacuacgagagacuuaaaaaa

SEQ ID NO: 4089 - RNA, 25 nt, Artificial Sequence
  Synthetic oligonucleotide
aacuuaacacuacgagagacuuaaa

SEQ ID NO: 4090 - RNA, 25 nt, Artificial Sequence
  Synthetic oligonucleotide
uaacuuaacacuacgagagacuuaa

SEQ ID NO: 4091 - RNA, 25 nt, Artificial Sequence
  Synthetic oligonucleotide
auucacuauaacuuaacacuacgag

SEQ ID NO: 4092 - RNA, 25 nt, Artificial Sequence
  Synthetic oligonucleotide
uauucacuauaacuuaacacuacga

SEQ ID NO: 4093 - RNA, 25 nt, Artificial Sequence
  Synthetic oligonucleotide
guauucacuauaacuuaacacuacg

SEQ ID NO: 4094 - RNA, 25 nt, Artificial Sequence
  Synthetic oligonucleotide
aguauucacuauaacuuaacacuac

SEQ ID NO: 4095 - RNA, 25 nt, Artificial Sequence
  Synthetic oligonucleotide
aaauugcuguagcaguauucacuau

SEQ ID NO: 4096 - RNA, 25 nt, Artificial Sequence
  Synthetic oligonucleotide
gaaauugcuguagcaguauucacua

SEQ ID NO: 4097 - RNA, 25 nt, Artificial Sequence
  Synthetic oligonucleotide
agaaauugcuguagcaguauucacu

SEQ ID NO: 4098 - RNA, 25 nt, Artificial Sequence
  Synthetic oligonucleotide
ucaauucuuaaaaauuagaaauugc

SEQ ID NO: 4099 - RNA, 25 nt, Artificial Sequence
  Synthetic oligonucleotide
auuacucaauucuuaaaaauuagaa

SEQ ID NO: 4100 - RNA, 25 nt, Artificial Sequence
  Synthetic oligonucleotide
accauuacucaauucuuaaaaauua

SEQ ID NO: 4101 - RNA, 25 nt, Artificial Sequence
  Synthetic oligonucleotide
acaccauuacucaauucuuaaaaau

SEQ ID NO: 4102 - RNA, 25 nt, Artificial Sequence
  Synthetic oligonucleotide
uacaccauuacucaauucuuaaaaa

SEQ ID NO: 4103 - RNA, 25 nt, Artificial Sequence
  Synthetic oligonucleotide
ucuacaccauuacucaauucuuaaa

SEQ ID NO: 4104 - RNA, 25 nt, Artificial Sequence
  Synthetic oligonucleotide
guucuacaccauuacucaauucuua

SEQ ID NO: 4105 - RNA, 25 nt, Artificial Sequence
  Synthetic oligonucleotide
gaauuaguguucuacaccauuacuc

SEQ ID NO: 4106 - RNA, 25 nt, Artificial Sequence
  Synthetic oligonucleotide
auuaugaauuaguguucuacaccau

SEQ ID NO: 4107 - RNA, 25 nt, Artificial Sequence
  Synthetic oligonucleotide
gauuaugaauuaguguucuacacca

SEQ ID NO: 4108 - RNA, 25 nt, Artificial Sequence
  Synthetic oligonucleotide
ugauuaugaauuaguguucuacacc

SEQ ID NO: 4109 - RNA, 25 nt, Artificial Sequence
  Synthetic oligonucleotide
uaauuagagugauuaugaauuagug

SEQ ID NO: 4110 - RNA, 25 nt, Artificial Sequence
  Synthetic oligonucleotide
uuaauuagagugauuaugaauuagu

SEQ ID NO: 4111 - RNA, 25 nt, Artificial Sequence
  Synthetic oligonucleotide
auuaauuagagugauuaugaauuag

SEQ ID NO: 4112 - RNA, 25 nt, Artificial Sequence
  Synthetic oligonucleotide
uacaauuaauuagagugauuaugaa

SEQ ID NO: 4113 - RNA, 25 nt, Artificial Sequence
  Synthetic oligonucleotide
uuacaauuaauuagagugauuauga

SEQ ID NO: 4114 - RNA, 25 nt, Artificial Sequence
  Synthetic oligonucleotide
auuacaauuaauuagagugauuaug

SEQ ID NO: 4115 - RNA, 25 nt, Artificial Sequence
  Synthetic oligonucleotide
uuauucagauuacaauuaauuagag

SEQ ID NO: 4116 - RNA, 25 nt, Artificial Sequence
  Synthetic oligonucleotide
uuuauucagauuacaauuaauuaga

SEQ ID NO: 4117 - RNA, 25 nt, Artificial Sequence
  Synthetic oligonucleotide
acacuuuauucagauuacaauuaau

SEQ ID NO: 4118 - RNA, 25 nt, Artificial Sequence
  Synthetic oligonucleotide
uacacuuuauucagauuacaauuaa

SEQ ID NO: 4119 - RNA, 25 nt, Artificial Sequence
  Synthetic oligonucleotide
uuacacuuuauucagauuacaauua

SEQ ID NO: 4120 - RNA, 25 nt, Artificial Sequence
  Synthetic oligonucleotide
guuacacuuuauucagauuacaauu

SEQ ID NO: 4121 - RNA, 25 nt, Artificial Sequence
  Synthetic oligonucleotide
uguuacacuuuauucagauuacaau

SEQ ID NO: 4122 - RNA, 25 nt, Artificial Sequence
  Synthetic oligonucleotide
acacaauuguuacacuuuauucaga

SEQ ID NO: 4123 - RNA, 25 nt, Artificial Sequence
  Synthetic oligonucleotide
ggcuacacaauuguuacacuuuauu

SEQ ID NO: 4124 - RNA, 25 nt, Artificial Sequence
  Synthetic oligonucleotide
aaaaaggcuacacaauuguuacacu

SEQ ID NO: 4125 - RNA, 25 nt, Artificial Sequence
  Synthetic oligonucleotide
uuauacaaaaaggcuacacaauugu

SEQ ID NO: 4126 - RNA, 25 nt, Artificial Sequence
  Synthetic oligonucleotide
uuuauacaaaaaggcuacacaauug

SEQ ID NO: 4127 - RNA, 25 nt, Artificial Sequence
  Synthetic oligonucleotide
auuuuauacaaaaaggcuacacaau

SEQ ID NO: 4128 - RNA, 25 nt, Artificial Sequence
  Synthetic oligonucleotide
uauuuuauacaaaaaggcuacacaa

SEQ ID NO: 4129 - RNA, 25 nt, Artificial Sequence
  Synthetic oligonucleotide
ucuauuuuauacaaaaaggcuacac

SEQ ID NO: 4130 - RNA, 25 nt, Artificial Sequence
  Synthetic oligonucleotide
uauuugucuauuuuauacaaaaagg

SEQ ID NO: 4131 - RNA, 25 nt, Artificial Sequence
  Synthetic oligonucleotide
ucuauuugucuauuuuauacaaaaa

SEQ ID NO: 4132 - RNA, 25 nt, Artificial Sequence
  Synthetic oligonucleotide
uucuauuugucuauuuuauacaaaa

SEQ ID NO: 4133 - RNA, 25 nt, Artificial Sequence
  Synthetic oligonucleotide
uuucuauuugucuauuuuauacaaa

SEQ ID NO: 4134 - RNA, 25 nt, Artificial Sequence
  Synthetic oligonucleotide
uuuucuauuugucuauuuuauacaa

SEQ ID NO: 4135 - RNA, 25 nt, Artificial Sequence
  Synthetic oligonucleotide
auuuucuauuugucuauuuuauaca

SEQ ID NO: 4136 - RNA, 25 nt, Artificial Sequence
  Synthetic oligonucleotide
accauuuucuauuugucuauuuuau

SEQ ID NO: 4137 - RNA, 25 nt, Artificial Sequence
  Synthetic oligonucleotide
gaccauuuucuauuugucuauuuua

SEQ ID NO: 4138 - RNA, 25 nt, Artificial Sequence
  Synthetic oligonucleotide
ggaccauuuucuauuugucuauuuu

SEQ ID NO: 4139 - RNA, 25 nt, Artificial Sequence
  Synthetic oligonucleotide
acuaauuggaccauuuucuauuugu

SEQ ID NO: 4140 - RNA, 25 nt, Artificial Sequence
  Synthetic oligonucleotide
aacuaauuggaccauuuucuauuug

SEQ ID NO: 4141 - RNA, 25 nt, Artificial Sequence
  Synthetic oligonucleotide
aaacuaauuggaccauuuucuauuu

SEQ ID NO: 4142 - RNA, 25 nt, Artificial Sequence
  Synthetic oligonucleotide
gaaacuaauuggaccauuuucuauu

SEQ ID NO: 4143 - RNA, 25 nt, Artificial Sequence
  Synthetic oligonucleotide
aaaaaggaaacuaauuggaccauuu

SEQ ID NO: 4144 - RNA, 25 nt, Artificial Sequence
  Synthetic oligonucleotide
uaaaaaggaaacuaauuggaccauu

SEQ ID NO: 4145 - RNA, 25 nt, Artificial Sequence
  Synthetic oligonucleotide
gcauauuaaaaaggaaacuaauugg

SEQ ID NO: 4146 - RNA, 25 nt, Artificial Sequence
  Synthetic oligonucleotide
agcauauuaaaaaggaaacuaauug

SEQ ID NO: 4147 - RNA, 25 nt, Artificial Sequence
  Synthetic oligonucleotide
uuuaagcauauuaaaaaggaaacua

SEQ ID NO: 4148 - RNA, 25 nt, Artificial Sequence
  Synthetic oligonucleotide
gcuuauuuuaagcauauuaaaaagg

SEQ ID NO: 4149 - RNA, 25 nt, Artificial Sequence
  Synthetic oligonucleotide
ugcuuauuuuaagcauauuaaaaag

SEQ ID NO: 4150 - RNA, 25 nt, Artificial Sequence
  Synthetic oligonucleotide
uccaccugcuuauuuuaagcauauu

SEQ ID NO: 4151 - RNA, 25 nt, Artificial Sequence
  Synthetic oligonucleotide
aaaacaugaaauagauccaccugcu

SEQ ID NO: 4152 - RNA, 25 nt, Artificial Sequence
  Synthetic oligonucleotide
aaaaacaugaaauagauccaccugc

SEQ ID NO: 4153 - RNA, 25 nt, Artificial Sequence
  Synthetic oligonucleotide
ucaaaaacaugaaauagauccaccu

SEQ ID NO: 4154 - RNA, 25 nt, Artificial Sequence
  Synthetic oligonucleotide
aucaaaaacaugaaauagauccacc

SEQ ID NO: 4155 - RNA, 25 nt, Artificial Sequence
  Synthetic oligonucleotide
gaucaaaaacaugaaauagauccac

SEQ ID NO: 4156 - RNA, 25 nt, Artificial Sequence
  Synthetic oligonucleotide
uuuuugaucaaaaacaugaaauaga

SEQ ID NO: 4157 - RNA, 25 nt, Artificial Sequence
  Synthetic oligonucleotide
aaauaguuuuugaucaaaaacauga

SEQ ID NO: 4158 - RNA, 25 nt, Artificial Sequence
  Synthetic oligonucleotide
ucccaaauaguuuuugaucaaaaac

SEQ ID NO: 4159 - RNA, 25 nt, Artificial Sequence
  Synthetic oligonucleotide
aucccaaauaguuuuugaucaaaaa

SEQ ID NO: 4160 - RNA, 25 nt, Artificial Sequence
  Synthetic oligonucleotide
uaucccaaauaguuuuugaucaaaa

SEQ ID NO: 4161 - RNA, 25 nt, Artificial Sequence
  Synthetic oligonucleotide
auaucccaaauaguuuuugaucaaa

SEQ ID NO: 4162 - RNA, 25 nt, Artificial Sequence
  Synthetic oligonucleotide
auacauaucccaaauaguuuuugau

SEQ ID NO: 4163 - RNA, 25 nt, Artificial Sequence
  Synthetic oligonucleotide
acccuacccauacauaucccaaaua

SEQ ID NO: 4164 - RNA, 25 nt, Artificial Sequence
  Synthetic oligonucleotide
uacccuacccauacauaucccaaau

SEQ ID NO: 4165 - RNA, 25 nt, Artificial Sequence
  Synthetic oligonucleotide
uuacccuacccauacauaucccaaa

SEQ ID NO: 4166 - RNA, 25 nt, Artificial Sequence
  Synthetic oligonucleotide
accucuuacugauuuacccuaccca

SEQ ID NO: 4167 - RNA, 25 nt, Artificial Sequence
  Synthetic oligonucleotide
acaccucuuacugauuuacccuacc

SEQ ID NO: 4168 - RNA, 25 nt, Artificial Sequence
  Synthetic oligonucleotide
aacaccucuuacugauuuacccuac

SEQ ID NO: 4169 - RNA, 25 nt, Artificial Sequence
  Synthetic oligonucleotide
uaacaccucuuacugauuuacccua

SEQ ID NO: 4170 - RNA, 25 nt, Artificial Sequence
  Synthetic oligonucleotide
auaacaccucuuacugauuuacccu

SEQ ID NO: 4171 - RNA, 25 nt, Artificial Sequence
  Synthetic oligonucleotide
aauaacaccucuuacugauuuaccc

SEQ ID NO: 4172 - RNA, 25 nt, Artificial Sequence
  Synthetic oligonucleotide
guuccaaauaacaccucuuacugau

SEQ ID NO: 4173 - RNA, 25 nt, Artificial Sequence
  Synthetic oligonucleotide
aacaagguuccaaauaacaccucuu

SEQ ID NO: 4174 - RNA, 25 nt, Artificial Sequence
  Synthetic oligonucleotide
aaacaagguuccaaauaacaccucu

SEQ ID NO: 4175 - RNA, 25 nt, Artificial Sequence
  Synthetic oligonucleotide
aaaacaagguuccaaauaacaccuc

SEQ ID NO: 4176 - RNA, 25 nt, Artificial Sequence
  Synthetic oligonucleotide
uguccaaaacaagguuccaaauaac

SEQ ID NO: 4177 - RNA, 25 nt, Artificial Sequence
  Synthetic oligonucleotide
aaacuguccaaaacaagguuccaaa

SEQ ID NO: 4178 - RNA, 25 nt, Artificial Sequence
  Synthetic oligonucleotide
uaaacuguccaaaacaagguuccaa

SEQ ID NO: 4179 - RNA, 25 nt, Artificial Sequence
  Synthetic oligonucleotide
gcaacugguaaacuguccaaaacaa

SEQ ID NO: 4180 - RNA, 25 nt, Artificial Sequence
  Synthetic oligonucleotide
gauaaaaggcaacugguaaacuguc

SEQ ID NO: 4181 - RNA, 25 nt, Artificial Sequence
  Synthetic oligonucleotide
ggauaaaaggcaacugguaaacugu

SEQ ID NO: 4182 - RNA, 25 nt, Artificial Sequence
  Synthetic oligonucleotide
aacuuugggauaaaaggcaacuggu

SEQ ID NO: 4183 - RNA, 25 nt, Artificial Sequence
  Synthetic oligonucleotide
acaacuuugggauaaaaggcaacug

SEQ ID NO: 4184 - RNA, 25 nt, Artificial Sequence
  Synthetic oligonucleotide
uuacaacaacuuugggauaaaaggc

SEQ ID NO: 4185 - RNA, 25 nt, Artificial Sequence
  Synthetic oligonucleotide
guuacaacaacuuugggauaaaagg

SEQ ID NO: 4186 - RNA, 25 nt, Artificial Sequence
  Synthetic oligonucleotide
gguuacaacaacuuugggauaaaag

SEQ ID NO: 4187 - RNA, 25 nt, Artificial Sequence
  Synthetic oligonucleotide
ucacagcagguuacaacaacuuugg

SEQ ID NO: 4188 - RNA, 25 nt, Artificial Sequence
  Synthetic oligonucleotide
aucacagcagguuacaacaacuuug

SEQ ID NO: 4189 - RNA, 25 nt, Artificial Sequence
  Synthetic oligonucleotide
guaucacagcagguuacaacaacuu

SEQ ID NO: 4190 - RNA, 25 nt, Artificial Sequence
  Synthetic oligonucleotide
ucucuugaagcaucguaucacagca

SEQ ID NO: 4191 - RNA, 25 nt, Artificial Sequence
  Synthetic oligonucleotide
uucucuugaagcaucguaucacagc

SEQ ID NO: 4192 - RNA, 25 nt, Artificial Sequence
  Synthetic oligonucleotide
uuuucucuugaagcaucguaucaca

SEQ ID NO: 4193 - RNA, 25 nt, Artificial Sequence
  Synthetic oligonucleotide
uuuuauaaccgcauuuucucuugaa

SEQ ID NO: 4194 - RNA, 25 nt, Artificial Sequence
  Synthetic oligonucleotide
uuuuuauaaccgcauuuucucuuga

SEQ ID NO: 4195 - RNA, 25 nt, Artificial Sequence
  Synthetic oligonucleotide
uuuuuuauaaccgcauuuucucuug

SEQ ID NO: 4196 - RNA, 25 nt, Artificial Sequence
  Synthetic oligonucleotide
auuuuuuauaaccgcauuuucucuu

SEQ ID NO: 4197 - RNA, 25 nt, Artificial Sequence
  Synthetic oligonucleotide
gaaccauuuuuuauaaccgcauuuu

SEQ ID NO: 4198 - RNA, 25 nt, Artificial Sequence
  Synthetic oligonucleotide
auucugaaccauuuuuuauaaccgc

SEQ ID NO: 4199 - RNA, 25 nt, Artificial Sequence
  Synthetic oligonucleotide
aauucugaaccauuuuuuauaaccg

SEQ ID NO: 4200 - RNA, 25 nt, Artificial Sequence
  Synthetic oligonucleotide
uaauucugaaccauuuuuuauaacc

SEQ ID NO: 4201 - RNA, 25 nt, Artificial Sequence
  Synthetic oligonucleotide
uuaauucugaaccauuuuuuauaac

SEQ ID NO: 4202 - RNA, 25 nt, Artificial Sequence
  Synthetic oligonucleotide
uuuaauucugaaccauuuuuuauaa

SEQ ID NO: 4203 - RNA, 25 nt, Artificial Sequence
  Synthetic oligonucleotide
guuuaauucugaaccauuuuuuaua

SEQ ID NO: 4204 - RNA, 25 nt, Artificial Sequence
  Synthetic oligonucleotide
uaaaaguuuaauucugaaccauuuu

SEQ ID NO: 4205 - RNA, 25 nt, Artificial Sequence
  Synthetic oligonucleotide
uuaaaaguuuaauucugaaccauuu

SEQ ID NO: 4206 - RNA, 25 nt, Artificial Sequence
  Synthetic oligonucleotide
aauuaaaaguuuaauucugaaccau

SEQ ID NO: 4207 - RNA, 25 nt, Artificial Sequence
  Synthetic oligonucleotide
auacagcuaaaggaugauuuacagg

SEQ ID NO: 4208 - RNA, 25 nt, Artificial Sequence
  Synthetic oligonucleotide
aauacagcuaaaggaugauuuacag

SEQ ID NO: 4209 - RNA, 25 nt, Artificial Sequence
  Synthetic oligonucleotide
acaauacagcuaaaggaugauuuac

SEQ ID NO: 4210 - RNA, 25 nt, Artificial Sequence
  Synthetic oligonucleotide
uacuccuaaaggaugauuuacaggu

SEQ ID NO: 4211 - RNA, 25 nt, Artificial Sequence
  Synthetic oligonucleotide
uuacuccuaaaggaugauuuacagg

SEQ ID NO: 4212 - RNA, 25 nt, Artificial Sequence
  Synthetic oligonucleotide
guuacuccuaaaggaugauuuacag

SEQ ID NO: 4213 - RNA, 25 nt, Artificial Sequence
  Synthetic oligonucleotide
uguuacuccuaaaggaugauuuaca

SEQ ID NO: 4214 - RNA, 25 nt, Artificial Sequence
  Synthetic oligonucleotide
auuccagaauccaaguaagacugcu

SEQ ID NO: 4215 - RNA, 25 nt, Artificial Sequence
  Synthetic oligonucleotide
ugcucccauucauaaaggacuuggg

SEQ ID NO: 4216 - RNA, 25 nt, Artificial Sequence
  Synthetic oligonucleotide
ucaauaucagcuacuugcucuugcg

SEQ ID NO: 4217 - RNA, 25 nt, Artificial Sequence
  Synthetic oligonucleotide
gucaauaucagcuacuugcucuugc

SEQ ID NO: 4218 - RNA, 25 nt, Artificial Sequence
  Synthetic oligonucleotide
ugcccgucaauaucagcuacuugcu

SEQ ID NO: 4219 - RNA, 25 nt, Artificial Sequence
  Synthetic oligonucleotide
uuucaacaucugugaugguucagcc

SEQ ID NO: 4220 - RNA, 25 nt, Artificial Sequence
  Synthetic oligonucleotide
guuucaacaucugugaugguucagc

SEQ ID NO: 4221 - RNA, 25 nt, Artificial Sequence
  Synthetic oligonucleotide
acaacugcauguuucaacaucugug

SEQ ID NO: 4222 - RNA, 25 nt, Artificial Sequence
  Synthetic oligonucleotide
ugacaacugcauguuucaacaucug

SEQ ID NO: 4223 - RNA, 25 nt, Artificial Sequence
  Synthetic oligonucleotide
aaauugacaacugcauguuucaaca

SEQ ID NO: 4224 - RNA, 25 nt, Artificial Sequence
  Synthetic oligonucleotide
uuaaucaaauugacaacugcauguu

SEQ ID NO: 4225 - RNA, 25 nt, Artificial Sequence
  Synthetic oligonucleotide
ugauaguuaaucaaauugacaacug

SEQ ID NO: 4226 - RNA, 25 nt, Artificial Sequence
  Synthetic oligonucleotide
ucauccugauaguuaaucaaauuga

SEQ ID NO: 4227 - RNA, 25 nt, Artificial Sequence
  Synthetic oligonucleotide
gucauccugauaguuaaucaaauug

SEQ ID NO: 4228 - RNA, 25 nt, Artificial Sequence
  Synthetic oligonucleotide
ucaucguuuagcaguuuugucagcu

SEQ ID NO: 4229 - RNA, 25 nt, Artificial Sequence
  Synthetic oligonucleotide
gguccucaucguuuagcaguuuugu

SEQ ID NO: 4230 - RNA, 25 nt, Artificial Sequence
  Synthetic oligonucleotide
uaacagcagcuuuauuaacuaccac

SEQ ID NO: 4231 - RNA, 25 nt, Artificial Sequence
  Synthetic oligonucleotide
auaacagcagcuuuauuaacuacca

SEQ ID NO: 4232 - RNA, 25 nt, Artificial Sequence
  Synthetic oligonucleotide
accauaacagcagcuuuauuaacua

SEQ ID NO: 4233 - RNA, 25 nt, Artificial Sequence
  Synthetic oligonucleotide
gaccauaacagcagcuuuauuaacu

SEQ ID NO: 4234 - RNA, 25 nt, Artificial Sequence
  Synthetic oligonucleotide
gucucuacaucauuuguauucugca

SEQ ID NO: 4235 - RNA, 25 nt, Artificial Sequence
  Synthetic oligonucleotide
ugucucuacaucauuuguauucugc

SEQ ID NO: 4236 - RNA, 25 nt, Artificial Sequence
  Synthetic oligonucleotide
aaccauuuucugcaguccaccagcu

SEQ ID NO: 4237 - RNA, 25 nt, Artificial Sequence
  Synthetic oligonucleotide
gcaaccauuuucugcaguccaccag

SEQ ID NO: 4238 - RNA, 25 nt, Artificial Sequence
  Synthetic oligonucleotide
guuuuguugagcaaagcaaccauuu

SEQ ID NO: 4239 - RNA, 25 nt, Artificial Sequence
  Synthetic oligonucleotide
uguuuuguugagcaaagcaaccauu

SEQ ID NO: 4240 - RNA, 25 nt, Artificial Sequence
  Synthetic oligonucleotide
gccaagaauuucacguuuguuuugu

SEQ ID NO: 4241 - RNA, 25 nt, Artificial Sequence
  Synthetic oligonucleotide
ugauugccauaagcuaagaucugaa

SEQ ID NO: 4242 - RNA, 25 nt, Artificial Sequence
  Synthetic oligonucleotide
ucucuugauugccauaagcuaagau

SEQ ID NO: 4243 - RNA, 25 nt, Artificial Sequence
  Synthetic oligonucleotide
ucucauaaguguagguccucauuau

SEQ ID NO: 4244 - RNA, 25 nt, Artificial Sequence
  Synthetic oligonucleotide
uucucauaaguguagguccucauua

SEQ ID NO: 4245 - RNA, 25 nt, Artificial Sequence
  Synthetic oligonucleotide
gcuucucauaaguguagguccucau

SEQ ID NO: 4246 - RNA, 25 nt, Artificial Sequence
  Synthetic oligonucleotide
agcuucucauaaguguagguccuca

SEQ ID NO: 4247 - RNA, 25 nt, Artificial Sequence
  Synthetic oligonucleotide
guccaaagacaguuuugaacaaguc

SEQ ID NO: 4248 - RNA, 25 nt, Artificial Sequence
  Synthetic oligonucleotide
aguccaaagacaguuuugaacaagu

SEQ ID NO: 4249 - RNA, 25 nt, Artificial Sequence
  Synthetic oligonucleotide
acauuuauaucaucggaacccagaa

SEQ ID NO: 4250 - RNA, 25 nt, Artificial Sequence
  Synthetic oligonucleotide
accacauuuauaucaucggaaccca

SEQ ID NO: 4251 - RNA, 25 nt, Artificial Sequence
  Synthetic oligonucleotide
gcacaggugaccacauuuauaucau

SEQ ID NO: 4252 - RNA, 25 nt, Artificial Sequence
  Synthetic oligonucleotide
ugcacaggugaccacauuuauauca

SEQ ID NO: 4253 - RNA, 25 nt, Artificial Sequence
  Synthetic oligonucleotide
guaauuauugcaagugagguuagag

SEQ ID NO: 4254 - RNA, 25 nt, Artificial Sequence
  Synthetic oligonucleotide
ucaucuuguuuuuguaauuauugca

SEQ ID NO: 4255 - RNA, 25 nt, Artificial Sequence
  Synthetic oligonucleotide
aucaucuuguuuuuguaauuauugc

SEQ ID NO: 4256 - RNA, 25 nt, Artificial Sequence
  Synthetic oligonucleotide
accaucaucuuguuuuuguaauuau

SEQ ID NO: 4257 - RNA, 25 nt, Artificial Sequence
  Synthetic oligonucleotide
ggcacaccaucaucuuguuuuugua

SEQ ID NO: 4258 - RNA, 25 nt, Artificial Sequence
  Synthetic oligonucleotide
aauccaacaguugccuuuaucagag

SEQ ID NO: 4259 - RNA, 25 nt, Artificial Sequence
  Synthetic oligonucleotide
gaaucaauccaacaguugccuuuau

SEQ ID NO: 4260 - RNA, 25 nt, Artificial Sequence
  Synthetic oligonucleotide
ugaacuagucguggaauagcacccu

SEQ ID NO: 4261 - RNA, 25 nt, Artificial Sequence
  Synthetic oligonucleotide
uacacccuucuacuaucuccuccau

SEQ ID NO: 4262 - RNA, 25 nt, Artificial Sequence
  Synthetic oligonucleotide
guacacccuucuacuaucuccucca

SEQ ID NO: 4263 - RNA, 25 nt, Artificial Sequence
  Synthetic oligonucleotide
aguacacccuucuacuaucuccucc

SEQ ID NO: 4264 - RNA, 25 nt, Artificial Sequence
  Synthetic oligonucleotide
gcuccaguacacccuucuacuaucu

SEQ ID NO: 4265 - RNA, 25 nt, Artificial Sequence
  Synthetic oligonucleotide
acaauggaaugguauugaguccucg

SEQ ID NO: 4266 - RNA, 25 nt, Artificial Sequence
  Synthetic oligonucleotide
gcacaaacaauggaaugguauugag

SEQ ID NO: 4267 - RNA, 25 nt, Artificial Sequence
  Synthetic oligonucleotide
ugcacaaacaauggaaugguauuga

SEQ ID NO: 4268 - RNA, 25 nt, Artificial Sequence
  Synthetic oligonucleotide
gcaacugcacaaacaauggaauggu

SEQ ID NO: 4269 - RNA, 25 nt, Artificial Sequence
  Synthetic oligonucleotide
gaauaaagcaacugcacaaacaaug

SEQ ID NO: 4270 - RNA, 25 nt, Artificial Sequence
  Synthetic oligonucleotide
ucaaugggagaauaaagcaacugca

SEQ ID NO: 4271 - RNA, 25 nt, Artificial Sequence
  Synthetic oligonucleotide
uucaaugggagaauaaagcaacugc

SEQ ID NO: 4272 - RNA, 25 nt, Artificial Sequence
  Synthetic oligonucleotide
uuucaaugggagaauaaagcaacug

SEQ ID NO: 4273 - RNA, 25 nt, Artificial Sequence
  Synthetic oligonucleotide
auauuuucaaugggagaauaaagca

SEQ ID NO: 4274 - RNA, 25 nt, Artificial Sequence
  Synthetic oligonucleotide
gauauuuucaaugggagaauaaagc

SEQ ID NO: 4275 - RNA, 25 nt, Artificial Sequence
  Synthetic oligonucleotide
ggauauuuucaaugggagaauaaag

SEQ ID NO: 4276 - RNA, 25 nt, Artificial Sequence
  Synthetic oligonucleotide
gcuacucuuuggauauuuucaaugg

SEQ ID NO: 4277 - RNA, 25 nt, Artificial Sequence
  Synthetic oligonucleotide
agcuacucuuuggauauuuucaaug

SEQ ID NO: 4278 - RNA, 25 nt, Artificial Sequence
  Synthetic oligonucleotide
gcuucuuguaauccuguggcuuguc

SEQ ID NO: 4279 - RNA, 25 nt, Artificial Sequence
  Synthetic oligonucleotide
aguccaagaucugcagucucauucc

SEQ ID NO: 4280 - RNA, 25 nt, Artificial Sequence
  Synthetic oligonucleotide
uauccaccagagugaaaagaacggu

SEQ ID NO: 4281 - RNA, 25 nt, Artificial Sequence
  Synthetic oligonucleotide
ggccagcugauugcuaucaccuggg

SEQ ID NO: 4282 - RNA, 25 nt, Artificial Sequence
  Synthetic oligonucleotide
auuuacaggucaguaucaaaccagg

SEQ ID NO: 4283 - RNA, 25 nt, Artificial Sequence
  Synthetic oligonucleotide
gauuuacaggucaguaucaaaccag

SEQ ID NO: 4284 - RNA, 25 nt, Artificial Sequence
  Synthetic oligonucleotide
ucuuaccuaaaggacgauuuacagg

SEQ ID NO: 4285 - RNA, 25 nt, Artificial Sequence
  Synthetic oligonucleotide
uuucuuaccuaaaggacgauuuaca

SEQ ID NO: 4286 - RNA, 25 nt, Artificial Sequence
  Synthetic oligonucleotide
uuuauaagcuuucuuaccuaaagga

SEQ ID NO: 4287 - RNA, 25 nt, Artificial Sequence
  Synthetic oligonucleotide
uuuuauaagcuuucuuaccuaaagg

SEQ ID NO: 4288 - RNA, 25 nt, Artificial Sequence
  Synthetic oligonucleotide
ggcuuuuauaagcuuucuuaccuaa

SEQ ID NO: 4289 - RNA, 25 nt, Artificial Sequence
  Synthetic oligonucleotide
acacuggcuuuuauaagcuuucuua

SEQ ID NO: 4290 - RNA, 25 nt, Artificial Sequence
  Synthetic oligonucleotide
ucacccacacuggcuuuuauaagcu

SEQ ID NO: 4291 - RNA, 25 nt, Artificial Sequence
  Synthetic oligonucleotide
uaccaagucuuucuggaguucugca

SEQ ID NO: 4292 - RNA, 25 nt, Artificial Sequence
  Synthetic oligonucleotide
uuacaaacaggccuaaaaccauucc

SEQ ID NO: 4293 - RNA, 25 nt, Artificial Sequence
  Synthetic oligonucleotide
uuuacaaacaggccuaaaaccauuc

SEQ ID NO: 4294 - RNA, 25 nt, Artificial Sequence
  Synthetic oligonucleotide
auuuacaaacaggccuaaaaccauu

SEQ ID NO: 4295 - RNA, 25 nt, Artificial Sequence
  Synthetic oligonucleotide
ucuccuuccaagguauguaucuguu

SEQ ID NO: 4296 - RNA, 25 nt, Artificial Sequence
  Synthetic oligonucleotide
aucuccuuccaagguauguaucugu

SEQ ID NO: 4297 - RNA, 25 nt, Artificial Sequence
  Synthetic oligonucleotide
uuccacacaugaacaucuccuucca

SEQ ID NO: 4298 - RNA, 25 nt, Artificial Sequence
  Synthetic oligonucleotide
aacuuccacacaugaacaucuccuu

SEQ ID NO: 4299 - RNA, 25 nt, Artificial Sequence
  Synthetic oligonucleotide
aaacuuccacacaugaacaucuccu

SEQ ID NO: 4300 - RNA, 25 nt, Artificial Sequence
  Synthetic oligonucleotide
gaaacuuccacacaugaacaucucc

SEQ ID NO: 4301 - RNA, 25 nt, Artificial Sequence
  Synthetic oligonucleotide
agaaacuuccacacaugaacaucuc

SEQ ID NO: 4302 - RNA, 25 nt, Artificial Sequence
  Synthetic oligonucleotide
ucaacgugagaaacuuccacacaug

SEQ ID NO: 4303 - RNA, 25 nt, Artificial Sequence
  Synthetic oligonucleotide
acaucaacgugagaaacuuccacac

SEQ ID NO: 4304 - RNA, 25 nt, Artificial Sequence
  Synthetic oligonucleotide
aacaucaacgugagaaacuuccaca

SEQ ID NO: 4305 - RNA, 25 nt, Artificial Sequence
  Synthetic oligonucleotide
aaacaucaacgugagaaacuuccac

SEQ ID NO: 4306 - RNA, 25 nt, Artificial Sequence
  Synthetic oligonucleotide
aaaacaucaacgugagaaacuucca

SEQ ID NO: 4307 - RNA, 25 nt, Artificial Sequence
  Synthetic oligonucleotide
aaaaacaucaacgugagaaacuucc

SEQ ID NO: 4308 - RNA, 25 nt, Artificial Sequence
  Synthetic oligonucleotide
gcaaaaacaucaacgugagaaacuu

SEQ ID NO: 4309 - RNA, 25 nt, Artificial Sequence
  Synthetic oligonucleotide
gcaaaagcuguggcaaaaacaucaa

SEQ ID NO: 4310 - RNA, 25 nt, Artificial Sequence
  Synthetic oligonucleotide
ugcaaaagcuguggcaaaaacauca

SEQ ID NO: 4311 - RNA, 25 nt, Artificial Sequence
  Synthetic oligonucleotide
ucaucugaguauaacgcugcaaaag

SEQ ID NO: 4312 - RNA, 25 nt, Artificial Sequence
  Synthetic oligonucleotide
aaaacagcaaauguuacucaucuga

SEQ ID NO: 4313 - RNA, 25 nt, Artificial Sequence
  Synthetic oligonucleotide
gaaaacagcaaauguuacucaucug

SEQ ID NO: 4314 - RNA, 25 nt, Artificial Sequence
  Synthetic oligonucleotide
ugaaaacagcaaauguuacucaucu

SEQ ID NO: 4315 - RNA, 25 nt, Artificial Sequence
  Synthetic oligonucleotide
auuaauguugaaaacagcaaauguu

SEQ ID NO: 4316 - RNA, 25 nt, Artificial Sequence
  Synthetic oligonucleotide
acuacagcuguauagagagaaaggc

SEQ ID NO: 4317 - RNA, 25 nt, Artificial Sequence
  Synthetic oligonucleotide
ggccaaucacaaugcacguucagac

SEQ ID NO: 4318 - RNA, 25 nt, Artificial Sequence
  Synthetic oligonucleotide
guucccauaggaaacucagcuuggu

SEQ ID NO: 4319 - RNA, 25 nt, Artificial Sequence
  Synthetic oligonucleotide
gaacaaaaagcguacuucgacuguu

SEQ ID NO: 4320 - RNA, 25 nt, Artificial Sequence
  Synthetic oligonucleotide
ggaccagaacaaaaagcguacuucg

SEQ ID NO: 4321 - RNA, 25 nt, Artificial Sequence
  Synthetic oligonucleotide
accaaaaaggaccagaacaaaaagc

SEQ ID NO: 4322 - RNA, 25 nt, Artificial Sequence
  Synthetic oligonucleotide
gaccaaaaaggaccagaacaaaaag

SEQ ID NO: 4323 - RNA, 25 nt, Artificial Sequence
  Synthetic oligonucleotide
acuccucgaccaaaaaggaccagaa

SEQ ID NO: 4324 - RNA, 25 nt, Artificial Sequence
  Synthetic oligonucleotide
uccauuuguauuguuacuccucgac

SEQ ID NO: 4325 - RNA, 25 nt, Artificial Sequence
  Synthetic oligonucleotide
auccauuuguauuguuacuccucga

SEQ ID NO: 4326 - RNA, 25 nt, Artificial Sequence
  Synthetic oligonucleotide
aauccauuuguauuguuacuccucg

SEQ ID NO: 4327 - RNA, 25 nt, Artificial Sequence
  Synthetic oligonucleotide
aaauccauuuguauuguuacuccuc

SEQ ID NO: 4328 - RNA, 25 nt, Artificial Sequence
  Synthetic oligonucleotide
acuccccaaauccauuuguauuguu

SEQ ID NO: 4329 - RNA, 25 nt, Artificial Sequence
  Synthetic oligonucleotide
uccauucgugugcauucuucacugc

SEQ ID NO: 4330 - RNA, 25 nt, Artificial Sequence
  Synthetic oligonucleotide
auccauucgugugcauucuucacug

SEQ ID NO: 4331 - RNA, 25 nt, Artificial Sequence
  Synthetic oligonucleotide
gauccauucgugugcauucuucacu

SEQ ID NO: 4332 - RNA, 25 nt, Artificial Sequence
  Synthetic oligonucleotide
aaacaaagaacaagcaaggcuaggg

SEQ ID NO: 4333 - RNA, 25 nt, Artificial Sequence
  Synthetic oligonucleotide
accacuacagauauuaaaacaaaga

SEQ ID NO: 4334 - RNA, 25 nt, Artificial Sequence
  Synthetic oligonucleotide
gcaccacuacagauauuaaaacaaa

SEQ ID NO: 4335 - RNA, 25 nt, Artificial Sequence
  Synthetic oligonucleotide
agcaccacuacagauauuaaaacaa

SEQ ID NO: 4336 - RNA, 25 nt, Artificial Sequence
  Synthetic oligonucleotide
aaaauaaaagcaagcaaagucagca

SEQ ID NO: 4337 - RNA, 25 nt, Artificial Sequence
  Synthetic oligonucleotide
gcaaaaaauaaaagcaagcaaaguc

SEQ ID NO: 4338 - RNA, 25 nt, Artificial Sequence
  Synthetic oligonucleotide
uuacugcaaaaaauaaaagcaagca

SEQ ID NO: 4339 - RNA, 25 nt, Artificial Sequence
  Synthetic oligonucleotide
uaacaguuacugcaaaaaauaaaag

SEQ ID NO: 4340 - RNA, 25 nt, Artificial Sequence
  Synthetic oligonucleotide
acuaacaguuacugcaaaaaauaaa

SEQ ID NO: 4341 - RNA, 25 nt, Artificial Sequence
  Synthetic oligonucleotide
aaacuaacaguuacugcaaaaaaua

SEQ ID NO: 4342 - RNA, 25 nt, Artificial Sequence
  Synthetic oligonucleotide
aaaacuaacaguuacugcaaaaaau

SEQ ID NO: 4343 - RNA, 25 nt, Artificial Sequence
  Synthetic oligonucleotide
uaaaaacuaacaguuacugcaaaaa

SEQ ID NO: 4344 - RNA, 25 nt, Artificial Sequence
  Synthetic oligonucleotide
uacuuaaaaacuaacaguuacugca

SEQ ID NO: 4345 - RNA, 25 nt, Artificial Sequence
  Synthetic oligonucleotide
acuacuuaaaaacuaacaguuacug

SEQ ID NO: 4346 - RNA, 25 nt, Artificial Sequence
  Synthetic oligonucleotide
uaacacuacuuaaaaacuaacaguu

SEQ ID NO: 4347 - RNA, 25 nt, Artificial Sequence
  Synthetic oligonucleotide
auaacacuacuuaaaaacuaacagu

SEQ ID NO: 4348 - RNA, 25 nt, Artificial Sequence
  Synthetic oligonucleotide
acauaacacuacuuaaaaacuaaca

SEQ ID NO: 4349 - RNA, 25 nt, Artificial Sequence
  Synthetic oligonucleotide
aacauaacacuacuuaaaaacuaac

SEQ ID NO: 4350 - RNA, 25 nt, Artificial Sequence
  Synthetic oligonucleotide
gaacauaacacuacuuaaaaacuaa

SEQ ID NO: 4351 - RNA, 25 nt, Artificial Sequence
  Synthetic oligonucleotide
agaacauaacacuacuuaaaaacua

SEQ ID NO: 4352 - RNA, 25 nt, Artificial Sequence
  Synthetic oligonucleotide
ucacuagaacauaacacuacuuaaa

SEQ ID NO: 4353 - RNA, 25 nt, Artificial Sequence
  Synthetic oligonucleotide
guucacuagaacauaacacuacuua

SEQ ID NO: 4354 - RNA, 25 nt, Artificial Sequence
  Synthetic oligonucleotide
gguucacuagaacauaacacuacuu

SEQ ID NO: 4355 - RNA, 25 nt, Artificial Sequence
  Synthetic oligonucleotide
auuacucgguucuuagaaaucagaa

SEQ ID NO: 4356 - RNA, 25 nt, Artificial Sequence
  Synthetic oligonucleotide
accauuacucgguucuuagaaauca

SEQ ID NO: 4357 - RNA, 25 nt, Artificial Sequence
  Synthetic oligonucleotide
ucuacaccauuacucgguucuuaga

SEQ ID NO: 4358 - RNA, 25 nt, Artificial Sequence
  Synthetic oligonucleotide
gaauuaguguucuacaccauuacuc

SEQ ID NO: 4359 - RNA, 25 nt, Artificial Sequence
  Synthetic oligonucleotide
auuaugaauuaguguucuacaccau

SEQ ID NO: 4360 - RNA, 25 nt, Artificial Sequence
  Synthetic oligonucleotide
gauuaugaauuaguguucuacacca

SEQ ID NO: 4361 - RNA, 25 nt, Artificial Sequence
  Synthetic oligonucleotide
ugauuaugaauuaguguucuacacc

SEQ ID NO: 4362 - RNA, 25 nt, Artificial Sequence
  Synthetic oligonucleotide
acaauuagcgugauuaugaauuagu

SEQ ID NO: 4363 - RNA, 25 nt, Artificial Sequence
  Synthetic oligonucleotide
uacaauuagcgugauuaugaauuag

SEQ ID NO: 4364 - RNA, 25 nt, Artificial Sequence
  Synthetic oligonucleotide
agauuacaauuagcgugauuaugaa

SEQ ID NO: 4365 - RNA, 25 nt, Artificial Sequence
  Synthetic oligonucleotide
uacacgucuccagauuacaauuagc

SEQ ID NO: 4366 - RNA, 25 nt, Artificial Sequence
  Synthetic oligonucleotide
guuacacgucuccagauuacaauua

SEQ ID NO: 4367 - RNA, 25 nt, Artificial Sequence
  Synthetic oligonucleotide
uacacaauguuacacgucuccagau

SEQ ID NO: 4368 - RNA, 25 nt, Artificial Sequence
  Synthetic oligonucleotide
gcuacacaauguuacacgucuccag

SEQ ID NO: 4369 - RNA, 25 nt, Artificial Sequence
  Synthetic oligonucleotide
acaaaaggcuacacaauguuacacg

SEQ ID NO: 4370 - RNA, 25 nt, Artificial Sequence
  Synthetic oligonucleotide
uacaaaaggcuacacaauguuacac

SEQ ID NO: 4371 - RNA, 25 nt, Artificial Sequence
  Synthetic oligonucleotide
uuuauacaaaaggcuacacaauguu

SEQ ID NO: 4372 - RNA, 25 nt, Artificial Sequence
  Synthetic oligonucleotide
auuuauacaaaaggcuacacaaugu

SEQ ID NO: 4373 - RNA, 25 nt, Artificial Sequence
  Synthetic oligonucleotide
ucuauuuauacaaaaggcuacacaa

SEQ ID NO: 4374 - RNA, 25 nt, Artificial Sequence
  Synthetic oligonucleotide
gucuauuuauacaaaaggcuacaca

SEQ ID NO: 4375 - RNA, 25 nt, Artificial Sequence
  Synthetic oligonucleotide
ugucuauuuauacaaaaggcuacac

SEQ ID NO: 4376 - RNA, 25 nt, Artificial Sequence
  Synthetic oligonucleotide
ucuaucugucuauuuauacaaaagg

SEQ ID NO: 4377 - RNA, 25 nt, Artificial Sequence
  Synthetic oligonucleotide
uucuaucugucuauuuauacaaaag

SEQ ID NO: 4378 - RNA, 25 nt, Artificial Sequence
  Synthetic oligonucleotide
uuucuaucugucuauuuauacaaaa

SEQ ID NO: 4379 - RNA, 25 nt, Artificial Sequence
  Synthetic oligonucleotide
auuucuaucugucuauuuauacaaa

SEQ ID NO: 4380 - RNA, 25 nt, Artificial Sequence
  Synthetic oligonucleotide
gaccauuucuaucugucuauuuaua

SEQ ID NO: 4381 - RNA, 25 nt, Artificial Sequence
  Synthetic oligonucleotide
ggaccauuucuaucugucuauuuau

SEQ ID NO: 4382 - RNA, 25 nt, Artificial Sequence
  Synthetic oligonucleotide
acuaaucggaccauuucuaucuguc

SEQ ID NO: 4383 - RNA, 25 nt, Artificial Sequence
  Synthetic oligonucleotide
aacuaaucggaccauuucuaucugu

SEQ ID NO: 4384 - RNA, 25 nt, Artificial Sequence
  Synthetic oligonucleotide
aaacuaaucggaccauuucuaucug

SEQ ID NO: 4385 - RNA, 25 nt, Artificial Sequence
  Synthetic oligonucleotide
gaaacuaaucggaccauuucuaucu

SEQ ID NO: 4386 - RNA, 25 nt, Artificial Sequence
  Synthetic oligonucleotide
uaaaaaggaaacuaaucggaccauu

SEQ ID NO: 4387 - RNA, 25 nt, Artificial Sequence
  Synthetic oligonucleotide
gcauauuaaaaaggaaacuaaucgg

SEQ ID NO: 4388 - RNA, 25 nt, Artificial Sequence
  Synthetic oligonucleotide
agcauauuaaaaaggaaacuaaucg

SEQ ID NO: 4389 - RNA, 25 nt, Artificial Sequence
  Synthetic oligonucleotide
uuuaagcauauuaaaaaggaaacua

SEQ ID NO: 4390 - RNA, 25 nt, Artificial Sequence
  Synthetic oligonucleotide
gcuuauuuuaagcauauuaaaaagg

SEQ ID NO: 4391 - RNA, 25 nt, Artificial Sequence
  Synthetic oligonucleotide
ugcuuauuuuaagcauauuaaaaag

SEQ ID NO: 4392 - RNA, 25 nt, Artificial Sequence
  Synthetic oligonucleotide
uccaccugcuuauuuuaagcauauu

SEQ ID NO: 4393 - RNA, 25 nt, Artificial Sequence
  Synthetic oligonucleotide
aaaacaugaaauagauccaccugcu

SEQ ID NO: 4394 - RNA, 25 nt, Artificial Sequence
  Synthetic oligonucleotide
aaaaacaugaaauagauccaccugc

SEQ ID NO: 4395 - RNA, 25 nt, Artificial Sequence
  Synthetic oligonucleotide
ucaaaaacaugaaauagauccaccu

SEQ ID NO: 4396 - RNA, 25 nt, Artificial Sequence
  Synthetic oligonucleotide
uucaaaaacaugaaauagauccacc

SEQ ID NO: 4397 - RNA, 25 nt, Artificial Sequence
  Synthetic oligonucleotide
guucaaaaacaugaaauagauccac

SEQ ID NO: 4398 - RNA, 25 nt, Artificial Sequence
  Synthetic oligonucleotide
uuuuuguucaaaaacaugaaauaga

SEQ ID NO: 4399 - RNA, 25 nt, Artificial Sequence
  Synthetic oligonucleotide
auaaaguuuuuguucaaaaacauga

SEQ ID NO: 4400 - RNA, 25 nt, Artificial Sequence
  Synthetic oligonucleotide
uccccgauaaaguuuuuguucaaaa

SEQ ID NO: 4401 - RNA, 25 nt, Artificial Sequence
  Synthetic oligonucleotide
auccccgauaaaguuuuuguucaaa

SEQ ID NO: 4402 - RNA, 25 nt, Artificial Sequence
  Synthetic oligonucleotide
accucuuacugauuuacccuaccgc

SEQ ID NO: 4403 - RNA, 25 nt, Artificial Sequence
  Synthetic oligonucleotide
acaccucuuacugauuuacccuacc

SEQ ID NO: 4404 - RNA, 25 nt, Artificial Sequence
  Synthetic oligonucleotide
aacaccucuuacugauuuacccuac

SEQ ID NO: 4405 - RNA, 25 nt, Artificial Sequence
  Synthetic oligonucleotide
uaacaccucuuacugauuuacccua

SEQ ID NO: 4406 - RNA, 25 nt, Artificial Sequence
  Synthetic oligonucleotide
auaacaccucuuacugauuuacccu

SEQ ID NO: 4407 - RNA, 25 nt, Artificial Sequence
  Synthetic oligonucleotide
aauaacaccucuuacugauuuaccc

SEQ ID NO: 4408 - RNA, 25 nt, Artificial Sequence
  Synthetic oligonucleotide
ggcucaaauaacaccucuuacugau

SEQ ID NO: 4409 - RNA, 25 nt, Artificial Sequence
  Synthetic oligonucleotide
aacaaggcucaaauaacaccucuua

SEQ ID NO: 4410 - RNA, 25 nt, Artificial Sequence
  Synthetic oligonucleotide
aaacaaggcucaaauaacaccucuu

SEQ ID NO: 4411 - RNA, 25 nt, Artificial Sequence
  Synthetic oligonucleotide
aaaacaaggcucaaauaacaccucu

SEQ ID NO: 4412 - RNA, 25 nt, Artificial Sequence
  Synthetic oligonucleotide
uccaaaacaaggcucaaauaacacc

SEQ ID NO: 4413 - RNA, 25 nt, Artificial Sequence
  Synthetic oligonucleotide
uguccaaaacaaggcucaaauaaca

SEQ ID NO: 4414 - RNA, 25 nt, Artificial Sequence
  Synthetic oligonucleotide
uauacuguccaaaacaaggcucaaa

SEQ ID NO: 4415 - RNA, 25 nt, Artificial Sequence
  Synthetic oligonucleotide
gcaacugguauacuguccaaaacaa

SEQ ID NO: 4416 - RNA, 25 nt, Artificial Sequence
  Synthetic oligonucleotide
gauaaaaggcaacugguauacuguc

SEQ ID NO: 4417 - RNA, 25 nt, Artificial Sequence
  Synthetic oligonucleotide
ggauaaaaggcaacugguauacugu

SEQ ID NO: 4418 - RNA, 25 nt, Artificial Sequence
  Synthetic oligonucleotide
aacuuugggauaaaaggcaacuggu

SEQ ID NO: 4419 - RNA, 25 nt, Artificial Sequence
  Synthetic oligonucleotide
acaacuuugggauaaaaggcaacug

SEQ ID NO: 4420 - RNA, 25 nt, Artificial Sequence
  Synthetic oligonucleotide
uuacaacaacuuugggauaaaaggc

SEQ ID NO: 4421 - RNA, 25 nt, Artificial Sequence
  Synthetic oligonucleotide
guuacaacaacuuugggauaaaagg

SEQ ID NO: 4422 - RNA, 25 nt, Artificial Sequence
  Synthetic oligonucleotide
gguuacaacaacuuugggauaaaag

SEQ ID NO: 4423 - RNA, 25 nt, Artificial Sequence
  Synthetic oligonucleotide
ucacagcagguuacaacaacuuugg

SEQ ID NO: 4424 - RNA, 25 nt, Artificial Sequence
  Synthetic oligonucleotide
aucacagcagguuacaacaacuuug

SEQ ID NO: 4425 - RNA, 25 nt, Artificial Sequence
  Synthetic oligonucleotide
guaucacagcagguuacaacaacuu

SEQ ID NO: 4426 - RNA, 25 nt, Artificial Sequence
  Synthetic oligonucleotide
gcaucuguugaagcauuguaucaca

SEQ ID NO: 4427 - RNA, 25 nt, Artificial Sequence
  Synthetic oligonucleotide
ugaaccauuucuauaaccgcaucug

SEQ ID NO: 4428 - RNA, 25 nt, Artificial Sequence
  Synthetic oligonucleotide
auucugaaccauuucuauaaccgca

SEQ ID NO: 4429 - RNA, 25 nt, Artificial Sequence
  Synthetic oligonucleotide
uaauucugaaccauuucuauaaccg

SEQ ID NO: 4430 - RNA, 25 nt, Artificial Sequence
  Synthetic oligonucleotide
uuaauucugaaccauuucuauaacc

SEQ ID NO: 4431 - RNA, 25 nt, Artificial Sequence
  Synthetic oligonucleotide
uuuaauucugaaccauuucuauaac

SEQ ID NO: 4432 - RNA, 25 nt, Artificial Sequence
  Synthetic oligonucleotide
guuuaauucugaaccauuucuauaa

SEQ ID NO: 4433 - RNA, 25 nt, Artificial Sequence
  Synthetic oligonucleotide
uaaaaguuuaauucugaaccauuuc

SEQ ID NO: 4434 - RNA, 25 nt, Artificial Sequence
  Synthetic oligonucleotide
uuaaaaguuuaauucugaaccauuu

SEQ ID NO: 4435 - RNA, 25 nt, Artificial Sequence
  Synthetic oligonucleotide
aauuaaaaguuuaauucugaaccau

SEQ ID NO: 4436 - RNA, 25 nt, Artificial Sequence
  Synthetic oligonucleotide
ugaaugaauuaaaaguuuaauucug

SEQ ID NO: 4437 - RNA, 25 nt, Artificial Sequence
  Synthetic oligonucleotide
uuuuugaaugaauuaaaaguuuaau

SEQ ID NO: 4438 - RNA, 25 nt, Artificial Sequence
  Synthetic oligonucleotide
uuuuuuuuugaaugaauuaaaaguu

SEQ ID NO: 4439 - RNA, 25 nt, Artificial Sequence
  Synthetic oligonucleotide
uuuuuuuuuugaaugaauuaaaagu

SEQ ID NO: 4440 - RNA, 25 nt, Artificial Sequence
  Synthetic oligonucleotide
uuuuuuuuuuugaaugaauuaaaag

SEQ ID NO: 4441 - RNA, 25 nt, Artificial Sequence
  Synthetic oligonucleotide
uuuuuuuuuuuugaaugaauuaaaa

SEQ ID NO: 4442 - RNA, 25 nt, Artificial Sequence
  Synthetic oligonucleotide
uuuuuuuuuuuuugaaugaauuaaa

SEQ ID NO: 4443 - RNA, 25 nt, Artificial Sequence
  Synthetic oligonucleotide
uuuuuuuuuuuuuugaaugaauuaa

SEQ ID NO: 4444 - DNA, 21 bp, Artificial Sequence
  Synthetic oligonucleotide
ccctgagggtatttgaagtat

SEQ ID NO: 4445 - DNA, 21 bp, Artificial Sequence
  Synthetic oligonucleotide
gagggtatttgaagtatacca

SEQ ID NO: 4446 - DNA, 21 bp, Artificial Sequence
  Synthetic oligonucleotide
tgaagtataccatacaactgt

SEQ ID NO: 4447 - DNA, 21 bp, Artificial Sequence
  Synthetic oligonucleotide
ataccatacaactgttttgaa

SEQ ID NO: 4448 - DNA, 21 bp, Artificial Sequence
  Synthetic oligonucleotide
atacaactgttttgaaaatcc

SEQ ID NO: 4449 - DNA, 21 bp, Artificial Sequence
  Synthetic oligonucleotide
cagggattttctcagtccttc

SEQ ID NO: 4450 - DNA, 21 bp, Artificial Sequence
  Synthetic oligonucleotide
cactcaagaacaagtagctga

SEQ ID NO: 4451 - DNA, 21 bp, Artificial Sequence
  Synthetic oligonucleotide
agaacaagtagctgatattga

SEQ ID NO: 4452 - DNA, 21 bp, Artificial Sequence
  Synthetic oligonucleotide
aacaagtagctgatattgatg

SEQ ID NO: 4453 - DNA, 21 bp, Artificial Sequence
  Synthetic oligonucleotide
tgatggacagtatgcaatgac

SEQ ID NO: 4454 - DNA, 21 bp, Artificial Sequence
  Synthetic oligonucleotide
tgctatgttccctgagacatt

SEQ ID NO: 4455 - DNA, 21 bp, Artificial Sequence
  Synthetic oligonucleotide
tgctgaaacatgcagttgtaa

SEQ ID NO: 4456 - DNA, 21 bp, Artificial Sequence
  Synthetic oligonucleotide
aacatgcagttgtaaacttga

SEQ ID NO: 4457 - DNA, 21 bp, Artificial Sequence
  Synthetic oligonucleotide
gcagttgtaaacttgattaac

SEQ ID NO: 4458 - DNA, 21 bp, Artificial Sequence
  Synthetic oligonucleotide
acttgattaactatcaagatg

SEQ ID NO: 4459 - DNA, 21 bp, Artificial Sequence
  Synthetic oligonucleotide
ccctgaactgacaaaactgct

SEQ ID NO: 4460 - DNA, 21 bp, Artificial Sequence
  Synthetic oligonucleotide
tcagatggtgtctgctattgt

SEQ ID NO: 4461 - DNA, 21 bp, Artificial Sequence
  Synthetic oligonucleotide
gtacgtaccatgcagaataca

SEQ ID NO: 4462 - DNA, 21 bp, Artificial Sequence
  Synthetic oligonucleotide
attacaactctccacaacctt

SEQ ID NO: 4463 - DNA, 21 bp, Artificial Sequence
  Synthetic oligonucleotide
aactctccacaaccttttatt

SEQ ID NO: 4464 - DNA, 21 bp, Artificial Sequence
  Synthetic oligonucleotide
tccacaaccttttattacatc

SEQ ID NO: 4465 - DNA, 21 bp, Artificial Sequence
  Synthetic oligonucleotide
accttttattacatcaagaag

SEQ ID NO: 4466 - DNA, 21 bp, Artificial Sequence
  Synthetic oligonucleotide
acaaaacaaatgttaaattct

SEQ ID NO: 4467 - DNA, 21 bp, Artificial Sequence
  Synthetic oligonucleotide
attacgacagactgccttcaa

SEQ ID NO: 4468 - DNA, 21 bp, Artificial Sequence
  Synthetic oligonucleotide
gacagactgccttcaaatttt

SEQ ID NO: 4469 - DNA, 21 bp, Artificial Sequence
  Synthetic oligonucleotide
agctttagtaaatataatgag

SEQ ID NO: 4470 - DNA, 21 bp, Artificial Sequence
  Synthetic oligonucleotide
gaaaaactactgtggaccaca

SEQ ID NO: 4471 - DNA, 21 bp, Artificial Sequence
  Synthetic oligonucleotide
caagtcaacgtcttgttcaga

SEQ ID NO: 4472 - DNA, 21 bp, Artificial Sequence
  Synthetic oligonucleotide
aacgtcttgttcagaactgtc

SEQ ID NO: 4473 - DNA, 21 bp, Artificial Sequence
  Synthetic oligonucleotide
cttgttcagaactgtctttgg

SEQ ID NO: 4474 - DNA, 21 bp, Artificial Sequence
  Synthetic oligonucleotide
tgggttcagatgatataaatg

SEQ ID NO: 4475 - DNA, 21 bp, Artificial Sequence
  Synthetic oligonucleotide
attctttctaacctcacttgc

SEQ ID NO: 4476 - DNA, 21 bp, Artificial Sequence
  Synthetic oligonucleotide
acctcacttgcaataattata

SEQ ID NO: 4477 - DNA, 21 bp, Artificial Sequence
  Synthetic oligonucleotide
tgcaataattataagaacaag

SEQ ID NO: 4478 - DNA, 21 bp, Artificial Sequence
  Synthetic oligonucleotide
tggtatagaggctcttgtgcg

SEQ ID NO: 4479 - DNA, 21 bp, Artificial Sequence
  Synthetic oligonucleotide
aaggctactgttggattgatt

SEQ ID NO: 4480 - DNA, 21 bp, Artificial Sequence
  Synthetic oligonucleotide
cgcatggaagaaatagttgaa

SEQ ID NO: 4481 - DNA, 21 bp, Artificial Sequence
  Synthetic oligonucleotide
catggaagaaatagttgaagg

SEQ ID NO: 4482 - DNA, 21 bp, Artificial Sequence
  Synthetic oligonucleotide
ccattgaaaacatccaaagag

SEQ ID NO: 4483 - DNA, 21 bp, Artificial Sequence
  Synthetic oligonucleotide
ctgaggacaagccacaagatt

SEQ ID NO: 4484 - DNA, 21 bp, Artificial Sequence
  Synthetic oligonucleotide
ttgatactgacctgtaaatca

SEQ ID NO: 4485 - DNA, 21 bp, Artificial Sequence
  Synthetic oligonucleotide
ctttaggtaagaagttttaaa

SEQ ID NO: 4486 - DNA, 21 bp, Artificial Sequence
  Synthetic oligonucleotide
aacaggtatatactttgaaag

SEQ ID NO: 4487 - DNA, 21 bp, Artificial Sequence
  Synthetic oligonucleotide
tggaagttattaactttaatg

SEQ ID NO: 4488 - DNA, 21 bp, Artificial Sequence
  Synthetic oligonucleotide
tgccacagcttttgcaactta

SEQ ID NO: 4489 - DNA, 21 bp, Artificial Sequence
  Synthetic oligonucleotide
aacatttgctgttttaaacat

SEQ ID NO: 4490 - DNA, 21 bp, Artificial Sequence
  Synthetic oligonucleotide
aacaattgaagtaaacttttt

SEQ ID NO: 4491 - DNA, 21 bp, Artificial Sequence
  Synthetic oligonucleotide
aaaccctagccttgcttgtta

SEQ ID NO: 4492 - DNA, 21 bp, Artificial Sequence
  Synthetic oligonucleotide
tagccttgcttgttaaatttt

SEQ ID NO: 4493 - DNA, 21 bp, Artificial Sequence
  Synthetic oligonucleotide
ttgaagtagctcttttttttt

SEQ ID NO: 4494 - DNA, 21 bp, Artificial Sequence
  Synthetic oligonucleotide
tcgtagtgttaagttatagtg

SEQ ID NO: 4495 - DNA, 21 bp, Artificial Sequence
  Synthetic oligonucleotide
tagtgaatactgctacagcaa

SEQ ID NO: 4496 - DNA, 21 bp, Artificial Sequence
  Synthetic oligonucleotide
aatactgctacagcaatttct

SEQ ID NO: 4497 - DNA, 21 bp, Artificial Sequence
  Synthetic oligonucleotide
ttctaatttttaagaattgag

SEQ ID NO: 4498 - DNA, 21 bp, Artificial Sequence
  Synthetic oligonucleotide
atttttaagaattgagtaatg

SEQ ID NO: 4499 - DNA, 21 bp, Artificial Sequence
  Synthetic oligonucleotide
ttcataatcactctaattaat

SEQ ID NO: 4500 - DNA, 21 bp, Artificial Sequence
  Synthetic oligonucleotide
attaattgtaatctgaataaa

SEQ ID NO: 4501 - DNA, 21 bp, Artificial Sequence
  Synthetic oligonucleotide
ttgtaatctgaataaagtgta

SEQ ID NO: 4502 - DNA, 21 bp, Artificial Sequence
  Synthetic oligonucleotide
tctgaataaagtgtaacaatt

SEQ ID NO: 4503 - DNA, 21 bp, Artificial Sequence
  Synthetic oligonucleotide
gtgtagcctttttgtataaaa

SEQ ID NO: 4504 - DNA, 21 bp, Artificial Sequence
  Synthetic oligonucleotide
tttgtataaaatagacaaata

SEQ ID NO: 4505 - DNA, 21 bp, Artificial Sequence
  Synthetic oligonucleotide
agaaaatggtccaattagttt

SEQ ID NO: 4506 - DNA, 21 bp, Artificial Sequence
  Synthetic oligonucleotide
gtccaattagtttccttttta

SEQ ID NO: 4507 - DNA, 21 bp, Artificial Sequence
  Synthetic oligonucleotide
tttttgatcaaaaactatttg

SEQ ID NO: 4508 - DNA, 21 bp, Artificial Sequence
  Synthetic oligonucleotide
aagaggtgttatttggaacct

SEQ ID NO: 4509 - DNA, 21 bp, Artificial Sequence
  Synthetic oligonucleotide
gtgttatttggaaccttgttt

SEQ ID NO: 4510 - DNA, 21 bp, Artificial Sequence
  Synthetic oligonucleotide
gaaccttgttttggacagttt

SEQ ID NO: 4511 - DNA, 21 bp, Artificial Sequence
  Synthetic oligonucleotide
gtgatacgatgcttcaagaga

SEQ ID NO: 4512 - DNA, 21 bp, Artificial Sequence
  Synthetic oligonucleotide
ttcaagagaaaatgcggttat

SEQ ID NO: 4513 - DNA, 21 bp, Artificial Sequence
  Synthetic oligonucleotide
gagaaaatgcggttataaaaa

SEQ ID NO: 4514 - DNA, 21 bp, Artificial Sequence
  Synthetic oligonucleotide
cggttataaaaaatggttcag

SEQ ID NO: 4515 - DNA, 21 bp, Artificial Sequence
  Synthetic oligonucleotide
aaaaaatggttcagaattaaa

SEQ ID NO: 4516 - DNA, 21 bp, Artificial Sequence
  Synthetic oligonucleotide
cagcgtggacaatggctactc

SEQ ID NO: 4517 - DNA, 21 bp, Artificial Sequence
  Synthetic oligonucleotide
agcgtggacaatggctactca

SEQ ID NO: 4518 - DNA, 21 bp, Artificial Sequence
  Synthetic oligonucleotide
gcgtggacaatggctactcaa

SEQ ID NO: 4519 - DNA, 21 bp, Artificial Sequence
  Synthetic oligonucleotide
cgtggacaatggctactcaag

SEQ ID NO: 4520 - DNA, 21 bp, Artificial Sequence
  Synthetic oligonucleotide
gtggacaatggctactcaagc

SEQ ID NO: 4521 - DNA, 21 bp, Artificial Sequence
  Synthetic oligonucleotide
tggacaatggctactcaagct

SEQ ID NO: 4522 - DNA, 21 bp, Artificial Sequence
  Synthetic oligonucleotide
ggacaatggctactcaagctg

SEQ ID NO: 4523 - DNA, 21 bp, Artificial Sequence
  Synthetic oligonucleotide
gacaatggctactcaagctga

SEQ ID NO: 4524 - DNA, 21 bp, Artificial Sequence
  Synthetic oligonucleotide
tttgatggagttggacatggc

SEQ ID NO: 4525 - DNA, 21 bp, Artificial Sequence
  Synthetic oligonucleotide
ttgatggagttggacatggcc

SEQ ID NO: 4526 - DNA, 21 bp, Artificial Sequence
  Synthetic oligonucleotide
tgatggagttggacatggcca

SEQ ID NO: 4527 - DNA, 21 bp, Artificial Sequence
  Synthetic oligonucleotide
gatggagttggacatggccat

SEQ ID NO: 4528 - DNA, 21 bp, Artificial Sequence
  Synthetic oligonucleotide
atggagttggacatggccatg

SEQ ID NO: 4529 - DNA, 21 bp, Artificial Sequence
  Synthetic oligonucleotide
tggagttggacatggccatgg

SEQ ID NO: 4530 - DNA, 21 bp, Artificial Sequence
  Synthetic oligonucleotide
ggagttggacatggccatgga

SEQ ID NO: 4531 - DNA, 21 bp, Artificial Sequence
  Synthetic oligonucleotide
actctggaatccattctggtg

SEQ ID NO: 4532 - DNA, 21 bp, Artificial Sequence
  Synthetic oligonucleotide
ctctggaatccattctggtgc

SEQ ID NO: 4533 - DNA, 21 bp, Artificial Sequence
  Synthetic oligonucleotide
tctggaatccattctggtgcc

SEQ ID NO: 4534 - DNA, 21 bp, Artificial Sequence
  Synthetic oligonucleotide
ctggaatccattctggtgcca

SEQ ID NO: 4535 - DNA, 21 bp, Artificial Sequence
  Synthetic oligonucleotide
tggaatccattctggtgccac

SEQ ID NO: 4536 - DNA, 21 bp, Artificial Sequence
  Synthetic oligonucleotide
attagatgagggcatgcagat

SEQ ID NO: 4537 - DNA, 21 bp, Artificial Sequence
  Synthetic oligonucleotide
ttagatgagggcatgcagatc

SEQ ID NO: 4538 - DNA, 21 bp, Artificial Sequence
  Synthetic oligonucleotide
tagatgagggcatgcagatcc

SEQ ID NO: 4539 - DNA, 21 bp, Artificial Sequence
  Synthetic oligonucleotide
agatgagggcatgcagatccc

SEQ ID NO: 4540 - DNA, 21 bp, Artificial Sequence
  Synthetic oligonucleotide
gatgagggcatgcagatccca

SEQ ID NO: 4541 - DNA, 21 bp, Artificial Sequence
  Synthetic oligonucleotide
atgagggcatgcagatcccat

SEQ ID NO: 4542 - DNA, 21 bp, Artificial Sequence
  Synthetic oligonucleotide
atgctgctcatcccactaatg

SEQ ID NO: 4543 - DNA, 21 bp, Artificial Sequence
  Synthetic oligonucleotide
tgctgctcatcccactaatgt

SEQ ID NO: 4544 - DNA, 21 bp, Artificial Sequence
  Synthetic oligonucleotide
gctgctcatcccactaatgtc

SEQ ID NO: 4545 - DNA, 21 bp, Artificial Sequence
  Synthetic oligonucleotide
ctgctcatcccactaatgtcc

SEQ ID NO: 4546 - DNA, 21 bp, Artificial Sequence
  Synthetic oligonucleotide
tgctcatcccactaatgtcca

SEQ ID NO: 4547 - DNA, 21 bp, Artificial Sequence
  Synthetic oligonucleotide
gctcatcccactaatgtccag

SEQ ID NO: 4548 - DNA, 21 bp, Artificial Sequence
  Synthetic oligonucleotide
ctcatcccactaatgtccagc

SEQ ID NO: 4549 - DNA, 21 bp, Artificial Sequence
  Synthetic oligonucleotide
tcatcccactaatgtccagcg

SEQ ID NO: 4550 - DNA, 21 bp, Artificial Sequence
  Synthetic oligonucleotide
gtttggctgaaccatcacaga

SEQ ID NO: 4551 - DNA, 21 bp, Artificial Sequence
  Synthetic oligonucleotide
tttggctgaaccatcacagat

SEQ ID NO: 4552 - DNA, 21 bp, Artificial Sequence
  Synthetic oligonucleotide
ttggctgaaccatcacagatg

SEQ ID NO: 4553 - DNA, 21 bp, Artificial Sequence
  Synthetic oligonucleotide
cagaacttgccacacgtgcaa

SEQ ID NO: 4554 - DNA, 21 bp, Artificial Sequence
  Synthetic oligonucleotide
agaacttgccacacgtgcaat

SEQ ID NO: 4555 - DNA, 21 bp, Artificial Sequence
  Synthetic oligonucleotide
cagttatggtccatcagcttt

SEQ ID NO: 4556 - DNA, 21 bp, Artificial Sequence
  Synthetic oligonucleotide
agttatggtccatcagctttc

SEQ ID NO: 4557 - DNA, 21 bp, Artificial Sequence
  Synthetic oligonucleotide
ctaaaaaggaagcttccagac

SEQ ID NO: 4558 - DNA, 21 bp, Artificial Sequence
  Synthetic oligonucleotide
taaaaaggaagcttccagaca

SEQ ID NO: 4559 - DNA, 21 bp, Artificial Sequence
  Synthetic oligonucleotide
gtaccatgcagaatacaaatg

SEQ ID NO: 4560 - DNA, 21 bp, Artificial Sequence
  Synthetic oligonucleotide
taccatgcagaatacaaatga

SEQ ID NO: 4561 - DNA, 21 bp, Artificial Sequence
  Synthetic oligonucleotide
accatgcagaatacaaatgat

SEQ ID NO: 4562 - DNA, 21 bp, Artificial Sequence
  Synthetic oligonucleotide
ccatgcagaatacaaatgatg

SEQ ID NO: 4563 - DNA, 21 bp, Artificial Sequence
  Synthetic oligonucleotide
catgcagaatacaaatgatgt

SEQ ID NO: 4564 - DNA, 21 bp, Artificial Sequence
  Synthetic oligonucleotide
atgcagaatacaaatgatgta

SEQ ID NO: 4565 - DNA, 21 bp, Artificial Sequence
  Synthetic oligonucleotide
tgcagaatacaaatgatgtag

SEQ ID NO: 4566 - DNA, 21 bp, Artificial Sequence
  Synthetic oligonucleotide
gcagaatacaaatgatgtaga

SEQ ID NO: 4567 - DNA, 21 bp, Artificial Sequence
  Synthetic oligonucleotide
tactggccatctttaagtctg

SEQ ID NO: 4568 - DNA, 21 bp, Artificial Sequence
  Synthetic oligonucleotide
actggccatctttaagtctgg

SEQ ID NO: 4569 - DNA, 21 bp, Artificial Sequence
  Synthetic oligonucleotide
aagaaggagctaaaatggcag

SEQ ID NO: 4570 - DNA, 21 bp, Artificial Sequence
  Synthetic oligonucleotide
agaaggagctaaaatggcagt

SEQ ID NO: 4571 - DNA, 21 bp, Artificial Sequence
  Synthetic oligonucleotide
gaaggagctaaaatggcagtg

SEQ ID NO: 4572 - DNA, 21 bp, Artificial Sequence
  Synthetic oligonucleotide
aaggagctaaaatggcagtgc

SEQ ID NO: 4573 - DNA, 21 bp, Artificial Sequence
  Synthetic oligonucleotide
aggagctaaaatggcagtgcg

SEQ ID NO: 4574 - DNA, 21 bp, Artificial Sequence
  Synthetic oligonucleotide
tactgtggaccacaagcagag

SEQ ID NO: 4575 - DNA, 21 bp, Artificial Sequence
  Synthetic oligonucleotide
actgtggaccacaagcagagt

SEQ ID NO: 4576 - DNA, 21 bp, Artificial Sequence
  Synthetic oligonucleotide
ctgtggaccacaagcagagtg

SEQ ID NO: 4577 - DNA, 21 bp, Artificial Sequence
  Synthetic oligonucleotide
tgtggaccacaagcagagtgc

SEQ ID NO: 4578 - DNA, 21 bp, Artificial Sequence
  Synthetic oligonucleotide
gtggaccacaagcagagtgct

SEQ ID NO: 4579 - DNA, 21 bp, Artificial Sequence
  Synthetic oligonucleotide
tggaccacaagcagagtgctg

SEQ ID NO: 4580 - DNA, 21 bp, Artificial Sequence
  Synthetic oligonucleotide
ggaccacaagcagagtgctga

SEQ ID NO: 4581 - DNA, 21 bp, Artificial Sequence
  Synthetic oligonucleotide
gaccacaagcagagtgctgaa

SEQ ID NO: 4582 - DNA, 21 bp, Artificial Sequence
  Synthetic oligonucleotide
accacaagcagagtgctgaag

SEQ ID NO: 4583 - DNA, 21 bp, Artificial Sequence
  Synthetic oligonucleotide
ccacaagcagagtgctgaagg

SEQ ID NO: 4584 - DNA, 21 bp, Artificial Sequence
  Synthetic oligonucleotide
cacaagcagagtgctgaaggt

SEQ ID NO: 4585 - DNA, 21 bp, Artificial Sequence
  Synthetic oligonucleotide
acaagcagagtgctgaaggtg

SEQ ID NO: 4586 - DNA, 21 bp, Artificial Sequence
  Synthetic oligonucleotide
caagcagagtgctgaaggtgc

SEQ ID NO: 4587 - DNA, 21 bp, Artificial Sequence
  Synthetic oligonucleotide
aagcagagtgctgaaggtgct

SEQ ID NO: 4588 - DNA, 21 bp, Artificial Sequence
  Synthetic oligonucleotide
agaactgtctttggactctca

SEQ ID NO: 4589 - DNA, 21 bp, Artificial Sequence
  Synthetic oligonucleotide
gaactgtctttggactctcag

SEQ ID NO: 4590 - DNA, 21 bp, Artificial Sequence
  Synthetic oligonucleotide
cagatgatataaatgtggtca

SEQ ID NO: 4591 - DNA, 21 bp, Artificial Sequence
  Synthetic oligonucleotide
agatgatataaatgtggtcac

SEQ ID NO: 4592 - DNA, 21 bp, Artificial Sequence
  Synthetic oligonucleotide
gatgatataaatgtggtcacc

SEQ ID NO: 4593 - DNA, 21 bp, Artificial Sequence
  Synthetic oligonucleotide
atgatataaatgtggtcacct

SEQ ID NO: 4594 - DNA, 21 bp, Artificial Sequence
  Synthetic oligonucleotide
tgatataaatgtggtcacctg

SEQ ID NO: 4595 - DNA, 21 bp, Artificial Sequence
  Synthetic oligonucleotide
gatataaatgtggtcacctgt

SEQ ID NO: 4596 - DNA, 21 bp, Artificial Sequence
  Synthetic oligonucleotide
atataaatgtggtcacctgtg

SEQ ID NO: 4597 - DNA, 21 bp, Artificial Sequence
  Synthetic oligonucleotide
tataaatgtggtcacctgtgc

SEQ ID NO: 4598 - DNA, 21 bp, Artificial Sequence
  Synthetic oligonucleotide
ataaatgtggtcacctgtgca

SEQ ID NO: 4599 - DNA, 21 bp, Artificial Sequence
  Synthetic oligonucleotide
taaatgtggtcacctgtgcag

SEQ ID NO: 4600 - DNA, 21 bp, Artificial Sequence
  Synthetic oligonucleotide
aaatgtggtcacctgtgcagc

SEQ ID NO: 4601 - DNA, 21 bp, Artificial Sequence
  Synthetic oligonucleotide
aatgtggtcacctgtgcagct

SEQ ID NO: 4602 - DNA, 21 bp, Artificial Sequence
  Synthetic oligonucleotide
atgtggtcacctgtgcagctg

SEQ ID NO: 4603 - DNA, 21 bp, Artificial Sequence
  Synthetic oligonucleotide
tgtggtcacctgtgcagctgg

SEQ ID NO: 4604 - DNA, 21 bp, Artificial Sequence
  Synthetic oligonucleotide
gtggtcacctgtgcagctgga

SEQ ID NO: 4605 - DNA, 21 bp, Artificial Sequence
  Synthetic oligonucleotide
tggtcacctgtgcagctggaa

SEQ ID NO: 4606 - DNA, 21 bp, Artificial Sequence
  Synthetic oligonucleotide
ggtcacctgtgcagctggaat

SEQ ID NO: 4607 - DNA, 21 bp, Artificial Sequence
  Synthetic oligonucleotide
gtcacctgtgcagctggaatt

SEQ ID NO: 4608 - DNA, 21 bp, Artificial Sequence
  Synthetic oligonucleotide
tcacctgtgcagctggaattc

SEQ ID NO: 4609 - DNA, 21 bp, Artificial Sequence
  Synthetic oligonucleotide
cacctgtgcagctggaattct

SEQ ID NO: 4610 - DNA, 21 bp, Artificial Sequence
  Synthetic oligonucleotide
tttctaacctcacttgcaata

SEQ ID NO: 4611 - DNA, 21 bp, Artificial Sequence
  Synthetic oligonucleotide
ttctaacctcacttgcaataa

SEQ ID NO: 4612 - DNA, 21 bp, Artificial Sequence
  Synthetic oligonucleotide
tctaacctcacttgcaataat

SEQ ID NO: 4613 - DNA, 21 bp, Artificial Sequence
  Synthetic oligonucleotide
ctaacctcacttgcaataatt

SEQ ID NO: 4614 - DNA, 21 bp, Artificial Sequence
  Synthetic oligonucleotide
taacctcacttgcaataatta

SEQ ID NO: 4615 - DNA, 21 bp, Artificial Sequence
  Synthetic oligonucleotide
gggctggtgacagggaagaca

SEQ ID NO: 4616 - DNA, 21 bp, Artificial Sequence
  Synthetic oligonucleotide
ggctggtgacagggaagacat

SEQ ID NO: 4617 - DNA, 21 bp, Artificial Sequence
  Synthetic oligonucleotide
gctggtgacagggaagacatc

SEQ ID NO: 4618 - DNA, 21 bp, Artificial Sequence
  Synthetic oligonucleotide
ctggtgacagggaagacatca

SEQ ID NO: 4619 - DNA, 21 bp, Artificial Sequence
  Synthetic oligonucleotide
tggtgacagggaagacatcac

SEQ ID NO: 4620 - DNA, 21 bp, Artificial Sequence
  Synthetic oligonucleotide
ggtgacagggaagacatcact

SEQ ID NO: 4621 - DNA, 21 bp, Artificial Sequence
  Synthetic oligonucleotide
gtgacagggaagacatcactg

SEQ ID NO: 4622 - DNA, 21 bp, Artificial Sequence
  Synthetic oligonucleotide
tgacagggaagacatcactga

SEQ ID NO: 4623 - DNA, 21 bp, Artificial Sequence
  Synthetic oligonucleotide
gacagggaagacatcactgag

SEQ ID NO: 4624 - DNA, 21 bp, Artificial Sequence
  Synthetic oligonucleotide
acagggaagacatcactgagc

SEQ ID NO: 4625 - DNA, 21 bp, Artificial Sequence
  Synthetic oligonucleotide
cagggaagacatcactgagcc

SEQ ID NO: 4626 - DNA, 21 bp, Artificial Sequence
  Synthetic oligonucleotide
agggaagacatcactgagcct

SEQ ID NO: 4627 - DNA, 21 bp, Artificial Sequence
  Synthetic oligonucleotide
gggaagacatcactgagcctg

SEQ ID NO: 4628 - DNA, 21 bp, Artificial Sequence
  Synthetic oligonucleotide
ggaagacatcactgagcctgc

SEQ ID NO: 4629 - DNA, 21 bp, Artificial Sequence
  Synthetic oligonucleotide
gaagacatcactgagcctgcc

SEQ ID NO: 4630 - DNA, 21 bp, Artificial Sequence
  Synthetic oligonucleotide
aagacatcactgagcctgcca

SEQ ID NO: 4631 - DNA, 21 bp, Artificial Sequence
  Synthetic oligonucleotide
agacatcactgagcctgccat

SEQ ID NO: 4632 - DNA, 21 bp, Artificial Sequence
  Synthetic oligonucleotide
gacatcactgagcctgccatc

SEQ ID NO: 4633 - DNA, 21 bp, Artificial Sequence
  Synthetic oligonucleotide
acatcactgagcctgccatct

SEQ ID NO: 4634 - DNA, 21 bp, Artificial Sequence
  Synthetic oligonucleotide
catcactgagcctgccatctg

SEQ ID NO: 4635 - DNA, 21 bp, Artificial Sequence
  Synthetic oligonucleotide
atcactgagcctgccatctgt

SEQ ID NO: 4636 - DNA, 21 bp, Artificial Sequence
  Synthetic oligonucleotide
tcactgagcctgccatctgtg

SEQ ID NO: 4637 - DNA, 21 bp, Artificial Sequence
  Synthetic oligonucleotide
cactgagcctgccatctgtgc

SEQ ID NO: 4638 - DNA, 21 bp, Artificial Sequence
  Synthetic oligonucleotide
actgagcctgccatctgtgct

SEQ ID NO: 4639 - DNA, 21 bp, Artificial Sequence
  Synthetic oligonucleotide
ctgagcctgccatctgtgctc

SEQ ID NO: 4640 - DNA, 21 bp, Artificial Sequence
  Synthetic oligonucleotide
tgagcctgccatctgtgctct

SEQ ID NO: 4641 - DNA, 21 bp, Artificial Sequence
  Synthetic oligonucleotide
gagcctgccatctgtgctctt

SEQ ID NO: 4642 - DNA, 21 bp, Artificial Sequence
  Synthetic oligonucleotide
agcctgccatctgtgctcttc

SEQ ID NO: 4643 - DNA, 21 bp, Artificial Sequence
  Synthetic oligonucleotide
gcctgccatctgtgctcttcg

SEQ ID NO: 4644 - DNA, 21 bp, Artificial Sequence
  Synthetic oligonucleotide
cctgccatctgtgctcttcgt

SEQ ID NO: 4645 - DNA, 21 bp, Artificial Sequence
  Synthetic oligonucleotide
ctgccatctgtgctcttcgtc

SEQ ID NO: 4646 - DNA, 21 bp, Artificial Sequence
  Synthetic oligonucleotide
tgccatctgtgctcttcgtca

SEQ ID NO: 4647 - DNA, 21 bp, Artificial Sequence
  Synthetic oligonucleotide
gccatctgtgctcttcgtcat

SEQ ID NO: 4648 - DNA, 21 bp, Artificial Sequence
  Synthetic oligonucleotide
ccatctgtgctcttcgtcatc

SEQ ID NO: 4649 - DNA, 21 bp, Artificial Sequence
  Synthetic oligonucleotide
catctgtgctcttcgtcatct

SEQ ID NO: 4650 - DNA, 21 bp, Artificial Sequence
  Synthetic oligonucleotide
atctgtgctcttcgtcatctg

SEQ ID NO: 4651 - DNA, 21 bp, Artificial Sequence
  Synthetic oligonucleotide
tctgtgctcttcgtcatctga

SEQ ID NO: 4652 - DNA, 21 bp, Artificial Sequence
  Synthetic oligonucleotide
ctgtgctcttcgtcatctgac

SEQ ID NO: 4653 - DNA, 21 bp, Artificial Sequence
  Synthetic oligonucleotide
tgtgctcttcgtcatctgacc

SEQ ID NO: 4654 - DNA, 21 bp, Artificial Sequence
  Synthetic oligonucleotide
gtgctcttcgtcatctgacca

SEQ ID NO: 4655 - DNA, 21 bp, Artificial Sequence
  Synthetic oligonucleotide
tgctcttcgtcatctgaccag

SEQ ID NO: 4656 - DNA, 21 bp, Artificial Sequence
  Synthetic oligonucleotide
gctcttcgtcatctgaccagc

SEQ ID NO: 4657 - DNA, 21 bp, Artificial Sequence
  Synthetic oligonucleotide
ctcttcgtcatctgaccagcc

SEQ ID NO: 4658 - DNA, 21 bp, Artificial Sequence
  Synthetic oligonucleotide
tcttcgtcatctgaccagccg

SEQ ID NO: 4659 - DNA, 21 bp, Artificial Sequence
  Synthetic oligonucleotide
tacacccaccatcccactggc

SEQ ID NO: 4660 - DNA, 21 bp, Artificial Sequence
  Synthetic oligonucleotide
acacccaccatcccactggcc

SEQ ID NO: 4661 - DNA, 21 bp, Artificial Sequence
  Synthetic oligonucleotide
cacccaccatcccactggcct

SEQ ID NO: 4662 - DNA, 21 bp, Artificial Sequence
  Synthetic oligonucleotide
acccaccatcccactggcctc

SEQ ID NO: 4663 - DNA, 21 bp, Artificial Sequence
  Synthetic oligonucleotide
cccaccatcccactggcctct

SEQ ID NO: 4664 - DNA, 21 bp, Artificial Sequence
  Synthetic oligonucleotide
ccaccatcccactggcctctg

SEQ ID NO: 4665 - DNA, 21 bp, Artificial Sequence
  Synthetic oligonucleotide
caccatcccactggcctctga

SEQ ID NO: 4666 - DNA, 21 bp, Artificial Sequence
  Synthetic oligonucleotide
accatcccactggcctctgat

SEQ ID NO: 4667 - DNA, 21 bp, Artificial Sequence
  Synthetic oligonucleotide
ccatcccactggcctctgata

SEQ ID NO: 4668 - DNA, 21 bp, Artificial Sequence
  Synthetic oligonucleotide
catcccactggcctctgataa

SEQ ID NO: 4669 - DNA, 21 bp, Artificial Sequence
  Synthetic oligonucleotide
atcccactggcctctgataaa

SEQ ID NO: 4670 - DNA, 21 bp, Artificial Sequence
  Synthetic oligonucleotide
tcccactggcctctgataaag

SEQ ID NO: 4671 - DNA, 21 bp, Artificial Sequence
  Synthetic oligonucleotide
cccactggcctctgataaagg

SEQ ID NO: 4672 - DNA, 21 bp, Artificial Sequence
  Synthetic oligonucleotide
ccactggcctctgataaaggc

SEQ ID NO: 4673 - DNA, 21 bp, Artificial Sequence
  Synthetic oligonucleotide
ctactgttggattgattcgaa

SEQ ID NO: 4674 - DNA, 21 bp, Artificial Sequence
  Synthetic oligonucleotide
tactgttggattgattcgaaa

SEQ ID NO: 4675 - DNA, 21 bp, Artificial Sequence
  Synthetic oligonucleotide
taaataccattccattgtttg

SEQ ID NO: 4676 - DNA, 21 bp, Artificial Sequence
  Synthetic oligonucleotide
aaataccattccattgtttgt

SEQ ID NO: 4677 - DNA, 21 bp, Artificial Sequence
  Synthetic oligonucleotide
aataccattccattgtttgtg

SEQ ID NO: 4678 - DNA, 21 bp, Artificial Sequence
  Synthetic oligonucleotide
ataccattccattgtttgtgc

SEQ ID NO: 4679 - DNA, 21 bp, Artificial Sequence
  Synthetic oligonucleotide
taccattccattgtttgtgca

SEQ ID NO: 4680 - DNA, 21 bp, Artificial Sequence
  Synthetic oligonucleotide
accattccattgtttgtgcag

SEQ ID NO: 4681 - DNA, 21 bp, Artificial Sequence
  Synthetic oligonucleotide
gctgctttattctcccattga

SEQ ID NO: 4682 - DNA, 21 bp, Artificial Sequence
  Synthetic oligonucleotide
ctgctttattctcccattgaa

SEQ ID NO: 4683 - DNA, 21 bp, Artificial Sequence
  Synthetic oligonucleotide
tgctttattctcccattgaaa

SEQ ID NO: 4684 - DNA, 21 bp, Artificial Sequence
  Synthetic oligonucleotide
gctttattctcccattgaaaa

SEQ ID NO: 4685 - DNA, 21 bp, Artificial Sequence
  Synthetic oligonucleotide
gggtcctctgtgaacttgctc

SEQ ID NO: 4686 - DNA, 21 bp, Artificial Sequence
  Synthetic oligonucleotide
ggtcctctgtgaacttgctca

SEQ ID NO: 4687 - DNA, 21 bp, Artificial Sequence
  Synthetic oligonucleotide
gtcctctgtgaacttgctcag

SEQ ID NO: 4688 - DNA, 21 bp, Artificial Sequence
  Synthetic oligonucleotide
tcctctgtgaacttgctcagg

SEQ ID NO: 4689 - DNA, 21 bp, Artificial Sequence
  Synthetic oligonucleotide
cctctgtgaacttgctcagga

SEQ ID NO: 4690 - DNA, 21 bp, Artificial Sequence
  Synthetic oligonucleotide
ctctgtgaacttgctcaggac

SEQ ID NO: 4691 - DNA, 21 bp, Artificial Sequence
  Synthetic oligonucleotide
tctgtgaacttgctcaggaca

SEQ ID NO: 4692 - DNA, 21 bp, Artificial Sequence
  Synthetic oligonucleotide
ctgtgaacttgctcaggacaa

SEQ ID NO: 4693 - DNA, 21 bp, Artificial Sequence
  Synthetic oligonucleotide
tgtgaacttgctcaggacaag

SEQ ID NO: 4694 - DNA, 21 bp, Artificial Sequence
  Synthetic oligonucleotide
gtgaacttgctcaggacaagg

SEQ ID NO: 4695 - DNA, 21 bp, Artificial Sequence
  Synthetic oligonucleotide
tgaacttgctcaggacaagga

SEQ ID NO: 4696 - DNA, 21 bp, Artificial Sequence
  Synthetic oligonucleotide
ctattgaagctgagggagcca

SEQ ID NO: 4697 - DNA, 21 bp, Artificial Sequence
  Synthetic oligonucleotide
tattgaagctgagggagccac

SEQ ID NO: 4698 - DNA, 21 bp, Artificial Sequence
  Synthetic oligonucleotide
attgaagctgagggagccaca

SEQ ID NO: 4699 - DNA, 21 bp, Artificial Sequence
  Synthetic oligonucleotide
tgttccgaatgtctgaggaca

SEQ ID NO: 4700 - DNA, 21 bp, Artificial Sequence
  Synthetic oligonucleotide
gttccgaatgtctgaggacaa

SEQ ID NO: 4701 - DNA, 21 bp, Artificial Sequence
  Synthetic oligonucleotide
ttccgaatgtctgaggacaag

SEQ ID NO: 4702 - DNA, 21 bp, Artificial Sequence
  Synthetic oligonucleotide
tccgaatgtctgaggacaagc

SEQ ID NO: 4703 - DNA, 21 bp, Artificial Sequence
  Synthetic oligonucleotide
ccgaatgtctgaggacaagcc

SEQ ID NO: 4704 - DNA, 21 bp, Artificial Sequence
  Synthetic oligonucleotide
cgaatgtctgaggacaagcca

SEQ ID NO: 4705 - DNA, 21 bp, Artificial Sequence
  Synthetic oligonucleotide
gaatgtctgaggacaagccac

SEQ ID NO: 4706 - DNA, 21 bp, Artificial Sequence
  Synthetic oligonucleotide
aatgtctgaggacaagccaca

SEQ ID NO: 4707 - DNA, 21 bp, Artificial Sequence
  Synthetic oligonucleotide
gaacagagccaatggcttgga

SEQ ID NO: 4708 - DNA, 21 bp, Artificial Sequence
  Synthetic oligonucleotide
aacagagccaatggcttggaa

SEQ ID NO: 4709 - DNA, 21 bp, Artificial Sequence
  Synthetic oligonucleotide
acagagccaatggcttggaat

SEQ ID NO: 4710 - DNA, 21 bp, Artificial Sequence
  Synthetic oligonucleotide
cagagccaatggcttggaatg

SEQ ID NO: 4711 - DNA, 21 bp, Artificial Sequence
  Synthetic oligonucleotide
agagccaatggcttggaatga

SEQ ID NO: 4712 - DNA, 21 bp, Artificial Sequence
  Synthetic oligonucleotide
gagccaatggcttggaatgag

SEQ ID NO: 4713 - DNA, 21 bp, Artificial Sequence
  Synthetic oligonucleotide
agccaatggcttggaatgaga

SEQ ID NO: 4714 - DNA, 21 bp, Artificial Sequence
  Synthetic oligonucleotide
gccaatggcttggaatgagac

SEQ ID NO: 4715 - DNA, 21 bp, Artificial Sequence
  Synthetic oligonucleotide
ccaatggcttggaatgagact

SEQ ID NO: 4716 - DNA, 21 bp, Artificial Sequence
  Synthetic oligonucleotide
caatggcttggaatgagactg

SEQ ID NO: 4717 - DNA, 21 bp, Artificial Sequence
  Synthetic oligonucleotide
aatggcttggaatgagactgc

SEQ ID NO: 4718 - DNA, 21 bp, Artificial Sequence
  Synthetic oligonucleotide
cccttggatatcgccaggatg

SEQ ID NO: 4719 - DNA, 21 bp, Artificial Sequence
  Synthetic oligonucleotide
ccttggatatcgccaggatga

SEQ ID NO: 4720 - DNA, 21 bp, Artificial Sequence
  Synthetic oligonucleotide
cttggatatcgccaggatgat

SEQ ID NO: 4721 - DNA, 21 bp, Artificial Sequence
  Synthetic oligonucleotide
ttggatatcgccaggatgatc

SEQ ID NO: 4722 - DNA, 21 bp, Artificial Sequence
  Synthetic oligonucleotide
tggatatcgccaggatgatcc

SEQ ID NO: 4723 - DNA, 21 bp, Artificial Sequence
  Synthetic oligonucleotide
atcgttcttttcactctggtg

SEQ ID NO: 4724 - DNA, 21 bp, Artificial Sequence
  Synthetic oligonucleotide
tcgttcttttcactctggtgg

SEQ ID NO: 4725 - DNA, 21 bp, Artificial Sequence
  Synthetic oligonucleotide
cgttcttttcactctggtgga

SEQ ID NO: 4726 - DNA, 21 bp, Artificial Sequence
  Synthetic oligonucleotide
gttcttttcactctggtggat

SEQ ID NO: 4727 - DNA, 21 bp, Artificial Sequence
  Synthetic oligonucleotide
ttcttttcactctggtggata

SEQ ID NO: 4728 - DNA, 21 bp, Artificial Sequence
  Synthetic oligonucleotide
aacatgagatgggtggccacc

SEQ ID NO: 4729 - DNA, 21 bp, Artificial Sequence
  Synthetic oligonucleotide
acatgagatgggtggccacca

SEQ ID NO: 4730 - DNA, 21 bp, Artificial Sequence
  Synthetic oligonucleotide
catgagatgggtggccaccac

SEQ ID NO: 4731 - DNA, 21 bp, Artificial Sequence
  Synthetic oligonucleotide
atgagatgggtggccaccacc

SEQ ID NO: 4732 - DNA, 21 bp, Artificial Sequence
  Synthetic oligonucleotide
tgagatgggtggccaccaccc

SEQ ID NO: 4733 - DNA, 21 bp, Artificial Sequence
  Synthetic oligonucleotide
gagatgggtggccaccaccct

SEQ ID NO: 4734 - DNA, 21 bp, Artificial Sequence
  Synthetic oligonucleotide
agatgggtggccaccaccctg

SEQ ID NO: 4735 - DNA, 21 bp, Artificial Sequence
  Synthetic oligonucleotide
gatgggtggccaccaccctgg

SEQ ID NO: 4736 - DNA, 21 bp, Artificial Sequence
  Synthetic oligonucleotide
atgggtggccaccaccctggt

SEQ ID NO: 4737 - DNA, 21 bp, Artificial Sequence
  Synthetic oligonucleotide
tgggtggccaccaccctggtg

SEQ ID NO: 4738 - DNA, 21 bp, Artificial Sequence
  Synthetic oligonucleotide
gggtggccaccaccctggtgc

SEQ ID NO: 4739 - DNA, 21 bp, Artificial Sequence
  Synthetic oligonucleotide
ggtggccaccaccctggtgct

SEQ ID NO: 4740 - DNA, 21 bp, Artificial Sequence
  Synthetic oligonucleotide
gtggccaccaccctggtgctg

SEQ ID NO: 4741 - DNA, 21 bp, Artificial Sequence
  Synthetic oligonucleotide
tggccaccaccctggtgctga

SEQ ID NO: 4742 - DNA, 21 bp, Artificial Sequence
  Synthetic oligonucleotide
ggccaccaccctggtgctgac

SEQ ID NO: 4743 - DNA, 21 bp, Artificial Sequence
  Synthetic oligonucleotide
gccaccaccctggtgctgact

SEQ ID NO: 4744 - DNA, 21 bp, Artificial Sequence
  Synthetic oligonucleotide
ccaccaccctggtgctgacta

SEQ ID NO: 4745 - DNA, 21 bp, Artificial Sequence
  Synthetic oligonucleotide
caccaccctggtgctgactat

SEQ ID NO: 4746 - DNA, 21 bp, Artificial Sequence
  Synthetic oligonucleotide
accaccctggtgctgactatc

SEQ ID NO: 4747 - DNA, 21 bp, Artificial Sequence
  Synthetic oligonucleotide
ccaccctggtgctgactatcc

SEQ ID NO: 4748 - DNA, 21 bp, Artificial Sequence
  Synthetic oligonucleotide
caccctggtgctgactatcca

SEQ ID NO: 4749 - DNA, 21 bp, Artificial Sequence
  Synthetic oligonucleotide
accctggtgctgactatccag

SEQ ID NO: 4750 - DNA, 21 bp, Artificial Sequence
  Synthetic oligonucleotide
ccctggtgctgactatccagt

SEQ ID NO: 4751 - DNA, 21 bp, Artificial Sequence
  Synthetic oligonucleotide
cctggtgctgactatccagtt

SEQ ID NO: 4752 - DNA, 21 bp, Artificial Sequence
  Synthetic oligonucleotide
ctggtgctgactatccagttg

SEQ ID NO: 4753 - DNA, 21 bp, Artificial Sequence
  Synthetic oligonucleotide
tggtgctgactatccagttga

SEQ ID NO: 4754 - DNA, 21 bp, Artificial Sequence
  Synthetic oligonucleotide
ggtgctgactatccagttgat

SEQ ID NO: 4755 - DNA, 21 bp, Artificial Sequence
  Synthetic oligonucleotide
gtgctgactatccagttgatg

SEQ ID NO: 4756 - DNA, 21 bp, Artificial Sequence
  Synthetic oligonucleotide
tgctgactatccagttgatgg

SEQ ID NO: 4757 - DNA, 21 bp, Artificial Sequence
  Synthetic oligonucleotide
gctgactatccagttgatggg

SEQ ID NO: 4758 - DNA, 21 bp, Artificial Sequence
  Synthetic oligonucleotide
ctgactatccagttgatgggc

SEQ ID NO: 4759 - DNA, 21 bp, Artificial Sequence
  Synthetic oligonucleotide
tgactatccagttgatgggct

SEQ ID NO: 4760 - DNA, 21 bp, Artificial Sequence
  Synthetic oligonucleotide
gactatccagttgatgggctg

SEQ ID NO: 4761 - DNA, 21 bp, Artificial Sequence
  Synthetic oligonucleotide
actatccagttgatgggctgc

SEQ ID NO: 4762 - DNA, 21 bp, Artificial Sequence
  Synthetic oligonucleotide
ctatccagttgatgggctgcc

SEQ ID NO: 4763 - DNA, 21 bp, Artificial Sequence
  Synthetic oligonucleotide
atgcccaggacctcatggatg

SEQ ID NO: 4764 - DNA, 21 bp, Artificial Sequence
  Synthetic oligonucleotide
tgcccaggacctcatggatgg

SEQ ID NO: 4765 - DNA, 21 bp, Artificial Sequence
  Synthetic oligonucleotide
gcccaggacctcatggatggg

SEQ ID NO: 4766 - DNA, 21 bp, Artificial Sequence
  Synthetic oligonucleotide
acagcaatcagctggcctggt

SEQ ID NO: 4767 - DNA, 21 bp, Artificial Sequence
  Synthetic oligonucleotide
cagcaatcagctggcctggtt

SEQ ID NO: 4768 - DNA, 21 bp, Artificial Sequence
  Synthetic oligonucleotide
agcaatcagctggcctggttt

SEQ ID NO: 4769 - DNA, 21 bp, Artificial Sequence
  Synthetic oligonucleotide
gcaatcagctggcctggtttg

SEQ ID NO: 4770 - DNA, 21 bp, Artificial Sequence
  Synthetic oligonucleotide
caatcagctggcctggtttga

SEQ ID NO: 4771 - DNA, 21 bp, Artificial Sequence
  Synthetic oligonucleotide
aatcagctggcctggtttgat

SEQ ID NO: 4772 - DNA, 21 bp, Artificial Sequence
  Synthetic oligonucleotide
atcagctggcctggtttgata

SEQ ID NO: 4773 - DNA, 21 bp, Artificial Sequence
  Synthetic oligonucleotide
tcagctggcctggtttgatac

SEQ ID NO: 4774 - DNA, 21 bp, Artificial Sequence
  Synthetic oligonucleotide
cagctggcctggtttgatact

SEQ ID NO: 4775 - DNA, 21 bp, Artificial Sequence
  Synthetic oligonucleotide
agctggcctggtttgatactg

SEQ ID NO: 4776 - DNA, 21 bp, Artificial Sequence
  Synthetic oligonucleotide
gctggcctggtttgatactga

SEQ ID NO: 4777 - DNA, 21 bp, Artificial Sequence
  Synthetic oligonucleotide
ctggcctggtttgatactgac

SEQ ID NO: 4778 - DNA, 21 bp, Artificial Sequence
  Synthetic oligonucleotide
tggcctggtttgatactgacc

SEQ ID NO: 4779 - DNA, 21 bp, Artificial Sequence
  Synthetic oligonucleotide
ggcctggtttgatactgacct

SEQ ID NO: 4780 - DNA, 21 bp, Artificial Sequence
  Synthetic oligonucleotide
gcctggtttgatactgacctg

SEQ ID NO: 4781 - DNA, 21 bp, Artificial Sequence
  Synthetic oligonucleotide
cctggtttgatactgacctgt

SEQ ID NO: 4782 - DNA, 21 bp, Artificial Sequence
  Synthetic oligonucleotide
ctggtttgatactgacctgta

SEQ ID NO: 4783 - DNA, 21 bp, Artificial Sequence
  Synthetic oligonucleotide
tggtttgatactgacctgtaa

SEQ ID NO: 4784 - DNA, 21 bp, Artificial Sequence
  Synthetic oligonucleotide
ggtttgatactgacctgtaaa

SEQ ID NO: 4785 - DNA, 21 bp, Artificial Sequence
  Synthetic oligonucleotide
gtttgatactgacctgtaaat

SEQ ID NO: 4786 - DNA, 21 bp, Artificial Sequence
  Synthetic oligonucleotide
tttgatactgacctgtaaatc

SEQ ID NO: 4787 - DNA, 21 bp, Artificial Sequence
  Synthetic oligonucleotide
ttttttgccacagcttttgca

SEQ ID NO: 4788 - DNA, 21 bp, Artificial Sequence
  Synthetic oligonucleotide
aatgagtaacatttgctgttt

SEQ ID NO: 4789 - DNA, 21 bp, Artificial Sequence
  Synthetic oligonucleotide
taaacattaatagcagccttt

SEQ ID NO: 4790 - DNA, 21 bp, Artificial Sequence
  Synthetic oligonucleotide
aacattaatagcagcctttct

SEQ ID NO: 4791 - DNA, 21 bp, Artificial Sequence
  Synthetic oligonucleotide
cattaatagcagcctttctct

SEQ ID NO: 4792 - DNA, 21 bp, Artificial Sequence
  Synthetic oligonucleotide
ttaatagcagcctttctctct

SEQ ID NO: 4793 - DNA, 21 bp, Artificial Sequence
  Synthetic oligonucleotide
ttgcattgtgattggcctgta

SEQ ID NO: 4794 - DNA, 21 bp, Artificial Sequence
  Synthetic oligonucleotide
gcattgtgattggcctgtaga

SEQ ID NO: 4795 - DNA, 21 bp, Artificial Sequence
  Synthetic oligonucleotide
attgtgattggcctgtagagt

SEQ ID NO: 4796 - DNA, 21 bp, Artificial Sequence
  Synthetic oligonucleotide
tgtgattggcctgtagagttg

SEQ ID NO: 4797 - DNA, 21 bp, Artificial Sequence
  Synthetic oligonucleotide
tgattggcctgtagagttgct

SEQ ID NO: 4798 - DNA, 21 bp, Artificial Sequence
  Synthetic oligonucleotide
attggcctgtagagttgctga

SEQ ID NO: 4799 - DNA, 21 bp, Artificial Sequence
  Synthetic oligonucleotide
tggcctgtagagttgctgaga

SEQ ID NO: 4800 - DNA, 21 bp, Artificial Sequence
  Synthetic oligonucleotide
gcctgtagagttgctgagagg

SEQ ID NO: 4801 - DNA, 21 bp, Artificial Sequence
  Synthetic oligonucleotide
ctgtagagttgctgagagggc

SEQ ID NO: 4802 - DNA, 21 bp, Artificial Sequence
  Synthetic oligonucleotide
gggtgggctggtatctcagaa

SEQ ID NO: 4803 - DNA, 21 bp, Artificial Sequence
  Synthetic oligonucleotide
gtgggctggtatctcagaaag

SEQ ID NO: 4804 - DNA, 21 bp, Artificial Sequence
  Synthetic oligonucleotide
gggctggtatctcagaaagtg

SEQ ID NO: 4805 - DNA, 21 bp, Artificial Sequence
  Synthetic oligonucleotide
gctggtatctcagaaagtgcc

SEQ ID NO: 4806 - DNA, 21 bp, Artificial Sequence
  Synthetic oligonucleotide
acactaaccaagctgagtttc

SEQ ID NO: 4807 - DNA, 21 bp, Artificial Sequence
  Synthetic oligonucleotide
actaaccaagctgagtttcct

SEQ ID NO: 4808 - DNA, 21 bp, Artificial Sequence
  Synthetic oligonucleotide
taaccaagctgagtttcctat

SEQ ID NO: 4809 - DNA, 21 bp, Artificial Sequence
  Synthetic oligonucleotide
accaagctgagtttcctatgg

SEQ ID NO: 4810 - DNA, 21 bp, Artificial Sequence
  Synthetic oligonucleotide
caagctgagtttcctatggga

SEQ ID NO: 4811 - DNA, 21 bp, Artificial Sequence
  Synthetic oligonucleotide
agctgagtttcctatgggaac

SEQ ID NO: 4812 - DNA, 21 bp, Artificial Sequence
  Synthetic oligonucleotide
aactttttgttctggtccttt

SEQ ID NO: 4813 - DNA, 21 bp, Artificial Sequence
  Synthetic oligonucleotide
ctttttgttctggtccttttt

SEQ ID NO: 4814 - DNA, 21 bp, Artificial Sequence
  Synthetic oligonucleotide
ttttgttctggtcctttttgg

SEQ ID NO: 4815 - DNA, 21 bp, Artificial Sequence
  Synthetic oligonucleotide
ttgttctggtcctttttggtc

SEQ ID NO: 4816 - DNA, 21 bp, Artificial Sequence
  Synthetic oligonucleotide
gttctggtcctttttggtcga

SEQ ID NO: 4817 - DNA, 21 bp, Artificial Sequence
  Synthetic oligonucleotide
tctggtcctttttggtcgagg

SEQ ID NO: 4818 - DNA, 21 bp, Artificial Sequence
  Synthetic oligonucleotide
tggtcctttttggtcgaggag

SEQ ID NO: 4819 - DNA, 21 bp, Artificial Sequence
  Synthetic oligonucleotide
gtcctttttggtcgaggagta

SEQ ID NO: 4820 - DNA, 21 bp, Artificial Sequence
  Synthetic oligonucleotide
cctttttggtcgaggagtaac

SEQ ID NO: 4821 - DNA, 21 bp, Artificial Sequence
  Synthetic oligonucleotide
tttttggtcgaggagtaacaa

SEQ ID NO: 4822 - DNA, 21 bp, Artificial Sequence
  Synthetic oligonucleotide
tttggtcgaggagtaacaata

SEQ ID NO: 4823 - DNA, 21 bp, Artificial Sequence
  Synthetic oligonucleotide
tggtcgaggagtaacaataca

SEQ ID NO: 4824 - DNA, 21 bp, Artificial Sequence
  Synthetic oligonucleotide
gtcgaggagtaacaatacaaa

SEQ ID NO: 4825 - DNA, 21 bp, Artificial Sequence
  Synthetic oligonucleotide
cgaggagtaacaatacaaatg

SEQ ID NO: 4826 - DNA, 21 bp, Artificial Sequence
  Synthetic oligonucleotide
aggagtaacaatacaaatgga

SEQ ID NO: 4827 - DNA, 21 bp, Artificial Sequence
  Synthetic oligonucleotide
tttatcaaaccctagccttgc

SEQ ID NO: 4828 - DNA, 21 bp, Artificial Sequence
  Synthetic oligonucleotide
tatcaaaccctagccttgctt

SEQ ID NO: 4829 - DNA, 21 bp, Artificial Sequence
  Synthetic oligonucleotide
tcaaaccctagccttgcttgt

SEQ ID NO: 4830 - DNA, 21 bp, Artificial Sequence
  Synthetic oligonucleotide
ttgagtaatggtgtagaacac

SEQ ID NO: 4831 - DNA, 21 bp, Artificial Sequence
  Synthetic oligonucleotide
gagtaatggtgtagaacacta

SEQ ID NO: 4832 - DNA, 21 bp, Artificial Sequence
  Synthetic oligonucleotide
gtaatggtgtagaacactaat

SEQ ID NO: 4833 - DNA, 21 bp, Artificial Sequence
  Synthetic oligonucleotide
aatggtgtagaacactaattc

SEQ ID NO: 4834 - DNA, 21 bp, Artificial Sequence
  Synthetic oligonucleotide
tggtgtagaacactaattcat

SEQ ID NO: 4835 - DNA, 21 bp, Artificial Sequence
  Synthetic oligonucleotide
gtgtagaacactaattcataa

SEQ ID NO: 4836 - DNA, 21 bp, Artificial Sequence
  Synthetic oligonucleotide
gtagaacactaattcataatc

SEQ ID NO: 4837 - DNA, 21 bp, Artificial Sequence
  Synthetic oligonucleotide
agaacactaattcataatcac

SEQ ID NO: 4838 - DNA, 21 bp, Artificial Sequence
  Synthetic oligonucleotide
aattagtttcctttttaatat

SEQ ID NO: 4839 - DNA, 21 bp, Artificial Sequence
  Synthetic oligonucleotide
ttagtttcctttttaatatgc

SEQ ID NO: 4840 - DNA, 21 bp, Artificial Sequence
  Synthetic oligonucleotide
agtttcctttttaatatgctt

SEQ ID NO: 4841 - DNA, 21 bp, Artificial Sequence
  Synthetic oligonucleotide
tttcctttttaatatgcttaa

SEQ ID NO: 4842 - DNA, 21 bp, Artificial Sequence
  Synthetic oligonucleotide
tcctttttaatatgcttaaaa

SEQ ID NO: 4843 - DNA, 21 bp, Artificial Sequence
  Synthetic oligonucleotide
cctttttaatatgcttaaaat

SEQ ID NO: 4844 - DNA, 21 bp, Artificial Sequence
  Synthetic oligonucleotide
ctttttaatatgcttaaaata

SEQ ID NO: 4845 - DNA, 21 bp, Artificial Sequence
  Synthetic oligonucleotide
ttttaatatgcttaaaataag

SEQ ID NO: 4846 - DNA, 21 bp, Artificial Sequence
  Synthetic oligonucleotide
ttaatatgcttaaaataagca

SEQ ID NO: 4847 - DNA, 21 bp, Artificial Sequence
  Synthetic oligonucleotide
aatatgcttaaaataagcagg

SEQ ID NO: 4848 - DNA, 21 bp, Artificial Sequence
  Synthetic oligonucleotide
tatgcttaaaataagcaggtg

SEQ ID NO: 4849 - DNA, 21 bp, Artificial Sequence
  Synthetic oligonucleotide
tgcttaaaataagcaggtgga

SEQ ID NO: 4850 - DNA, 21 bp, Artificial Sequence
  Synthetic oligonucleotide
cttaaaataagcaggtggatc

SEQ ID NO: 4851 - DNA, 21 bp, Artificial Sequence
  Synthetic oligonucleotide
taaaataagcaggtggatcta

SEQ ID NO: 4852 - DNA, 21 bp, Artificial Sequence
  Synthetic oligonucleotide
aaataagcaggtggatctatt

SEQ ID NO: 4853 - DNA, 21 bp, Artificial Sequence
  Synthetic oligonucleotide
ataagcaggtggatctatttc

SEQ ID NO: 4854 - DNA, 21 bp, Artificial Sequence
  Synthetic oligonucleotide
aagcaggtggatctatttcat

SEQ ID NO: 4855 - DNA, 21 bp, Artificial Sequence
  Synthetic oligonucleotide
gcaggtggatctatttcatgt

SEQ ID NO: 4856 - DNA, 21 bp, Artificial Sequence
  Synthetic oligonucleotide
aggtggatctatttcatgttt

SEQ ID NO: 4857 - DNA, 21 bp, Artificial Sequence
  Synthetic oligonucleotide
gtggatctatttcatgttttt

SEQ ID NO: 4858 - DNA, 21 bp, Artificial Sequence
  Synthetic oligonucleotide
ggatctatttcatgtttttga

SEQ ID NO: 4859 - DNA, 21 bp, Artificial Sequence
  Synthetic oligonucleotide
gggtagggtaaatcagtaaga

SEQ ID NO: 4860 - DNA, 21 bp, Artificial Sequence
  Synthetic oligonucleotide
gtagggtaaatcagtaagagg

SEQ ID NO: 4861 - DNA, 21 bp, Artificial Sequence
  Synthetic oligonucleotide
agggtaaatcagtaagaggtg

SEQ ID NO: 4862 - DNA, 21 bp, Artificial Sequence
  Synthetic oligonucleotide
ggtaaatcagtaagaggtgtt

SEQ ID NO: 4863 - DNA, 21 bp, Artificial Sequence
  Synthetic oligonucleotide
taaatcagtaagaggtgttat

SEQ ID NO: 4864 - DNA, 21 bp, Artificial Sequence
  Synthetic oligonucleotide
aatcagtaagaggtgttattt

SEQ ID NO: 4865 - DNA, 21 bp, Artificial Sequence
  Synthetic oligonucleotide
tttaccagttgccttttatcc

SEQ ID NO: 4866 - DNA, 21 bp, Artificial Sequence
  Synthetic oligonucleotide
taccagttgccttttatccca

SEQ ID NO: 4867 - DNA, 21 bp, Artificial Sequence
  Synthetic oligonucleotide
ccagttgccttttatcccaaa

SEQ ID NO: 4868 - DNA, 21 bp, Artificial Sequence
  Synthetic oligonucleotide
agttgccttttatcccaaagt

SEQ ID NO: 4869 - DNA, 21 bp, Artificial Sequence
  Synthetic oligonucleotide
ttgccttttatcccaaagttg

SEQ ID NO: 4870 - DNA, 21 bp, Artificial Sequence
  Synthetic oligonucleotide
gccttttatcccaaagttgtt

SEQ ID NO: 4871 - DNA, 21 bp, Artificial Sequence
  Synthetic oligonucleotide
cttttatcccaaagttgttgt

SEQ ID NO: 4872 - DNA, 21 bp, Artificial Sequence
  Synthetic oligonucleotide
tttatcccaaagttgttgtaa

SEQ ID NO: 4873 - DNA, 21 bp, Artificial Sequence
  Synthetic oligonucleotide
tatcccaaagttgttgtaacc

SEQ ID NO: 4874 - DNA, 21 bp, Artificial Sequence
  Synthetic oligonucleotide
tcccaaagttgttgtaacctg

SEQ ID NO: 4875 - DNA, 21 bp, Artificial Sequence
  Synthetic oligonucleotide
ccaaagttgttgtaacctgct

SEQ ID NO: 4876 - DNA, 21 bp, Artificial Sequence
  Synthetic oligonucleotide
aaagttgttgtaacctgctgt

SEQ ID NO: 4877 - DNA, 21 bp, Artificial Sequence
  Synthetic oligonucleotide
agttgttgtaacctgctgtga

SEQ ID NO: 4878 - DNA, 21 bp, Artificial Sequence
  Synthetic oligonucleotide
ttgttgtaacctgctgtgata

SEQ ID NO: 4879 - DNA, 21 bp, Artificial Sequence
  Synthetic oligonucleotide
aaaaatggttcagaattaaac

SEQ ID NO: 4880 - DNA, 21 bp, Artificial Sequence
  Synthetic oligonucleotide
aaatggttcagaattaaactt

SEQ ID NO: 4881 - DNA, 21 bp, Artificial Sequence
  Synthetic oligonucleotide
atggttcagaattaaactttt

SEQ ID NO: 4882 - DNA, 21 bp, Artificial Sequence
  Synthetic oligonucleotide
ggttcagaattaaacttttaa

SEQ ID NO: 4883 - DNA, 21 bp, Artificial Sequence
  Synthetic oligonucleotide
ttcagaattaaacttttaatt

SEQ ID NO: 4884 - DNA, 21 bp, Artificial Sequence
  Synthetic oligonucleotide
cagcagcagtcttacttggat

SEQ ID NO: 4885 - DNA, 21 bp, Artificial Sequence
  Synthetic oligonucleotide
ttacttggattctggaatcca

SEQ ID NO: 4886 - DNA, 21 bp, Artificial Sequence
  Synthetic oligonucleotide
ttgacacctcccaagtccttt

SEQ ID NO: 4887 - DNA, 21 bp, Artificial Sequence
  Synthetic oligonucleotide
cacgcaagagcaagtagctga

SEQ ID NO: 4888 - DNA, 21 bp, Artificial Sequence
  Synthetic oligonucleotide
tgccatgttccctgagacgct

SEQ ID NO: 4889 - DNA, 21 bp, Artificial Sequence
  Synthetic oligonucleotide
gttgaaacatgcagttgtcaa

SEQ ID NO: 4890 - DNA, 21 bp, Artificial Sequence
  Synthetic oligonucleotide
aacatgcagttgtcaatttga

SEQ ID NO: 4891 - DNA, 21 bp, Artificial Sequence
  Synthetic oligonucleotide
cagttgtcaatttgattaact

SEQ ID NO: 4892 - DNA, 21 bp, Artificial Sequence
  Synthetic oligonucleotide
atgaggaccaggtggtagtta

SEQ ID NO: 4893 - DNA, 21 bp, Artificial Sequence
  Synthetic oligonucleotide
tgggtcaccagtggattctgt

SEQ ID NO: 4894 - DNA, 21 bp, Artificial Sequence
  Synthetic oligonucleotide
accagtggattctgtactgtt

SEQ ID NO: 4895 - DNA, 21 bp, Artificial Sequence
  Synthetic oligonucleotide
tggattctgtactgttctacg

SEQ ID NO: 4896 - DNA, 21 bp, Artificial Sequence
  Synthetic oligonucleotide
tggtggactgcagaaaatggt

SEQ ID NO: 4897 - DNA, 21 bp, Artificial Sequence
  Synthetic oligonucleotide
aacgtgaaattcttggctatt

SEQ ID NO: 4898 - DNA, 21 bp, Artificial Sequence
  Synthetic oligonucleotide
cccaagtcagcgacttgttca

SEQ ID NO: 4899 - DNA, 21 bp, Artificial Sequence
  Synthetic oligonucleotide
gcgacttgttcaaaactgtct

SEQ ID NO: 4900 - DNA, 21 bp, Artificial Sequence
  Synthetic oligonucleotide
caaaactgtctttggactctc

SEQ ID NO: 4901 - DNA, 21 bp, Artificial Sequence
  Synthetic oligonucleotide
ctctctaacctcacttgcaat

SEQ ID NO: 4902 - DNA, 21 bp, Artificial Sequence
  Synthetic oligonucleotide
acctcacttgcaataattaca

SEQ ID NO: 4903 - DNA, 21 bp, Artificial Sequence
  Synthetic oligonucleotide
cagaatgccgttcgccttcat

SEQ ID NO: 4904 - DNA, 21 bp, Artificial Sequence
  Synthetic oligonucleotide
tcgccttcattatggactgcc

SEQ ID NO: 4905 - DNA, 21 bp, Artificial Sequence
  Synthetic oligonucleotide
ttcattatggactgcctgttg

SEQ ID NO: 4906 - DNA, 21 bp, Artificial Sequence
  Synthetic oligonucleotide
tggactgcctgttgtggttaa

SEQ ID NO: 4907 - DNA, 21 bp, Artificial Sequence
  Synthetic oligonucleotide
gcaactgttggattgattcga

SEQ ID NO: 4908 - DNA, 21 bp, Artificial Sequence
  Synthetic oligonucleotide
ccgaggactcaataccattcc

SEQ ID NO: 4909 - DNA, 21 bp, Artificial Sequence
  Synthetic oligonucleotide
ctgaggacaagccacaggatt

SEQ ID NO: 4910 - DNA, 21 bp, Artificial Sequence
  Synthetic oligonucleotide
ggatggaccctatgatggagc

SEQ ID NO: 4911 - DNA, 21 bp, Artificial Sequence
  Synthetic oligonucleotide
ttgatactgacctgtaaatcg

SEQ ID NO: 4912 - DNA, 21 bp, Artificial Sequence
  Synthetic oligonucleotide
agccagtgtgggtgaatactt

SEQ ID NO: 4913 - DNA, 21 bp, Artificial Sequence
  Synthetic oligonucleotide
tgccacagcttttgcagcgtt

SEQ ID NO: 4914 - DNA, 21 bp, Artificial Sequence
  Synthetic oligonucleotide
gcttttgcagcgttatactca

SEQ ID NO: 4915 - DNA, 21 bp, Artificial Sequence
  Synthetic oligonucleotide
cagcgttatactcagatgagt

SEQ ID NO: 4916 - DNA, 21 bp, Artificial Sequence
  Synthetic oligonucleotide
acatttgctgttttcaacatt

SEQ ID NO: 4917 - DNA, 21 bp, Artificial Sequence
  Synthetic oligonucleotide
agctgtagtgtctgaacgtgc

SEQ ID NO: 4918 - DNA, 21 bp, Artificial Sequence
  Synthetic oligonucleotide
gggaacagtcgaagtacgctt

SEQ ID NO: 4919 - DNA, 21 bp, Artificial Sequence
  Synthetic oligonucleotide
cagtcgaagtacgctttttgt

SEQ ID NO: 4920 - DNA, 21 bp, Artificial Sequence
  Synthetic oligonucleotide
aagtacgctttttgttctggt

SEQ ID NO: 4921 - DNA, 21 bp, Artificial Sequence
  Synthetic oligonucleotide
accctagccttgcttgttctt

SEQ ID NO: 4922 - DNA, 21 bp, Artificial Sequence
  Synthetic oligonucleotide
agccttgcttgttctttgttt

SEQ ID NO: 4923 - DNA, 21 bp, Artificial Sequence
  Synthetic oligonucleotide
tgaacctgctacagcaatttc

SEQ ID NO: 4924 - DNA, 21 bp, Artificial Sequence
  Synthetic oligonucleotide
tacagcaatttctgatttcta

SEQ ID NO: 4925 - DNA, 21 bp, Artificial Sequence
  Synthetic oligonucleotide
cagtaagaggtgttatttgag

SEQ ID NO: 4926 - DNA, 21 bp, Artificial Sequence
  Synthetic oligonucleotide
gaggtgttatttgagccttgt

SEQ ID NO: 4927 - DNA, 21 bp, Artificial Sequence
  Synthetic oligonucleotide
gttatttgagccttgttttgg

SEQ ID NO: 4928 - DNA, 21 bp, Artificial Sequence
  Synthetic oligonucleotide
ttgagccttgttttggacagt

SEQ ID NO: 4929 - DNA, 21 bp, Artificial Sequence
  Synthetic oligonucleotide
ttcaacagatgcggttataga

SEQ ID NO: 4930 - DNA, 21 bp, Artificial Sequence
  Synthetic oligonucleotide
cggttatagaaatggttcaga

SEQ ID NO: 4931 - DNA, 21 bp, Artificial Sequence
  Synthetic oligonucleotide
atagaaatggttcagaattaa

SEQ ID NO: 4932 - DNA, 21 bp, Artificial Sequence
  Synthetic oligonucleotide
gttgtatggtatacttcaaat

SEQ ID NO: 4933 - DNA, 21 bp, Artificial Sequence
  Synthetic oligonucleotide
caaaacagttgtatggtatac

SEQ ID NO: 4934 - DNA, 21 bp, Artificial Sequence
  Synthetic oligonucleotide
tcaaaacagttgtatggtata

SEQ ID NO: 4935 - DNA, 21 bp, Artificial Sequence
  Synthetic oligonucleotide
tttcaaaacagttgtatggta

SEQ ID NO: 4936 - DNA, 21 bp, Artificial Sequence
  Synthetic oligonucleotide
ttttcaaaacagttgtatggt

SEQ ID NO: 4937 - DNA, 21 bp, Artificial Sequence
  Synthetic oligonucleotide
attttcaaaacagttgtatgg

SEQ ID NO: 4938 - DNA, 21 bp, Artificial Sequence
  Synthetic oligonucleotide
ttgtccacgctggattttcaa

SEQ ID NO: 4939 - DNA, 21 bp, Artificial Sequence
  Synthetic oligonucleotide
attgtccacgctggattttca

SEQ ID NO: 4940 - DNA, 21 bp, Artificial Sequence
  Synthetic oligonucleotide
ccatcaaatcagcttgagtag

SEQ ID NO: 4941 - DNA, 21 bp, Artificial Sequence
  Synthetic oligonucleotide
tgtccaactccatcaaatcag

SEQ ID NO: 4942 - DNA, 21 bp, Artificial Sequence
  Synthetic oligonucleotide
cttcctcaggattgcctttac

SEQ ID NO: 4943 - DNA, 21 bp, Artificial Sequence
  Synthetic oligonucleotide
tcttcctcaggattgccttta

SEQ ID NO: 4944 - DNA, 21 bp, Artificial Sequence
  Synthetic oligonucleotide
catcaatatcagctacttgtt

SEQ ID NO: 4945 - DNA, 21 bp, Artificial Sequence
  Synthetic oligonucleotide
ccatcaatatcagctacttgt

SEQ ID NO: 4946 - DNA, 21 bp, Artificial Sequence
  Synthetic oligonucleotide
actgtccatcaatatcagcta

SEQ ID NO: 4947 - DNA, 21 bp, Artificial Sequence
  Synthetic oligonucleotide
attgcatactgtccatcaata

SEQ ID NO: 4948 - DNA, 21 bp, Artificial Sequence
  Synthetic oligonucleotide
cgagtcattgcatactgtcca

SEQ ID NO: 4949 - DNA, 21 bp, Artificial Sequence
  Synthetic oligonucleotide
cctcatctaatgtctcaggga

SEQ ID NO: 4950 - DNA, 21 bp, Artificial Sequence
  Synthetic oligonucleotide
ttacaactgcatgtttcagca

SEQ ID NO: 4951 - DNA, 21 bp, Artificial Sequence
  Synthetic oligonucleotide
gtttacaactgcatgtttcag

SEQ ID NO: 4952 - DNA, 21 bp, Artificial Sequence
  Synthetic oligonucleotide
agttaatcaagtttacaactg

SEQ ID NO: 4953 - DNA, 21 bp, Artificial Sequence
  Synthetic oligonucleotide
cttgatagttaatcaagttta

SEQ ID NO: 4954 - DNA, 21 bp, Artificial Sequence
  Synthetic oligonucleotide
ctgcatcatcttgatagttaa

SEQ ID NO: 4955 - DNA, 21 bp, Artificial Sequence
  Synthetic oligonucleotide
tctgcatcatcttgatagtta

SEQ ID NO: 4956 - DNA, 21 bp, Artificial Sequence
  Synthetic oligonucleotide
ctggtcctcgtcatttagcag

SEQ ID NO: 4957 - DNA, 21 bp, Artificial Sequence
  Synthetic oligonucleotide
cataactgcagccttattaac

SEQ ID NO: 4958 - DNA, 21 bp, Artificial Sequence
  Synthetic oligonucleotide
ccataactgcagccttattaa

SEQ ID NO: 4959 - DNA, 21 bp, Artificial Sequence
  Synthetic oligonucleotide
ggaccataactgcagccttat

SEQ ID NO: 4960 - DNA, 21 bp, Artificial Sequence
  Synthetic oligonucleotide
cctttttagaaagctgatgga

SEQ ID NO: 4961 - DNA, 21 bp, Artificial Sequence
  Synthetic oligonucleotide
atggtacgtacaatagcagac

SEQ ID NO: 4962 - DNA, 21 bp, Artificial Sequence
  Synthetic oligonucleotide
catcatttgtattctgcatgg

SEQ ID NO: 4963 - DNA, 21 bp, Artificial Sequence
  Synthetic oligonucleotide
ctgtttctacatcatttgtat

SEQ ID NO: 4964 - DNA, 21 bp, Artificial Sequence
  Synthetic oligonucleotide
gctgtttctacatcatttgta

SEQ ID NO: 4965 - DNA, 21 bp, Artificial Sequence
  Synthetic oligonucleotide
gtacaacgagctgtttctaca

SEQ ID NO: 4966 - DNA, 21 bp, Artificial Sequence
  Synthetic oligonucleotide
cggtacaacgagctgtttcta

SEQ ID NO: 4967 - DNA, 21 bp, Artificial Sequence
  Synthetic oligonucleotide
gcggtacaacgagctgtttct

SEQ ID NO: 4968 - DNA, 21 bp, Artificial Sequence
  Synthetic oligonucleotide
gcataaaacaacacagaatcc

SEQ ID NO: 4969 - DNA, 21 bp, Artificial Sequence
  Synthetic oligonucleotide
tggcataaaacaacacagaat

SEQ ID NO: 4970 - DNA, 21 bp, Artificial Sequence
  Synthetic oligonucleotide
atggcataaaacaacacagaa

SEQ ID NO: 4971 - DNA, 21 bp, Artificial Sequence
  Synthetic oligonucleotide
tagctccttcttgatgtaata

SEQ ID NO: 4972 - DNA, 21 bp, Artificial Sequence
  Synthetic oligonucleotide
ttagctccttcttgatgtaat

SEQ ID NO: 4973 - DNA, 21 bp, Artificial Sequence
  Synthetic oligonucleotide
tttaacatttgttttgttgag

SEQ ID NO: 4974 - DNA, 21 bp, Artificial Sequence
  Synthetic oligonucleotide
tagccaagaatttaacatttg

SEQ ID NO: 4975 - DNA, 21 bp, Artificial Sequence
  Synthetic oligonucleotide
cgtaatagccaagaatttaac

SEQ ID NO: 4976 - DNA, 21 bp, Artificial Sequence
  Synthetic oligonucleotide
tcgtaatagccaagaatttaa

SEQ ID NO: 4977 - DNA, 21 bp, Artificial Sequence
  Synthetic oligonucleotide
taagctaaaatttgaaggcag

SEQ ID NO: 4978 - DNA, 21 bp, Artificial Sequence
  Synthetic oligonucleotide
taggtcctcattatatttact

SEQ ID NO: 4979 - DNA, 21 bp, Artificial Sequence
  Synthetic oligonucleotide
aagtataggtcctcattatat

SEQ ID NO: 4980 - DNA, 21 bp, Artificial Sequence
  Synthetic oligonucleotide
taagtataggtcctcattata

SEQ ID NO: 4981 - DNA, 21 bp, Artificial Sequence
  Synthetic oligonucleotide
gtttttcgtaagtataggtcc

SEQ ID NO: 4982 - DNA, 21 bp, Artificial Sequence
  Synthetic oligonucleotide
agtttttcgtaagtataggtc

SEQ ID NO: 4983 - DNA, 21 bp, Artificial Sequence
  Synthetic oligonucleotide
tagtttttcgtaagtataggt

SEQ ID NO: 4984 - DNA, 21 bp, Artificial Sequence
  Synthetic oligonucleotide
gtagtttttcgtaagtatagg

SEQ ID NO: 4985 - DNA, 21 bp, Artificial Sequence
  Synthetic oligonucleotide
gtggtccacagtagtttttcg

SEQ ID NO: 4986 - DNA, 21 bp, Artificial Sequence
  Synthetic oligonucleotide
tctacaatagccggcttatta

SEQ ID NO: 4987 - DNA, 21 bp, Artificial Sequence
  Synthetic oligonucleotide
cttctacaatagccggcttat

SEQ ID NO: 4988 - DNA, 21 bp, Artificial Sequence
  Synthetic oligonucleotide
agtcctaaagcttgcattcca

SEQ ID NO: 4989 - DNA, 21 bp, Artificial Sequence
  Synthetic oligonucleotide
aagtcctaaagcttgcattcc

SEQ ID NO: 4990 - DNA, 21 bp, Artificial Sequence
  Synthetic oligonucleotide
gaagtcctaaagcttgcattc

SEQ ID NO: 4991 - DNA, 21 bp, Artificial Sequence
  Synthetic oligonucleotide
cagttctgaacaagacgttga

SEQ ID NO: 4992 - DNA, 21 bp, Artificial Sequence
  Synthetic oligonucleotide
acagttctgaacaagacgttg

SEQ ID NO: 4993 - DNA, 21 bp, Artificial Sequence
  Synthetic oligonucleotide
gagtccaaagacagttctgaa

SEQ ID NO: 4994 - DNA, 21 bp, Artificial Sequence
  Synthetic oligonucleotide
ccttcctgtttagttgcagca

SEQ ID NO: 4995 - DNA, 21 bp, Artificial Sequence
  Synthetic oligonucleotide
ccacatttatatcatctgaac

SEQ ID NO: 4996 - DNA, 21 bp, Artificial Sequence
  Synthetic oligonucleotide
tgaccacatttatatcatctg

SEQ ID NO: 4997 - DNA, 21 bp, Artificial Sequence
  Synthetic oligonucleotide
ctgcacaggtgaccacattta

SEQ ID NO: 4998 - DNA, 21 bp, Artificial Sequence
  Synthetic oligonucleotide
gctgcacaggtgaccacattt

SEQ ID NO: 4999 - DNA, 21 bp, Artificial Sequence
  Synthetic oligonucleotide
attgcaagtgaggttagaaag

SEQ ID NO: 5000 - DNA, 21 bp, Artificial Sequence
  Synthetic oligonucleotide
ttataattattgcaagtgagg

SEQ ID NO: 5001 - DNA, 21 bp, Artificial Sequence
  Synthetic oligonucleotide
catcatcttgttcttataatt

SEQ ID NO: 5002 - DNA, 21 bp, Artificial Sequence
  Synthetic oligonucleotide
ccatcatcttgttcttataat

SEQ ID NO: 5003 - DNA, 21 bp, Artificial Sequence
  Synthetic oligonucleotide
agaccatcatcttgttcttat

SEQ ID NO: 5004 - DNA, 21 bp, Artificial Sequence
  Synthetic oligonucleotide
gcagaccatcatcttgttctt

SEQ ID NO: 5005 - DNA, 21 bp, Artificial Sequence
  Synthetic oligonucleotide
tcaatccaacagtagccttta

SEQ ID NO: 5006 - DNA, 21 bp, Artificial Sequence
  Synthetic oligonucleotide
tcgaatcaatccaacagtagc

SEQ ID NO: 5007 - DNA, 21 bp, Artificial Sequence
  Synthetic oligonucleotide
cctccacaaattgctgctgtg

SEQ ID NO: 5008 - DNA, 21 bp, Artificial Sequence
  Synthetic oligonucleotide
gtacaaccttcaactatttct

SEQ ID NO: 5009 - DNA, 21 bp, Artificial Sequence
  Synthetic oligonucleotide
ggtacaaccttcaactatttc

SEQ ID NO: 5010 - DNA, 21 bp, Artificial Sequence
  Synthetic oligonucleotide
cggtacaaccttcaactattt

SEQ ID NO: 5011 - DNA, 21 bp, Artificial Sequence
  Synthetic oligonucleotide
ccggtacaaccttcaactatt

SEQ ID NO: 5012 - DNA, 21 bp, Artificial Sequence
  Synthetic oligonucleotide
gggctccggtacaaccttcaa

SEQ ID NO: 5013 - DNA, 21 bp, Artificial Sequence
  Synthetic oligonucleotide
taacaattcggttgtgaacat

SEQ ID NO: 5014 - DNA, 21 bp, Artificial Sequence
  Synthetic oligonucleotide
ataacaattcggttgtgaaca

SEQ ID NO: 5015 - DNA, 21 bp, Artificial Sequence
  Synthetic oligonucleotide
gataacaattcggttgtgaac

SEQ ID NO: 5016 - DNA, 21 bp, Artificial Sequence
  Synthetic oligonucleotide
tgataacaattcggttgtgaa

SEQ ID NO: 5017 - DNA, 21 bp, Artificial Sequence
  Synthetic oligonucleotide
ctgataacaattcggttgtga

SEQ ID NO: 5018 - DNA, 21 bp, Artificial Sequence
  Synthetic oligonucleotide
tctgataacaattcggttgtg

SEQ ID NO: 5019 - DNA, 21 bp, Artificial Sequence
  Synthetic oligonucleotide
gtatttagtcctctgataaca

SEQ ID NO: 5020 - DNA, 21 bp, Artificial Sequence
  Synthetic oligonucleotide
ggtatttagtcctctgataac

SEQ ID NO: 5021 - DNA, 21 bp, Artificial Sequence
  Synthetic oligonucleotide
tggtatttagtcctctgataa

SEQ ID NO: 5022 - DNA, 21 bp, Artificial Sequence
  Synthetic oligonucleotide
atggtatttagtcctctgata

SEQ ID NO: 5023 - DNA, 21 bp, Artificial Sequence
  Synthetic oligonucleotide
aaacaatggaatggtatttag

SEQ ID NO: 5024 - DNA, 21 bp, Artificial Sequence
  Synthetic oligonucleotide
gcacaaacaatggaatggtat

SEQ ID NO: 5025 - DNA, 21 bp, Artificial Sequence
  Synthetic oligonucleotide
ctgcacaaacaatggaatggt

SEQ ID NO: 5026 - DNA, 21 bp, Artificial Sequence
  Synthetic oligonucleotide
gctgcacaaacaatggaatgg

SEQ ID NO: 5027 - DNA, 21 bp, Artificial Sequence
  Synthetic oligonucleotide
cagctactctttggatgtttt

SEQ ID NO: 5028 - DNA, 21 bp, Artificial Sequence
  Synthetic oligonucleotide
gcagctactctttggatgttt

SEQ ID NO: 5029 - DNA, 21 bp, Artificial Sequence
  Synthetic oligonucleotide
cagcttcaatagcttctgcag

SEQ ID NO: 5030 - DNA, 21 bp, Artificial Sequence
  Synthetic oligonucleotide
gctccctcagcttcaatagct

SEQ ID NO: 5031 - DNA, 21 bp, Artificial Sequence
  Synthetic oligonucleotide
tggctccctcagcttcaatag

SEQ ID NO: 5032 - DNA, 21 bp, Artificial Sequence
  Synthetic oligonucleotide
tcattcctagagtgaagtaac

SEQ ID NO: 5033 - DNA, 21 bp, Artificial Sequence
  Synthetic oligonucleotide
cttcattcctagagtgaagta

SEQ ID NO: 5034 - DNA, 21 bp, Artificial Sequence
  Synthetic oligonucleotide
ccttcattcctagagtgaagt

SEQ ID NO: 5035 - DNA, 21 bp, Artificial Sequence
  Synthetic oligonucleotide
tgtcctcagacattcggaaca

SEQ ID NO: 5036 - DNA, 21 bp, Artificial Sequence
  Synthetic oligonucleotide
cttgtcctcagacattcggaa

SEQ ID NO: 5037 - DNA, 21 bp, Artificial Sequence
  Synthetic oligonucleotide
ccgtttcttgtaatcttgtgg

SEQ ID NO: 5038 - DNA, 21 bp, Artificial Sequence
  Synthetic oligonucleotide
actgaaagccgtttcttgtaa

SEQ ID NO: 5039 - DNA, 21 bp, Artificial Sequence
  Synthetic oligonucleotide
cagctcaactgaaagccgttt

SEQ ID NO: 5040 - DNA, 21 bp, Artificial Sequence
  Synthetic oligonucleotide
caagtccaagatcagcagtct

SEQ ID NO: 5041 - DNA, 21 bp, Artificial Sequence
  Synthetic oligonucleotide
gcaccaatatcaagtccaaga

SEQ ID NO: 5042 - DNA, 21 bp, Artificial Sequence
  Synthetic oligonucleotide
aaagaacgatagctaggatca

SEQ ID NO: 5043 - DNA, 21 bp, Artificial Sequence
  Synthetic oligonucleotide
catatccaccagagtgaaaag

SEQ ID NO: 5044 - DNA, 21 bp, Artificial Sequence
  Synthetic oligonucleotide
tgatttacaggtcagtatcaa

SEQ ID NO: 5045 - DNA, 21 bp, Artificial Sequence
  Synthetic oligonucleotide
atgatttacaggtcagtatca

SEQ ID NO: 5046 - DNA, 21 bp, Artificial Sequence
  Synthetic oligonucleotide
gatgatttacaggtcagtatc

SEQ ID NO: 5047 - DNA, 21 bp, Artificial Sequence
  Synthetic oligonucleotide
cttcttacctaaaggatgatt

SEQ ID NO: 5048 - DNA, 21 bp, Artificial Sequence
  Synthetic oligonucleotide
acttcttacctaaaggatgat

SEQ ID NO: 5049 - DNA, 21 bp, Artificial Sequence
  Synthetic oligonucleotide
aaacttcttacctaaaggatg

SEQ ID NO: 5050 - DNA, 21 bp, Artificial Sequence
  Synthetic oligonucleotide
gctttttaaaacttcttacct

SEQ ID NO: 5051 - DNA, 21 bp, Artificial Sequence
  Synthetic oligonucleotide
tggctttttaaaacttcttac

SEQ ID NO: 5052 - DNA, 21 bp, Artificial Sequence
  Synthetic oligonucleotide
ccaaactggctttttaaaact

SEQ ID NO: 5053 - DNA, 21 bp, Artificial Sequence
  Synthetic oligonucleotide
ttacccaaactggctttttaa

SEQ ID NO: 5054 - DNA, 21 bp, Artificial Sequence
  Synthetic oligonucleotide
tttacccaaactggcttttta

SEQ ID NO: 5055 - DNA, 21 bp, Artificial Sequence
  Synthetic oligonucleotide
ttttacccaaactggcttttt

SEQ ID NO: 5056 - DNA, 21 bp, Artificial Sequence
  Synthetic oligonucleotide
attttacccaaactggctttt

SEQ ID NO: 5057 - DNA, 21 bp, Artificial Sequence
  Synthetic oligonucleotide
ccaaccaagtctttctgaagt

SEQ ID NO: 5058 - DNA, 21 bp, Artificial Sequence
  Synthetic oligonucleotide
ccaccctaccaaccaagtctt

SEQ ID NO: 5059 - DNA, 21 bp, Artificial Sequence
  Synthetic oligonucleotide
atttacaaatagcctaaacca

SEQ ID NO: 5060 - DNA, 21 bp, Artificial Sequence
  Synthetic oligonucleotide
gatttacaaatagcctaaacc

SEQ ID NO: 5061 - DNA, 21 bp, Artificial Sequence
  Synthetic oligonucleotide
agatttacaaatagcctaaac

SEQ ID NO: 5062 - DNA, 21 bp, Artificial Sequence
  Synthetic oligonucleotide
cagatttacaaatagcctaaa

SEQ ID NO: 5063 - DNA, 21 bp, Artificial Sequence
  Synthetic oligonucleotide
tgtttttgtggcagatttaca

SEQ ID NO: 5064 - DNA, 21 bp, Artificial Sequence
  Synthetic oligonucleotide
ctgtttttgtggcagatttac

SEQ ID NO: 5065 - DNA, 21 bp, Artificial Sequence
  Synthetic oligonucleotide
cctgtttttgtggcagattta

SEQ ID NO: 5066 - DNA, 21 bp, Artificial Sequence
  Synthetic oligonucleotide
atatacctgtttttgtggcag

SEQ ID NO: 5067 - DNA, 21 bp, Artificial Sequence
  Synthetic oligonucleotide
ctttcaaagtatatacctgtt

SEQ ID NO: 5068 - DNA, 21 bp, Artificial Sequence
  Synthetic oligonucleotide
catctcctttcaaagtatata

SEQ ID NO: 5069 - DNA, 21 bp, Artificial Sequence
  Synthetic oligonucleotide
acatctcctttcaaagtatat

SEQ ID NO: 5070 - DNA, 21 bp, Artificial Sequence
  Synthetic oligonucleotide
agacatctcctttcaaagtat

SEQ ID NO: 5071 - DNA, 21 bp, Artificial Sequence
  Synthetic oligonucleotide
aagacatctcctttcaaagta

SEQ ID NO: 5072 - DNA, 21 bp, Artificial Sequence
  Synthetic oligonucleotide
caagacatctcctttcaaagt

SEQ ID NO: 5073 - DNA, 21 bp, Artificial Sequence
  Synthetic oligonucleotide
tgttccaagacatctcctttc

SEQ ID NO: 5074 - DNA, 21 bp, Artificial Sequence
  Synthetic oligonucleotide
cattccaatgttccaagacat

SEQ ID NO: 5075 - DNA, 21 bp, Artificial Sequence
  Synthetic oligonucleotide
acattccaatgttccaagaca

SEQ ID NO: 5076 - DNA, 21 bp, Artificial Sequence
  Synthetic oligonucleotide
gaacattccaatgttccaaga

SEQ ID NO: 5077 - DNA, 21 bp, Artificial Sequence
  Synthetic oligonucleotide
ccagaaatctgagaacattcc

SEQ ID NO: 5078 - DNA, 21 bp, Artificial Sequence
  Synthetic oligonucleotide
acaaccagaaatctgagaaca

SEQ ID NO: 5079 - DNA, 21 bp, Artificial Sequence
  Synthetic oligonucleotide
taacaaccagaaatctgagaa

SEQ ID NO: 5080 - DNA, 21 bp, Artificial Sequence
  Synthetic oligonucleotide
ataacaaccagaaatctgaga

SEQ ID NO: 5081 - DNA, 21 bp, Artificial Sequence
  Synthetic oligonucleotide
cataacaaccagaaatctgag

SEQ ID NO: 5082 - DNA, 21 bp, Artificial Sequence
  Synthetic oligonucleotide
tgatcacataacaaccagaaa

SEQ ID NO: 5083 - DNA, 21 bp, Artificial Sequence
  Synthetic oligonucleotide
atgatcacataacaaccagaa

SEQ ID NO: 5084 - DNA, 21 bp, Artificial Sequence
  Synthetic oligonucleotide
ccacacatgatcacataacaa

SEQ ID NO: 5085 - DNA, 21 bp, Artificial Sequence
  Synthetic oligonucleotide
cttccacacatgatcacataa

SEQ ID NO: 5086 - DNA, 21 bp, Artificial Sequence
  Synthetic oligonucleotide
aataacttccacacatgatca

SEQ ID NO: 5087 - DNA, 21 bp, Artificial Sequence
  Synthetic oligonucleotide
taataacttccacacatgatc

SEQ ID NO: 5088 - DNA, 21 bp, Artificial Sequence
  Synthetic oligonucleotide
ttaataacttccacacatgat

SEQ ID NO: 5089 - DNA, 21 bp, Artificial Sequence
  Synthetic oligonucleotide
gttaataacttccacacatga

SEQ ID NO: 5090 - DNA, 21 bp, Artificial Sequence
  Synthetic oligonucleotide
cattaaagttaataacttcca

SEQ ID NO: 5091 - DNA, 21 bp, Artificial Sequence
  Synthetic oligonucleotide
acattaaagttaataacttcc

SEQ ID NO: 5092 - DNA, 21 bp, Artificial Sequence
  Synthetic oligonucleotide
aaacattaaagttaataactt

SEQ ID NO: 5093 - DNA, 21 bp, Artificial Sequence
  Synthetic oligonucleotide
aaaacattaaagttaataact

SEQ ID NO: 5094 - DNA, 21 bp, Artificial Sequence
  Synthetic oligonucleotide
aaaaacattaaagttaataac

SEQ ID NO: 5095 - DNA, 21 bp, Artificial Sequence
  Synthetic oligonucleotide
aaaaaacattaaagttaataa

SEQ ID NO: 5096 - DNA, 21 bp, Artificial Sequence
  Synthetic oligonucleotide
caaaaaacattaaagttaata

SEQ ID NO: 5097 - DNA, 21 bp, Artificial Sequence
  Synthetic oligonucleotide
gcaaaaaacattaaagttaat

SEQ ID NO: 5098 - DNA, 21 bp, Artificial Sequence
  Synthetic oligonucleotide
tggcaaaaaacattaaagtta

SEQ ID NO: 5099 - DNA, 21 bp, Artificial Sequence
  Synthetic oligonucleotide
gtggcaaaaaacattaaagtt

SEQ ID NO: 5100 - DNA, 21 bp, Artificial Sequence
  Synthetic oligonucleotide
ttgcaaaagctgtggcaaaaa

SEQ ID NO: 5101 - DNA, 21 bp, Artificial Sequence
  Synthetic oligonucleotide
gttgcaaaagctgtggcaaaa

SEQ ID NO: 5102 - DNA, 21 bp, Artificial Sequence
  Synthetic oligonucleotide
actcatttgagtattaagttg

SEQ ID NO: 5103 - DNA, 21 bp, Artificial Sequence
  Synthetic oligonucleotide
ttaaaacagcaaatgttactc

SEQ ID NO: 5104 - DNA, 21 bp, Artificial Sequence
  Synthetic oligonucleotide
tttaaaacagcaaatgttact

SEQ ID NO: 5105 - DNA, 21 bp, Artificial Sequence
  Synthetic oligonucleotide
gtttaaaacagcaaatgttac

SEQ ID NO: 5106 - DNA, 21 bp, Artificial Sequence
  Synthetic oligonucleotide
tgtttaaaacagcaaatgtta

SEQ ID NO: 5107 - DNA, 21 bp, Artificial Sequence
  Synthetic oligonucleotide
atgtttaaaacagcaaatgtt

SEQ ID NO: 5108 - DNA, 21 bp, Artificial Sequence
  Synthetic oligonucleotide
aatgtttaaaacagcaaatgt

SEQ ID NO: 5109 - DNA, 21 bp, Artificial Sequence
  Synthetic oligonucleotide
ctattaatgtttaaaacagca

SEQ ID NO: 5110 - DNA, 21 bp, Artificial Sequence
  Synthetic oligonucleotide
agagaaaggctgctattaatg

SEQ ID NO: 5111 - DNA, 21 bp, Artificial Sequence
  Synthetic oligonucleotide
caagttcagacaatacagctg

SEQ ID NO: 5112 - DNA, 21 bp, Artificial Sequence
  Synthetic oligonucleotide
tcacaatgcaagttcagacaa

SEQ ID NO: 5113 - DNA, 21 bp, Artificial Sequence
  Synthetic oligonucleotide
aatcacaatgcaagttcagac

SEQ ID NO: 5114 - DNA, 21 bp, Artificial Sequence
  Synthetic oligonucleotide
ccaatcacaatgcaagttcag

SEQ ID NO: 5115 - DNA, 21 bp, Artificial Sequence
  Synthetic oligonucleotide
caggccaatcacaatgcaagt

SEQ ID NO: 5116 - DNA, 21 bp, Artificial Sequence
  Synthetic oligonucleotide
ttgttcccataggaaactcag

SEQ ID NO: 5117 - DNA, 21 bp, Artificial Sequence
  Synthetic oligonucleotide
cttcaattgttcccataggaa

SEQ ID NO: 5118 - DNA, 21 bp, Artificial Sequence
  Synthetic oligonucleotide
acttcaattgttcccatagga

SEQ ID NO: 5119 - DNA, 21 bp, Artificial Sequence
  Synthetic oligonucleotide
aagtttacttcaattgttccc

SEQ ID NO: 5120 - DNA, 21 bp, Artificial Sequence
  Synthetic oligonucleotide
aaagtttacttcaattgttcc

SEQ ID NO: 5121 - DNA, 21 bp, Artificial Sequence
  Synthetic oligonucleotide
acaaaaagtttacttcaattg

SEQ ID NO: 5122 - DNA, 21 bp, Artificial Sequence
  Synthetic oligonucleotide
cagaacaaaaagtttacttca

SEQ ID NO: 5123 - DNA, 21 bp, Artificial Sequence
  Synthetic oligonucleotide
aggaccagaacaaaaagttta

SEQ ID NO: 5124 - DNA, 21 bp, Artificial Sequence
  Synthetic oligonucleotide
aaggaccagaacaaaaagttt

SEQ ID NO: 5125 - DNA, 21 bp, Artificial Sequence
  Synthetic oligonucleotide
cgaccaaaaaggaccagaaca

SEQ ID NO: 5126 - DNA, 21 bp, Artificial Sequence
  Synthetic oligonucleotide
tcgaccaaaaaggaccagaac

SEQ ID NO: 5127 - DNA, 21 bp, Artificial Sequence
  Synthetic oligonucleotide
ttactcctcgaccaaaaagga

SEQ ID NO: 5128 - DNA, 21 bp, Artificial Sequence
  Synthetic oligonucleotide
aatccatttgtattgttactc

SEQ ID NO: 5129 - DNA, 21 bp, Artificial Sequence
  Synthetic oligonucleotide
aaatccatttgtattgttact

SEQ ID NO: 5130 - DNA, 21 bp, Artificial Sequence
  Synthetic oligonucleotide
aaaatccatttgtattgttac

SEQ ID NO: 5131 - DNA, 21 bp, Artificial Sequence
  Synthetic oligonucleotide
caaaatccatttgtattgtta

SEQ ID NO: 5132 - DNA, 21 bp, Artificial Sequence
  Synthetic oligonucleotide
ccaaaatccatttgtattgtt

SEQ ID NO: 5133 - DNA, 21 bp, Artificial Sequence
  Synthetic oligonucleotide
tcactcccaaaatccatttgt

SEQ ID NO: 5134 - DNA, 21 bp, Artificial Sequence
  Synthetic oligonucleotide
tcttcacttcttgagtcactc

SEQ ID NO: 5135 - DNA, 21 bp, Artificial Sequence
  Synthetic oligonucleotide
attcttcacttcttgagtcac

SEQ ID NO: 5136 - DNA, 21 bp, Artificial Sequence
  Synthetic oligonucleotide
cattcttcacttcttgagtca

SEQ ID NO: 5137 - DNA, 21 bp, Artificial Sequence
  Synthetic oligonucleotide
gcattcttcacttcttgagtc

SEQ ID NO: 5138 - DNA, 21 bp, Artificial Sequence
  Synthetic oligonucleotide
gtgcattcttcacttcttgag

SEQ ID NO: 5139 - DNA, 21 bp, Artificial Sequence
  Synthetic oligonucleotide
ccattcttgtgcattcttcac

SEQ ID NO: 5140 - DNA, 21 bp, Artificial Sequence
  Synthetic oligonucleotide
gatccattcttgtgcattctt

SEQ ID NO: 5141 - DNA, 21 bp, Artificial Sequence
  Synthetic oligonucleotide
tgatccattcttgtgcattct

SEQ ID NO: 5142 - DNA, 21 bp, Artificial Sequence
  Synthetic oligonucleotide
gtgatccattcttgtgcattc

SEQ ID NO: 5143 - DNA, 21 bp, Artificial Sequence
  Synthetic oligonucleotide
taaattccatcttgtgatcca

SEQ ID NO: 5144 - DNA, 21 bp, Artificial Sequence
  Synthetic oligonucleotide
gataaattccatcttgtgatc

SEQ ID NO: 5145 - DNA, 21 bp, Artificial Sequence
  Synthetic oligonucleotide
tgataaattccatcttgtgat

SEQ ID NO: 5146 - DNA, 21 bp, Artificial Sequence
  Synthetic oligonucleotide
ttgataaattccatcttgtga

SEQ ID NO: 5147 - DNA, 21 bp, Artificial Sequence
  Synthetic oligonucleotide
tttgataaattccatcttgtg

SEQ ID NO: 5148 - DNA, 21 bp, Artificial Sequence
  Synthetic oligonucleotide
aaggctagggtttgataaatt

SEQ ID NO: 5149 - DNA, 21 bp, Artificial Sequence
  Synthetic oligonucleotide
aaaaaaatttaacaagcaagg

SEQ ID NO: 5150 - DNA, 21 bp, Artificial Sequence
  Synthetic oligonucleotide
aaaaaaaaaaaaaaaatttaa

SEQ ID NO: 5151 - DNA, 21 bp, Artificial Sequence
  Synthetic oligonucleotide
aaaaaaaaaaaaaaaaattta

SEQ ID NO: 5152 - DNA, 21 bp, Artificial Sequence
  Synthetic oligonucleotide
aaaaaaaaaaaaaaaaaattt

SEQ ID NO: 5153 - DNA, 21 bp, Artificial Sequence
  Synthetic oligonucleotide
aaaaaaaaaaaaaaaaaaatt

SEQ ID NO: 5154 - DNA, 21 bp, Artificial Sequence
  Synthetic oligonucleotide
taaaaaaaaaaaaaaaaaaat

SEQ ID NO: 5155 - DNA, 21 bp, Artificial Sequence
  Synthetic oligonucleotide
ttaaaaaaaaaaaaaaaaaaa

SEQ ID NO: 5156 - DNA, 21 bp, Artificial Sequence
  Synthetic oligonucleotide
cttaaaaaaaaaaaaaaaaaa

SEQ ID NO: 5157 - DNA, 21 bp, Artificial Sequence
  Synthetic oligonucleotide
tcttaaaaaaaaaaaaaaaaa

SEQ ID NO: 5158 - DNA, 21 bp, Artificial Sequence
  Synthetic oligonucleotide
attcttaaaaaaaaaaaaaaa

SEQ ID NO: 5159 - DNA, 21 bp, Artificial Sequence
  Synthetic oligonucleotide
tattcttaaaaaaaaaaaaaa

SEQ ID NO: 5160 - DNA, 21 bp, Artificial Sequence
  Synthetic oligonucleotide
atattcttaaaaaaaaaaaaa

SEQ ID NO: 5161 - DNA, 21 bp, Artificial Sequence
  Synthetic oligonucleotide
gatattcttaaaaaaaaaaaa

SEQ ID NO: 5162 - DNA, 21 bp, Artificial Sequence
  Synthetic oligonucleotide
agatattcttaaaaaaaaaaa

SEQ ID NO: 5163 - DNA, 21 bp, Artificial Sequence
  Synthetic oligonucleotide
cagatattcttaaaaaaaaaa

SEQ ID NO: 5164 - DNA, 21 bp, Artificial Sequence
  Synthetic oligonucleotide
acagatattcttaaaaaaaaa

SEQ ID NO: 5165 - DNA, 21 bp, Artificial Sequence
  Synthetic oligonucleotide
cattacagatattcttaaaaa

SEQ ID NO: 5166 - DNA, 21 bp, Artificial Sequence
  Synthetic oligonucleotide
ccattacagatattcttaaaa

SEQ ID NO: 5167 - DNA, 21 bp, Artificial Sequence
  Synthetic oligonucleotide
agtaccattacagatattctt

SEQ ID NO: 5168 - DNA, 21 bp, Artificial Sequence
  Synthetic oligonucleotide
cagtaccattacagatattct

SEQ ID NO: 5169 - DNA, 21 bp, Artificial Sequence
  Synthetic oligonucleotide
tcagtaccattacagatattc

SEQ ID NO: 5170 - DNA, 21 bp, Artificial Sequence
  Synthetic oligonucleotide
aaagtcagtaccattacagat

SEQ ID NO: 5171 - DNA, 21 bp, Artificial Sequence
  Synthetic oligonucleotide
gctacttcaaagcaagcaaag

SEQ ID NO: 5172 - DNA, 21 bp, Artificial Sequence
  Synthetic oligonucleotide
aaaaaaagagctacttcaaag

SEQ ID NO: 5173 - DNA, 21 bp, Artificial Sequence
  Synthetic oligonucleotide
aaaaaaaaaaaagagctactt

SEQ ID NO: 5174 - DNA, 21 bp, Artificial Sequence
  Synthetic oligonucleotide
aaaaaaaaaaaaagagctact

SEQ ID NO: 5175 - DNA, 21 bp, Artificial Sequence
  Synthetic oligonucleotide
aaaaaaaaaaaaaaagagcta

SEQ ID NO: 5176 - DNA, 21 bp, Artificial Sequence
  Synthetic oligonucleotide
aaaaaaaaaaaaaaaagagct

SEQ ID NO: 5177 - DNA, 21 bp, Artificial Sequence
  Synthetic oligonucleotide
aaaaaaaaaaaaaaaaagagc

SEQ ID NO: 5178 - DNA, 21 bp, Artificial Sequence
  Synthetic oligonucleotide
aaaaaaaaaaaaaaaaaagag

SEQ ID NO: 5179 - DNA, 21 bp, Artificial Sequence
  Synthetic oligonucleotide
aaaaaaaaaaaaaaaaaaaaa

SEQ ID NO: 5180 - DNA, 21 bp, Artificial Sequence
  Synthetic oligonucleotide
aaaaaaaaaaaaaaaaaaaaa

SEQ ID NO: 5181 - DNA, 21 bp, Artificial Sequence
  Synthetic oligonucleotide
caaaaaaaaaaaaaaaaaaaa

SEQ ID NO: 5182 - DNA, 21 bp, Artificial Sequence
  Synthetic oligonucleotide
gcaaaaaaaaaaaaaaaaaaa

SEQ ID NO: 5183 - DNA, 21 bp, Artificial Sequence
  Synthetic oligonucleotide
ctgcaaaaaaaaaaaaaaaaa

SEQ ID NO: 5184 - DNA, 21 bp, Artificial Sequence
  Synthetic oligonucleotide
actgcaaaaaaaaaaaaaaaa

SEQ ID NO: 5185 - DNA, 21 bp, Artificial Sequence
  Synthetic oligonucleotide
agttactgcaaaaaaaaaaaa

SEQ ID NO: 5186 - DNA, 21 bp, Artificial Sequence
  Synthetic oligonucleotide
cagttactgcaaaaaaaaaaa

SEQ ID NO: 5187 - DNA, 21 bp, Artificial Sequence
  Synthetic oligonucleotide
acagttactgcaaaaaaaaaa

SEQ ID NO: 5188 - DNA, 21 bp, Artificial Sequence
  Synthetic oligonucleotide
aaaaacagttactgcaaaaaa

SEQ ID NO: 5189 - DNA, 21 bp, Artificial Sequence
  Synthetic oligonucleotide
aaaaaacagttactgcaaaaa

SEQ ID NO: 5190 - DNA, 21 bp, Artificial Sequence
  Synthetic oligonucleotide
taaaaaacagttactgcaaaa

SEQ ID NO: 5191 - DNA, 21 bp, Artificial Sequence
  Synthetic oligonucleotide
cttaaaaaacagttactgcaa

SEQ ID NO: 5192 - DNA, 21 bp, Artificial Sequence
  Synthetic oligonucleotide
acttaaaaaacagttactgca

SEQ ID NO: 5193 - DNA, 21 bp, Artificial Sequence
  Synthetic oligonucleotide
agacttaaaaaacagttactg

SEQ ID NO: 5194 - DNA, 21 bp, Artificial Sequence
  Synthetic oligonucleotide
acactacgagagacttaaaaa

SEQ ID NO: 5195 - DNA, 21 bp, Artificial Sequence
  Synthetic oligonucleotide
taacactacgagagacttaaa

SEQ ID NO: 5196 - DNA, 21 bp, Artificial Sequence
  Synthetic oligonucleotide
ttaacactacgagagacttaa

SEQ ID NO: 5197 - DNA, 21 bp, Artificial Sequence
  Synthetic oligonucleotide
acttaacactacgagagactt

SEQ ID NO: 5198 - DNA, 21 bp, Artificial Sequence
  Synthetic oligonucleotide
ataacttaacactacgagaga

SEQ ID NO: 5199 - DNA, 21 bp, Artificial Sequence
  Synthetic oligonucleotide
tataacttaacactacgagag

SEQ ID NO: 5200 - DNA, 21 bp, Artificial Sequence
  Synthetic oligonucleotide
gtattcactataacttaacac

SEQ ID NO: 5201 - DNA, 21 bp, Artificial Sequence
  Synthetic oligonucleotide
agtattcactataacttaaca

SEQ ID NO: 5202 - DNA, 21 bp, Artificial Sequence
  Synthetic oligonucleotide
cagtattcactataacttaac

SEQ ID NO: 5203 - DNA, 21 bp, Artificial Sequence
  Synthetic oligonucleotide
gcagtattcactataacttaa

SEQ ID NO: 5204 - DNA, 21 bp, Artificial Sequence
  Synthetic oligonucleotide
agaaattgctgtagcagtatt

SEQ ID NO: 5205 - DNA, 21 bp, Artificial Sequence
  Synthetic oligonucleotide
tagaaattgctgtagcagtat

SEQ ID NO: 5206 - DNA, 21 bp, Artificial Sequence
  Synthetic oligonucleotide
ttagaaattgctgtagcagta

SEQ ID NO: 5207 - DNA, 21 bp, Artificial Sequence
  Synthetic oligonucleotide
actcaattcttaaaaattaga

SEQ ID NO: 5208 - DNA, 21 bp, Artificial Sequence
  Synthetic oligonucleotide
ccattactcaattcttaaaaa

SEQ ID NO: 5209 - DNA, 21 bp, Artificial Sequence
  Synthetic oligonucleotide
acaccattactcaattcttaa

SEQ ID NO: 5210 - DNA, 21 bp, Artificial Sequence
  Synthetic oligonucleotide
ctacaccattactcaattctt

SEQ ID NO: 5211 - DNA, 21 bp, Artificial Sequence
  Synthetic oligonucleotide
tctacaccattactcaattct

SEQ ID NO: 5212 - DNA, 21 bp, Artificial Sequence
  Synthetic oligonucleotide
gttctacaccattactcaatt

SEQ ID NO: 5213 - DNA, 21 bp, Artificial Sequence
  Synthetic oligonucleotide
gtgttctacaccattactcaa

SEQ ID NO: 5214 - DNA, 21 bp, Artificial Sequence
  Synthetic oligonucleotide
atgaattagtgttctacacca

SEQ ID NO: 5215 - DNA, 21 bp, Artificial Sequence
  Synthetic oligonucleotide
tgattatgaattagtgttcta

SEQ ID NO: 5216 - DNA, 21 bp, Artificial Sequence
  Synthetic oligonucleotide
gtgattatgaattagtgttct

SEQ ID NO: 5217 - DNA, 21 bp, Artificial Sequence
  Synthetic oligonucleotide
agtgattatgaattagtgttc

SEQ ID NO: 5218 - DNA, 21 bp, Artificial Sequence
  Synthetic oligonucleotide
attaattagagtgattatgaa

SEQ ID NO: 5219 - DNA, 21 bp, Artificial Sequence
  Synthetic oligonucleotide
aattaattagagtgattatga

SEQ ID NO: 5220 - DNA, 21 bp, Artificial Sequence
  Synthetic oligonucleotide
caattaattagagtgattatg

SEQ ID NO: 5221 - DNA, 21 bp, Artificial Sequence
  Synthetic oligonucleotide
attacaattaattagagtgat

SEQ ID NO: 5222 - DNA, 21 bp, Artificial Sequence
  Synthetic oligonucleotide
gattacaattaattagagtga

SEQ ID NO: 5223 - DNA, 21 bp, Artificial Sequence
  Synthetic oligonucleotide
agattacaattaattagagtg

SEQ ID NO: 5224 - DNA, 21 bp, Artificial Sequence
  Synthetic oligonucleotide
ctttattcagattacaattaa

SEQ ID NO: 5225 - DNA, 21 bp, Artificial Sequence
  Synthetic oligonucleotide
actttattcagattacaatta

SEQ ID NO: 5226 - DNA, 21 bp, Artificial Sequence
  Synthetic oligonucleotide
ttacactttattcagattaca

SEQ ID NO: 5227 - DNA, 21 bp, Artificial Sequence
  Synthetic oligonucleotide
gttacactttattcagattac

SEQ ID NO: 5228 - DNA, 21 bp, Artificial Sequence
  Synthetic oligonucleotide
tgttacactttattcagatta

SEQ ID NO: 5229 - DNA, 21 bp, Artificial Sequence
  Synthetic oligonucleotide
ttgttacactttattcagatt

SEQ ID NO: 5230 - DNA, 21 bp, Artificial Sequence
  Synthetic oligonucleotide
attgttacactttattcagat

SEQ ID NO: 5231 - DNA, 21 bp, Artificial Sequence
  Synthetic oligonucleotide
ctacacaattgttacacttta

SEQ ID NO: 5232 - DNA, 21 bp, Artificial Sequence
  Synthetic oligonucleotide
aaggctacacaattgttacac

SEQ ID NO: 5233 - DNA, 21 bp, Artificial Sequence
  Synthetic oligonucleotide
acaaaaaggctacacaattgt

SEQ ID NO: 5234 - DNA, 21 bp, Artificial Sequence
  Synthetic oligonucleotide
ttttatacaaaaaggctacac

SEQ ID NO: 5235 - DNA, 21 bp, Artificial Sequence
  Synthetic oligonucleotide
attttatacaaaaaggctaca

SEQ ID NO: 5236 - DNA, 21 bp, Artificial Sequence
  Synthetic oligonucleotide
ctattttatacaaaaaggcta

SEQ ID NO: 5237 - DNA, 21 bp, Artificial Sequence
  Synthetic oligonucleotide
tctattttatacaaaaaggct

SEQ ID NO: 5238 - DNA, 21 bp, Artificial Sequence
  Synthetic oligonucleotide
tgtctattttatacaaaaagg

SEQ ID NO: 5239 - DNA, 21 bp, Artificial Sequence
  Synthetic oligonucleotide
tctatttgtctattttataca

SEQ ID NO: 5240 - DNA, 21 bp, Artificial Sequence
  Synthetic oligonucleotide
tttctatttgtctattttata

SEQ ID NO: 5241 - DNA, 21 bp, Artificial Sequence
  Synthetic oligonucleotide
ttttctatttgtctattttat

SEQ ID NO: 5242 - DNA, 21 bp, Artificial Sequence
  Synthetic oligonucleotide
attttctatttgtctatttta

SEQ ID NO: 5243 - DNA, 21 bp, Artificial Sequence
  Synthetic oligonucleotide
cattttctatttgtctatttt

SEQ ID NO: 5244 - DNA, 21 bp, Artificial Sequence
  Synthetic oligonucleotide
ccattttctatttgtctattt

SEQ ID NO: 5245 - DNA, 21 bp, Artificial Sequence
  Synthetic oligonucleotide
ggaccattttctatttgtcta

SEQ ID NO: 5246 - DNA, 21 bp, Artificial Sequence
  Synthetic oligonucleotide
tggaccattttctatttgtct

SEQ ID NO: 5247 - DNA, 21 bp, Artificial Sequence
  Synthetic oligonucleotide
ttggaccattttctatttgtc

SEQ ID NO: 5248 - DNA, 21 bp, Artificial Sequence
  Synthetic oligonucleotide
aaactaattggaccattttct

SEQ ID NO: 5249 - DNA, 21 bp, Artificial Sequence
  Synthetic oligonucleotide
gaaactaattggaccattttc

SEQ ID NO: 5250 - DNA, 21 bp, Artificial Sequence
  Synthetic oligonucleotide
ggaaactaattggaccatttt

SEQ ID NO: 5251 - DNA, 21 bp, Artificial Sequence
  Synthetic oligonucleotide
aggaaactaattggaccattt

SEQ ID NO: 5252 - DNA, 21 bp, Artificial Sequence
  Synthetic oligonucleotide
ttaaaaaggaaactaattgga

SEQ ID NO: 5253 - DNA, 21 bp, Artificial Sequence
  Synthetic oligonucleotide
attaaaaaggaaactaattgg

SEQ ID NO: 5254 - DNA, 21 bp, Artificial Sequence
  Synthetic oligonucleotide
aagcatattaaaaaggaaact

SEQ ID NO: 5255 - DNA, 21 bp, Artificial Sequence
  Synthetic oligonucleotide
taagcatattaaaaaggaaac

SEQ ID NO: 5256 - DNA, 21 bp, Artificial Sequence
  Synthetic oligonucleotide
attttaagcatattaaaaagg

SEQ ID NO: 5257 - DNA, 21 bp, Artificial Sequence
  Synthetic oligonucleotide
ctgcttattttaagcatatta

SEQ ID NO: 5258 - DNA, 21 bp, Artificial Sequence
  Synthetic oligonucleotide
cctgcttattttaagcatatt

SEQ ID NO: 5259 - DNA, 21 bp, Artificial Sequence
  Synthetic oligonucleotide
gatccacctgcttattttaag

SEQ ID NO: 5260 - DNA, 21 bp, Artificial Sequence
  Synthetic oligonucleotide
caaaaacatgaaatagatcca

SEQ ID NO: 5261 - DNA, 21 bp, Artificial Sequence
  Synthetic oligonucleotide
tcaaaaacatgaaatagatcc

SEQ ID NO: 5262 - DNA, 21 bp, Artificial Sequence
  Synthetic oligonucleotide
gatcaaaaacatgaaatagat

SEQ ID NO: 5263 - DNA, 21 bp, Artificial Sequence
  Synthetic oligonucleotide
tgatcaaaaacatgaaataga

SEQ ID NO: 5264 - DNA, 21 bp, Artificial Sequence
  Synthetic oligonucleotide
ttgatcaaaaacatgaaatag

SEQ ID NO: 5265 - DNA, 21 bp, Artificial Sequence
  Synthetic oligonucleotide
agtttttgatcaaaaacatga

SEQ ID NO: 5266 - DNA, 21 bp, Artificial Sequence
  Synthetic oligonucleotide
ccaaatagtttttgatcaaaa

SEQ ID NO: 5267 - DNA, 21 bp, Artificial Sequence
  Synthetic oligonucleotide
tatcccaaatagtttttgatc

SEQ ID NO: 5268 - DNA, 21 bp, Artificial Sequence
  Synthetic oligonucleotide
atatcccaaatagtttttgat

SEQ ID NO: 5269 - DNA, 21 bp, Artificial Sequence
  Synthetic oligonucleotide
catatcccaaatagtttttga

SEQ ID NO: 5270 - DNA, 21 bp, Artificial Sequence
  Synthetic oligonucleotide
acatatcccaaatagtttttg

SEQ ID NO: 5271 - DNA, 21 bp, Artificial Sequence
  Synthetic oligonucleotide
ccatacatatcccaaatagtt

SEQ ID NO: 5272 - DNA, 21 bp, Artificial Sequence
  Synthetic oligonucleotide
ttaccctacccatacatatcc

SEQ ID NO: 5273 - DNA, 21 bp, Artificial Sequence
  Synthetic oligonucleotide
tttaccctacccatacatatc

SEQ ID NO: 5274 - DNA, 21 bp, Artificial Sequence
  Synthetic oligonucleotide
atttaccctacccatacatat

SEQ ID NO: 5275 - DNA, 21 bp, Artificial Sequence
  Synthetic oligonucleotide
acacctcttactgatttaccc

SEQ ID NO: 5276 - DNA, 21 bp, Artificial Sequence
  Synthetic oligonucleotide
taacacctcttactgatttac

SEQ ID NO: 5277 - DNA, 21 bp, Artificial Sequence
  Synthetic oligonucleotide
ataacacctcttactgattta

SEQ ID NO: 5278 - DNA, 21 bp, Artificial Sequence
  Synthetic oligonucleotide
aataacacctcttactgattt

SEQ ID NO: 5279 - DNA, 21 bp, Artificial Sequence
  Synthetic oligonucleotide
aaataacacctcttactgatt

SEQ ID NO: 5280 - DNA, 21 bp, Artificial Sequence
  Synthetic oligonucleotide
caaataacacctcttactgat

SEQ ID NO: 5281 - DNA, 21 bp, Artificial Sequence
  Synthetic oligonucleotide
aggttccaaataacacctctt

SEQ ID NO: 5282 - DNA, 21 bp, Artificial Sequence
  Synthetic oligonucleotide
aaaacaaggttccaaataaca

SEQ ID NO: 5283 - DNA, 21 bp, Artificial Sequence
  Synthetic oligonucleotide
caaaacaaggttccaaataac

SEQ ID NO: 5284 - DNA, 21 bp, Artificial Sequence
  Synthetic oligonucleotide
ccaaaacaaggttccaaataa

SEQ ID NO: 5285 - DNA, 21 bp, Artificial Sequence
  Synthetic oligonucleotide
actgtccaaaacaaggttcca

SEQ ID NO: 5286 - DNA, 21 bp, Artificial Sequence
  Synthetic oligonucleotide
gtaaactgtccaaaacaaggt

SEQ ID NO: 5287 - DNA, 21 bp, Artificial Sequence
  Synthetic oligonucleotide
ggtaaactgtccaaaacaagg

SEQ ID NO: 5288 - DNA, 21 bp, Artificial Sequence
  Synthetic oligonucleotide
aggcaactggtaaactgtcca

SEQ ID NO: 5289 - DNA, 21 bp, Artificial Sequence
  Synthetic oligonucleotide
gggataaaaggcaactggtaa

SEQ ID NO: 5290 - DNA, 21 bp, Artificial Sequence
  Synthetic oligonucleotide
tgggataaaaggcaactggta

SEQ ID NO: 5291 - DNA, 21 bp, Artificial Sequence
  Synthetic oligonucleotide
acaactttgggataaaaggca

SEQ ID NO: 5292 - DNA, 21 bp, Artificial Sequence
  Synthetic oligonucleotide
caacaactttgggataaaagg

SEQ ID NO: 5293 - DNA, 21 bp, Artificial Sequence
  Synthetic oligonucleotide
ggttacaacaactttgggata

SEQ ID NO: 5294 - DNA, 21 bp, Artificial Sequence
  Synthetic oligonucleotide
aggttacaacaactttgggat

SEQ ID NO: 5295 - DNA, 21 bp, Artificial Sequence
  Synthetic oligonucleotide
caggttacaacaactttggga

SEQ ID NO: 5296 - DNA, 21 bp, Artificial Sequence
  Synthetic oligonucleotide
tatcacagcaggttacaacaa

SEQ ID NO: 5297 - DNA, 21 bp, Artificial Sequence
  Synthetic oligonucleotide
gtatcacagcaggttacaaca

SEQ ID NO: 5298 - DNA, 21 bp, Artificial Sequence
  Synthetic oligonucleotide
tcgtatcacagcaggttacaa

SEQ ID NO: 5299 - DNA, 21 bp, Artificial Sequence
  Synthetic oligonucleotide
tttctcttgaagcatcgtatc

SEQ ID NO: 5300 - DNA, 21 bp, Artificial Sequence
  Synthetic oligonucleotide
ttttctcttgaagcatcgtat

SEQ ID NO: 5301 - DNA, 21 bp, Artificial Sequence
  Synthetic oligonucleotide
cattttctcttgaagcatcgt

SEQ ID NO: 5302 - DNA, 21 bp, Artificial Sequence
  Synthetic oligonucleotide
ttttttataaccgcattttct

SEQ ID NO: 5303 - DNA, 21 bp, Artificial Sequence
  Synthetic oligonucleotide
attttttataaccgcattttc

SEQ ID NO: 5304 - DNA, 21 bp, Artificial Sequence
  Synthetic oligonucleotide
cattttttataaccgcatttt

SEQ ID NO: 5305 - DNA, 21 bp, Artificial Sequence
  Synthetic oligonucleotide
ccattttttataaccgcattt

SEQ ID NO: 5306 - DNA, 21 bp, Artificial Sequence
  Synthetic oligonucleotide
ctgaaccattttttataaccg

SEQ ID NO: 5307 - DNA, 21 bp, Artificial Sequence
  Synthetic oligonucleotide
taattctgaaccattttttat

SEQ ID NO: 5308 - DNA, 21 bp, Artificial Sequence
  Synthetic oligonucleotide
ttaattctgaaccatttttta

SEQ ID NO: 5309 - DNA, 21 bp, Artificial Sequence
  Synthetic oligonucleotide
tttaattctgaaccatttttt

SEQ ID NO: 5310 - DNA, 21 bp, Artificial Sequence
  Synthetic oligonucleotide
gtttaattctgaaccattttt

SEQ ID NO: 5311 - DNA, 21 bp, Artificial Sequence
  Synthetic oligonucleotide
agtttaattctgaaccatttt

SEQ ID NO: 5312 - DNA, 21 bp, Artificial Sequence
  Synthetic oligonucleotide
aagtttaattctgaaccattt

SEQ ID NO: 5313 - DNA, 21 bp, Artificial Sequence
  Synthetic oligonucleotide
attaaaagtttaattctgaac

SEQ ID NO: 5314 - DNA, 21 bp, Artificial Sequence
  Synthetic oligonucleotide
aattaaaagtttaattctgaa

SEQ ID NO: 5315 - DNA, 21 bp, Artificial Sequence
  Synthetic oligonucleotide
tgaattaaaagtttaattctg

SEQ ID NO: 5316 - DNA, 21 bp, Artificial Sequence
  Synthetic oligonucleotide
caatacagctaaaggatgatt

SEQ ID NO: 5317 - DNA, 21 bp, Artificial Sequence
  Synthetic oligonucleotide
acaatacagctaaaggatgat

SEQ ID NO: 5318 - DNA, 21 bp, Artificial Sequence
  Synthetic oligonucleotide
agacaatacagctaaaggatg

SEQ ID NO: 5319 - DNA, 21 bp, Artificial Sequence
  Synthetic oligonucleotide
gttactcctaaaggatgattt

SEQ ID NO: 5320 - DNA, 21 bp, Artificial Sequence
  Synthetic oligonucleotide
tgttactcctaaaggatgatt

SEQ ID NO: 5321 - DNA, 21 bp, Artificial Sequence
  Synthetic oligonucleotide
ttgttactcctaaaggatgat

SEQ ID NO: 5322 - DNA, 21 bp, Artificial Sequence
  Synthetic oligonucleotide
attgttactcctaaaggatga

SEQ ID NO: 5323 - DNA, 21 bp, Artificial Sequence
  Synthetic oligonucleotide
ggattccagaatccaagtaag

SEQ ID NO: 5324 - DNA, 21 bp, Artificial Sequence
  Synthetic oligonucleotide
cttgctcccattcataaagga

SEQ ID NO: 5325 - DNA, 21 bp, Artificial Sequence
  Synthetic oligonucleotide
cgtcaatatcagctacttgct

SEQ ID NO: 5326 - DNA, 21 bp, Artificial Sequence
  Synthetic oligonucleotide
ccgtcaatatcagctacttgc

SEQ ID NO: 5327 - DNA, 21 bp, Artificial Sequence
  Synthetic oligonucleotide
actgcccgtcaatatcagcta

SEQ ID NO: 5328 - DNA, 21 bp, Artificial Sequence
  Synthetic oligonucleotide
tgtttcaacatctgtgatggt

SEQ ID NO: 5329 - DNA, 21 bp, Artificial Sequence
  Synthetic oligonucleotide
atgtttcaacatctgtgatgg

SEQ ID NO: 5330 - DNA, 21 bp, Artificial Sequence
  Synthetic oligonucleotide
tgacaactgcatgtttcaaca

SEQ ID NO: 5331 - DNA, 21 bp, Artificial Sequence
  Synthetic oligonucleotide
attgacaactgcatgtttcaa

SEQ ID NO: 5332 - DNA, 21 bp, Artificial Sequence
  Synthetic oligonucleotide
tcaaattgacaactgcatgtt

SEQ ID NO: 5333 - DNA, 21 bp, Artificial Sequence
  Synthetic oligonucleotide
agttaatcaaattgacaactg

SEQ ID NO: 5334 - DNA, 21 bp, Artificial Sequence
  Synthetic oligonucleotide
cctgatagttaatcaaattga

SEQ ID NO: 5335 - DNA, 21 bp, Artificial Sequence
  Synthetic oligonucleotide
cgtcatcctgatagttaatca

SEQ ID NO: 5336 - DNA, 21 bp, Artificial Sequence
  Synthetic oligonucleotide
gcgtcatcctgatagttaatc

SEQ ID NO: 5337 - DNA, 21 bp, Artificial Sequence
  Synthetic oligonucleotide
cctcatcgtttagcagttttg

SEQ ID NO: 5338 - DNA, 21 bp, Artificial Sequence
  Synthetic oligonucleotide
ctggtcctcatcgtttagcag

SEQ ID NO: 5339 - DNA, 21 bp, Artificial Sequence
  Synthetic oligonucleotide
cataacagcagctttattaac

SEQ ID NO: 5340 - DNA, 21 bp, Artificial Sequence
  Synthetic oligonucleotide
ccataacagcagctttattaa

SEQ ID NO: 5341 - DNA, 21 bp, Artificial Sequence
  Synthetic oligonucleotide
ggaccataacagcagctttat

SEQ ID NO: 5342 - DNA, 21 bp, Artificial Sequence
  Synthetic oligonucleotide
tggaccataacagcagcttta

SEQ ID NO: 5343 - DNA, 21 bp, Artificial Sequence
  Synthetic oligonucleotide
ctgtctctacatcatttgtat

SEQ ID NO: 5344 - DNA, 21 bp, Artificial Sequence
  Synthetic oligonucleotide
gctgtctctacatcatttgta

SEQ ID NO: 5345 - DNA, 21 bp, Artificial Sequence
  Synthetic oligonucleotide
gcaaccattttctgcagtcca

SEQ ID NO: 5346 - DNA, 21 bp, Artificial Sequence
  Synthetic oligonucleotide
aagcaaccattttctgcagtc

SEQ ID NO: 5347 - DNA, 21 bp, Artificial Sequence
  Synthetic oligonucleotide
ttgttttgttgagcaaagcaa

SEQ ID NO: 5348 - DNA, 21 bp, Artificial Sequence
  Synthetic oligonucleotide
tttgttttgttgagcaaagca

SEQ ID NO: 5349 - DNA, 21 bp, Artificial Sequence
  Synthetic oligonucleotide
tagccaagaatttcacgtttg

SEQ ID NO: 5350 - DNA, 21 bp, Artificial Sequence
  Synthetic oligonucleotide
cttgattgccataagctaaga

SEQ ID NO: 5351 - DNA, 21 bp, Artificial Sequence
  Synthetic oligonucleotide
gctctcttgattgccataagc

SEQ ID NO: 5352 - DNA, 21 bp, Artificial Sequence
  Synthetic oligonucleotide
cttctcataagtgtaggtcct

SEQ ID NO: 5353 - DNA, 21 bp, Artificial Sequence
  Synthetic oligonucleotide
gcttctcataagtgtaggtcc

SEQ ID NO: 5354 - DNA, 21 bp, Artificial Sequence
  Synthetic oligonucleotide
aagcttctcataagtgtaggt

SEQ ID NO: 5355 - DNA, 21 bp, Artificial Sequence
  Synthetic oligonucleotide
gaagcttctcataagtgtagg

SEQ ID NO: 5356 - DNA, 21 bp, Artificial Sequence
  Synthetic oligonucleotide
gagtccaaagacagttttgaa

SEQ ID NO: 5357 - DNA, 21 bp, Artificial Sequence
  Synthetic oligonucleotide
agagtccaaagacagttttga

SEQ ID NO: 5358 - DNA, 21 bp, Artificial Sequence
  Synthetic oligonucleotide
ccacatttatatcatcggaac

SEQ ID NO: 5359 - DNA, 21 bp, Artificial Sequence
  Synthetic oligonucleotide
tgaccacatttatatcatcgg

SEQ ID NO: 5360 - DNA, 21 bp, Artificial Sequence
  Synthetic oligonucleotide
ctgcacaggtgaccacattta

SEQ ID NO: 5361 - DNA, 21 bp, Artificial Sequence
  Synthetic oligonucleotide
gctgcacaggtgaccacattt

SEQ ID NO: 5362 - DNA, 21 bp, Artificial Sequence
  Synthetic oligonucleotide
ttgtaattattgcaagtgagg

SEQ ID NO: 5363 - DNA, 21 bp, Artificial Sequence
  Synthetic oligonucleotide
catcatcttgtttttgtaatt

SEQ ID NO: 5364 - DNA, 21 bp, Artificial Sequence
  Synthetic oligonucleotide
ccatcatcttgtttttgtaat

SEQ ID NO: 5365 - DNA, 21 bp, Artificial Sequence
  Synthetic oligonucleotide
acaccatcatcttgtttttgt

SEQ ID NO: 5366 - DNA, 21 bp, Artificial Sequence
  Synthetic oligonucleotide
ttggcacaccatcatcttgtt

SEQ ID NO: 5367 - DNA, 21 bp, Artificial Sequence
  Synthetic oligonucleotide
tcaatccaacagttgccttta

SEQ ID NO: 5368 - DNA, 21 bp, Artificial Sequence
  Synthetic oligonucleotide
tcgaatcaatccaacagttgc

SEQ ID NO: 5369 - DNA, 21 bp, Artificial Sequence
  Synthetic oligonucleotide
gctgaactagtcgtggaatag

SEQ ID NO: 5370 - DNA, 21 bp, Artificial Sequence
  Synthetic oligonucleotide
agtacacccttctactatctc

SEQ ID NO: 5371 - DNA, 21 bp, Artificial Sequence
  Synthetic oligonucleotide
cagtacacccttctactatct

SEQ ID NO: 5372 - DNA, 21 bp, Artificial Sequence
  Synthetic oligonucleotide
ccagtacacccttctactatc

SEQ ID NO: 5373 - DNA, 21 bp, Artificial Sequence
  Synthetic oligonucleotide
gagctccagtacacccttcta

SEQ ID NO: 5374 - DNA, 21 bp, Artificial Sequence
  Synthetic oligonucleotide
aaacaatggaatggtattgag

SEQ ID NO: 5375 - DNA, 21 bp, Artificial Sequence
  Synthetic oligonucleotide
ctgcacaaacaatggaatggt

SEQ ID NO: 5376 - DNA, 21 bp, Artificial Sequence
  Synthetic oligonucleotide
actgcacaaacaatggaatgg

SEQ ID NO: 5377 - DNA, 21 bp, Artificial Sequence
  Synthetic oligonucleotide
aagcaactgcacaaacaatgg

SEQ ID NO: 5378 - DNA, 21 bp, Artificial Sequence
  Synthetic oligonucleotide
gagaataaagcaactgcacaa

SEQ ID NO: 5379 - DNA, 21 bp, Artificial Sequence
  Synthetic oligonucleotide
tttcaatgggagaataaagca

SEQ ID NO: 5380 - DNA, 21 bp, Artificial Sequence
  Synthetic oligonucleotide
ttttcaatgggagaataaagc

SEQ ID NO: 5381 - DNA, 21 bp, Artificial Sequence
  Synthetic oligonucleotide
attttcaatgggagaataaag

SEQ ID NO: 5382 - DNA, 21 bp, Artificial Sequence
  Synthetic oligonucleotide
ggatattttcaatgggagaat

SEQ ID NO: 5383 - DNA, 21 bp, Artificial Sequence
  Synthetic oligonucleotide
tggatattttcaatgggagaa

SEQ ID NO: 5384 - DNA, 21 bp, Artificial Sequence
  Synthetic oligonucleotide
ttggatattttcaatgggaga

SEQ ID NO: 5385 - DNA, 21 bp, Artificial Sequence
  Synthetic oligonucleotide
cagctactctttggatatttt

SEQ ID NO: 5386 - DNA, 21 bp, Artificial Sequence
  Synthetic oligonucleotide
gcagctactctttggatattt

SEQ ID NO: 5387 - DNA, 21 bp, Artificial Sequence
  Synthetic oligonucleotide
ccgcttcttgtaatcctgtgg

SEQ ID NO: 5388 - DNA, 21 bp, Artificial Sequence
  Synthetic oligonucleotide
ccagtccaagatctgcagtct

SEQ ID NO: 5389 - DNA, 21 bp, Artificial Sequence
  Synthetic oligonucleotide
cgtatccaccagagtgaaaag

SEQ ID NO: 5390 - DNA, 21 bp, Artificial Sequence
  Synthetic oligonucleotide
caggccagctgattgctatca

SEQ ID NO: 5391 - DNA, 21 bp, Artificial Sequence
  Synthetic oligonucleotide
cgatttacaggtcagtatcaa

SEQ ID NO: 5392 - DNA, 21 bp, Artificial Sequence
  Synthetic oligonucleotide
acgatttacaggtcagtatca

SEQ ID NO: 5393 - DNA, 21 bp, Artificial Sequence
  Synthetic oligonucleotide
tttcttacctaaaggacgatt

SEQ ID NO: 5394 - DNA, 21 bp, Artificial Sequence
  Synthetic oligonucleotide
gctttcttacctaaaggacga

SEQ ID NO: 5395 - DNA, 21 bp, Artificial Sequence
  Synthetic oligonucleotide
cttttataagctttcttacct

SEQ ID NO: 5396 - DNA, 21 bp, Artificial Sequence
  Synthetic oligonucleotide
gcttttataagctttcttacc

SEQ ID NO: 5397 - DNA, 21 bp, Artificial Sequence
  Synthetic oligonucleotide
ctggcttttataagctttctt

SEQ ID NO: 5398 - DNA, 21 bp, Artificial Sequence
  Synthetic oligonucleotide
ccacactggcttttataagct

SEQ ID NO: 5399 - DNA, 21 bp, Artificial Sequence
  Synthetic oligonucleotide
attcacccacactggctttta

SEQ ID NO: 5400 - DNA, 21 bp, Artificial Sequence
  Synthetic oligonucleotide
cctaccaagtctttctggagt

SEQ ID NO: 5401 - DNA, 21 bp, Artificial Sequence
  Synthetic oligonucleotide
atttacaaacaggcctaaaac

SEQ ID NO: 5402 - DNA, 21 bp, Artificial Sequence
  Synthetic oligonucleotide
gatttacaaacaggcctaaaa

SEQ ID NO: 5403 - DNA, 21 bp, Artificial Sequence
  Synthetic oligonucleotide
agatttacaaacaggcctaaa

SEQ ID NO: 5404 - DNA, 21 bp, Artificial Sequence
  Synthetic oligonucleotide
catctccttccaaggtatgta

SEQ ID NO: 5405 - DNA, 21 bp, Artificial Sequence
  Synthetic oligonucleotide
acatctccttccaaggtatgt

SEQ ID NO: 5406 - DNA, 21 bp, Artificial Sequence
  Synthetic oligonucleotide
acttccacacatgaacatctc

SEQ ID NO: 5407 - DNA, 21 bp, Artificial Sequence
  Synthetic oligonucleotide
gaaacttccacacatgaacat

SEQ ID NO: 5408 - DNA, 21 bp, Artificial Sequence
  Synthetic oligonucleotide
agaaacttccacacatgaaca

SEQ ID NO: 5409 - DNA, 21 bp, Artificial Sequence
  Synthetic oligonucleotide
gagaaacttccacacatgaac

SEQ ID NO: 5410 - DNA, 21 bp, Artificial Sequence
  Synthetic oligonucleotide
tgagaaacttccacacatgaa

SEQ ID NO: 5411 - DNA, 21 bp, Artificial Sequence
  Synthetic oligonucleotide
catcaacgtgagaaacttcca

SEQ ID NO: 5412 - DNA, 21 bp, Artificial Sequence
  Synthetic oligonucleotide
aaacatcaacgtgagaaactt

SEQ ID NO: 5413 - DNA, 21 bp, Artificial Sequence
  Synthetic oligonucleotide
aaaacatcaacgtgagaaact

SEQ ID NO: 5414 - DNA, 21 bp, Artificial Sequence
  Synthetic oligonucleotide
aaaaacatcaacgtgagaaac

SEQ ID NO: 5415 - DNA, 21 bp, Artificial Sequence
  Synthetic oligonucleotide
caaaaacatcaacgtgagaaa

SEQ ID NO: 5416 - DNA, 21 bp, Artificial Sequence
  Synthetic oligonucleotide
gcaaaaacatcaacgtgagaa

SEQ ID NO: 5417 - DNA, 21 bp, Artificial Sequence
  Synthetic oligonucleotide
tggcaaaaacatcaacgtgag

SEQ ID NO: 5418 - DNA, 21 bp, Artificial Sequence
  Synthetic oligonucleotide
ctgcaaaagctgtggcaaaaa

SEQ ID NO: 5419 - DNA, 21 bp, Artificial Sequence
  Synthetic oligonucleotide
gctgcaaaagctgtggcaaaa

SEQ ID NO: 5420 - DNA, 21 bp, Artificial Sequence
  Synthetic oligonucleotide
actcatctgagtataacgctg

SEQ ID NO: 5421 - DNA, 21 bp, Artificial Sequence
  Synthetic oligonucleotide
tgaaaacagcaaatgttactc

SEQ ID NO: 5422 - DNA, 21 bp, Artificial Sequence
  Synthetic oligonucleotide
ttgaaaacagcaaatgttact

SEQ ID NO: 5423 - DNA, 21 bp, Artificial Sequence
  Synthetic oligonucleotide
gttgaaaacagcaaatgttac

SEQ ID NO: 5424 - DNA, 21 bp, Artificial Sequence
  Synthetic oligonucleotide
ctattaatgttgaaaacagca

SEQ ID NO: 5425 - DNA, 21 bp, Artificial Sequence
  Synthetic oligonucleotide
acactacagctgtatagagag

SEQ ID NO: 5426 - DNA, 21 bp, Artificial Sequence
  Synthetic oligonucleotide
caggccaatcacaatgcacgt

SEQ ID NO: 5427 - DNA, 21 bp, Artificial Sequence
  Synthetic oligonucleotide
ctgttcccataggaaactcag

SEQ ID NO: 5428 - DNA, 21 bp, Artificial Sequence
  Synthetic oligonucleotide
cagaacaaaaagcgtacttcg

SEQ ID NO: 5429 - DNA, 21 bp, Artificial Sequence
  Synthetic oligonucleotide
aaggaccagaacaaaaagcgt

SEQ ID NO: 5430 - DNA, 21 bp, Artificial Sequence
  Synthetic oligonucleotide
cgaccaaaaaggaccagaaca

SEQ ID NO: 5431 - DNA, 21 bp, Artificial Sequence
  Synthetic oligonucleotide
tcgaccaaaaaggaccagaac

SEQ ID NO: 5432 - DNA, 21 bp, Artificial Sequence
  Synthetic oligonucleotide
ttactcctcgaccaaaaagga

SEQ ID NO: 5433 - DNA, 21 bp, Artificial Sequence
  Synthetic oligonucleotide
aatccatttgtattgttactc

SEQ ID NO: 5434 - DNA, 21 bp, Artificial Sequence
  Synthetic oligonucleotide
aaatccatttgtattgttact

SEQ ID NO: 5435 - DNA, 21 bp, Artificial Sequence
  Synthetic oligonucleotide
caaatccatttgtattgttac

SEQ ID NO: 5436 - DNA, 21 bp, Artificial Sequence
  Synthetic oligonucleotide
ccaaatccatttgtattgtta

SEQ ID NO: 5437 - DNA, 21 bp, Artificial Sequence
  Synthetic oligonucleotide
tcactccccaaatccatttgt

SEQ ID NO: 5438 - DNA, 21 bp, Artificial Sequence
  Synthetic oligonucleotide
gatccattcgtgtgcattctt

SEQ ID NO: 5439 - DNA, 21 bp, Artificial Sequence
  Synthetic oligonucleotide
tgatccattcgtgtgcattct

SEQ ID NO: 5440 - DNA, 21 bp, Artificial Sequence
  Synthetic oligonucleotide
gtgatccattcgtgtgcattc

SEQ ID NO: 5441 - DNA, 21 bp, Artificial Sequence
  Synthetic oligonucleotide
taaaacaaagaacaagcaagg

SEQ ID NO: 5442 - DNA, 21 bp, Artificial Sequence
  Synthetic oligonucleotide
gcaccactacagatattaaaa

SEQ ID NO: 5443 - DNA, 21 bp, Artificial Sequence
  Synthetic oligonucleotide
cagcaccactacagatattaa

SEQ ID NO: 5444 - DNA, 21 bp, Artificial Sequence
  Synthetic oligonucleotide
tcagcaccactacagatatta

SEQ ID NO: 5445 - DNA, 21 bp, Artificial Sequence
  Synthetic oligonucleotide
aaaaaataaaagcaagcaaag

SEQ ID NO: 5446 - DNA, 21 bp, Artificial Sequence
  Synthetic oligonucleotide
ctgcaaaaaataaaagcaagc

SEQ ID NO: 5447 - DNA, 21 bp, Artificial Sequence
  Synthetic oligonucleotide
agttactgcaaaaaataaaag

SEQ ID NO: 5448 - DNA, 21 bp, Artificial Sequence
  Synthetic oligonucleotide
actaacagttactgcaaaaaa

SEQ ID NO: 5449 - DNA, 21 bp, Artificial Sequence
  Synthetic oligonucleotide
aaactaacagttactgcaaaa

SEQ ID NO: 5450 - DNA, 21 bp, Artificial Sequence
  Synthetic oligonucleotide
aaaaactaacagttactgcaa

SEQ ID NO: 5451 - DNA, 21 bp, Artificial Sequence
  Synthetic oligonucleotide
taaaaactaacagttactgca

SEQ ID NO: 5452 - DNA, 21 bp, Artificial Sequence
  Synthetic oligonucleotide
cttaaaaactaacagttactg

SEQ ID NO: 5453 - DNA, 21 bp, Artificial Sequence
  Synthetic oligonucleotide
actacttaaaaactaacagtt

SEQ ID NO: 5454 - DNA, 21 bp, Artificial Sequence
  Synthetic oligonucleotide
acactacttaaaaactaacag

SEQ ID NO: 5455 - DNA, 21 bp, Artificial Sequence
  Synthetic oligonucleotide
cataacactacttaaaaacta

SEQ ID NO: 5456 - DNA, 21 bp, Artificial Sequence
  Synthetic oligonucleotide
acataacactacttaaaaact

SEQ ID NO: 5457 - DNA, 21 bp, Artificial Sequence
  Synthetic oligonucleotide
gaacataacactacttaaaaa

SEQ ID NO: 5458 - DNA, 21 bp, Artificial Sequence
  Synthetic oligonucleotide
agaacataacactacttaaaa

SEQ ID NO: 5459 - DNA, 21 bp, Artificial Sequence
  Synthetic oligonucleotide
tagaacataacactacttaaa

SEQ ID NO: 5460 - DNA, 21 bp, Artificial Sequence
  Synthetic oligonucleotide
ctagaacataacactacttaa

SEQ ID NO: 5461 - DNA, 21 bp, Artificial Sequence
  Synthetic oligonucleotide
gttcactagaacataacacta

SEQ ID NO: 5462 - DNA, 21 bp, Artificial Sequence
  Synthetic oligonucleotide
aggttcactagaacataacac

SEQ ID NO: 5463 - DNA, 21 bp, Artificial Sequence
  Synthetic oligonucleotide
caggttcactagaacataaca

SEQ ID NO: 5464 - DNA, 21 bp, Artificial Sequence
  Synthetic oligonucleotide
ccattactcggttcttagaaa

SEQ ID NO: 5465 - DNA, 21 bp, Artificial Sequence
  Synthetic oligonucleotide
acaccattactcggttcttag

SEQ ID NO: 5466 - DNA, 21 bp, Artificial Sequence
  Synthetic oligonucleotide
gttctacaccattactcggtt

SEQ ID NO: 5467 - DNA, 21 bp, Artificial Sequence
  Synthetic oligonucleotide
atgaattagtgttctacacca

SEQ ID NO: 5468 - DNA, 21 bp, Artificial Sequence
  Synthetic oligonucleotide
tgattatgaattagtgttcta

SEQ ID NO: 5469 - DNA, 21 bp, Artificial Sequence
  Synthetic oligonucleotide
gtgattatgaattagtgttct

SEQ ID NO: 5470 - DNA, 21 bp, Artificial Sequence
  Synthetic oligonucleotide
cgtgattatgaattagtgttc

SEQ ID NO: 5471 - DNA, 21 bp, Artificial Sequence
  Synthetic oligonucleotide
ttacaattagcgtgattatga

SEQ ID NO: 5472 - DNA, 21 bp, Artificial Sequence
  Synthetic oligonucleotide
attacaattagcgtgattatg

SEQ ID NO: 5473 - DNA, 21 bp, Artificial Sequence
  Synthetic oligonucleotide
ccagattacaattagcgtgat

SEQ ID NO: 5474 - DNA, 21 bp, Artificial Sequence
  Synthetic oligonucleotide
gttacacgtctccagattaca

SEQ ID NO: 5475 - DNA, 21 bp, Artificial Sequence
  Synthetic oligonucleotide
atgttacacgtctccagatta

SEQ ID NO: 5476 - DNA, 21 bp, Artificial Sequence
  Synthetic oligonucleotide
gctacacaatgttacacgtct

SEQ ID NO: 5477 - DNA, 21 bp, Artificial Sequence
  Synthetic oligonucleotide
aggctacacaatgttacacgt

SEQ ID NO: 5478 - DNA, 21 bp, Artificial Sequence
  Synthetic oligonucleotide
atacaaaaggctacacaatgt

SEQ ID NO: 5479 - DNA, 21 bp, Artificial Sequence
  Synthetic oligonucleotide
tatacaaaaggctacacaatg

SEQ ID NO: 5480 - DNA, 21 bp, Artificial Sequence
  Synthetic oligonucleotide
tatttatacaaaaggctacac

SEQ ID NO: 5481 - DNA, 21 bp, Artificial Sequence
  Synthetic oligonucleotide
ctatttatacaaaaggctaca

SEQ ID NO: 5482 - DNA, 21 bp, Artificial Sequence
  Synthetic oligonucleotide
tgtctatttatacaaaaggct

SEQ ID NO: 5483 - DNA, 21 bp, Artificial Sequence
  Synthetic oligonucleotide
ctgtctatttatacaaaaggc

SEQ ID NO: 5484 - DNA, 21 bp, Artificial Sequence
  Synthetic oligonucleotide
tctgtctatttatacaaaagg

SEQ ID NO: 5485 - DNA, 21 bp, Artificial Sequence
  Synthetic oligonucleotide
tttctatctgtctatttatac

SEQ ID NO: 5486 - DNA, 21 bp, Artificial Sequence
  Synthetic oligonucleotide
atttctatctgtctatttata

SEQ ID NO: 5487 - DNA, 21 bp, Artificial Sequence
  Synthetic oligonucleotide
catttctatctgtctatttat

SEQ ID NO: 5488 - DNA, 21 bp, Artificial Sequence
  Synthetic oligonucleotide
ccatttctatctgtctattta

SEQ ID NO: 5489 - DNA, 21 bp, Artificial Sequence
  Synthetic oligonucleotide
cggaccatttctatctgtcta

SEQ ID NO: 5490 - DNA, 21 bp, Artificial Sequence
  Synthetic oligonucleotide
tcggaccatttctatctgtct

SEQ ID NO: 5491 - DNA, 21 bp, Artificial Sequence
  Synthetic oligonucleotide
aaactaatcggaccatttcta

SEQ ID NO: 5492 - DNA, 21 bp, Artificial Sequence
  Synthetic oligonucleotide
gaaactaatcggaccatttct

SEQ ID NO: 5493 - DNA, 21 bp, Artificial Sequence
  Synthetic oligonucleotide
ggaaactaatcggaccatttc

SEQ ID NO: 5494 - DNA, 21 bp, Artificial Sequence
  Synthetic oligonucleotide
aggaaactaatcggaccattt

SEQ ID NO: 5495 - DNA, 21 bp, Artificial Sequence
  Synthetic oligonucleotide
attaaaaaggaaactaatcgg

SEQ ID NO: 5496 - DNA, 21 bp, Artificial Sequence
  Synthetic oligonucleotide
aagcatattaaaaaggaaact

SEQ ID NO: 5497 - DNA, 21 bp, Artificial Sequence
  Synthetic oligonucleotide
taagcatattaaaaaggaaac

SEQ ID NO: 5498 - DNA, 21 bp, Artificial Sequence
  Synthetic oligonucleotide
attttaagcatattaaaaagg

SEQ ID NO: 5499 - DNA, 21 bp, Artificial Sequence
  Synthetic oligonucleotide
ctgcttattttaagcatatta

SEQ ID NO: 5500 - DNA, 21 bp, Artificial Sequence
  Synthetic oligonucleotide
cctgcttattttaagcatatt

SEQ ID NO: 5501 - DNA, 21 bp, Artificial Sequence
  Synthetic oligonucleotide
gatccacctgcttattttaag

SEQ ID NO: 5502 - DNA, 21 bp, Artificial Sequence
  Synthetic oligonucleotide
caaaaacatgaaatagatcca

SEQ ID NO: 5503 - DNA, 21 bp, Artificial Sequence
  Synthetic oligonucleotide
tcaaaaacatgaaatagatcc

SEQ ID NO: 5504 - DNA, 21 bp, Artificial Sequence
  Synthetic oligonucleotide
gttcaaaaacatgaaatagat

SEQ ID NO: 5505 - DNA, 21 bp, Artificial Sequence
  Synthetic oligonucleotide
tgttcaaaaacatgaaataga

SEQ ID NO: 5506 - DNA, 21 bp, Artificial Sequence
  Synthetic oligonucleotide
ttgttcaaaaacatgaaatag

SEQ ID NO: 5507 - DNA, 21 bp, Artificial Sequence
  Synthetic oligonucleotide
agtttttgttcaaaaacatga

SEQ ID NO: 5508 - DNA, 21 bp, Artificial Sequence
  Synthetic oligonucleotide
cgataaagtttttgttcaaaa

SEQ ID NO: 5509 - DNA, 21 bp, Artificial Sequence
  Synthetic oligonucleotide
tatccccgataaagtttttgt

SEQ ID NO: 5510 - DNA, 21 bp, Artificial Sequence
  Synthetic oligonucleotide
gtatccccgataaagtttttg

SEQ ID NO: 5511 - DNA, 21 bp, Artificial Sequence
  Synthetic oligonucleotide
acacctcttactgatttaccc

SEQ ID NO: 5512 - DNA, 21 bp, Artificial Sequence
  Synthetic oligonucleotide
taacacctcttactgatttac

SEQ ID NO: 5513 - DNA, 21 bp, Artificial Sequence
  Synthetic oligonucleotide
ataacacctcttactgattta

SEQ ID NO: 5514 - DNA, 21 bp, Artificial Sequence
  Synthetic oligonucleotide
aataacacctcttactgattt

SEQ ID NO: 5515 - DNA, 21 bp, Artificial Sequence
  Synthetic oligonucleotide
aaataacacctcttactgatt

SEQ ID NO: 5516 - DNA, 21 bp, Artificial Sequence
  Synthetic oligonucleotide
caaataacacctcttactgat

SEQ ID NO: 5517 - DNA, 21 bp, Artificial Sequence
  Synthetic oligonucleotide
aaggctcaaataacacctctt

SEQ ID NO: 5518 - DNA, 21 bp, Artificial Sequence
  Synthetic oligonucleotide
aaaacaaggctcaaataacac

SEQ ID NO: 5519 - DNA, 21 bp, Artificial Sequence
  Synthetic oligonucleotide
caaaacaaggctcaaataaca

SEQ ID NO: 5520 - DNA, 21 bp, Artificial Sequence
  Synthetic oligonucleotide
ccaaaacaaggctcaaataac

SEQ ID NO: 5521 - DNA, 21 bp, Artificial Sequence
  Synthetic oligonucleotide
tgtccaaaacaaggctcaaat

SEQ ID NO: 5522 - DNA, 21 bp, Artificial Sequence
  Synthetic oligonucleotide
actgtccaaaacaaggctcaa

SEQ ID NO: 5523 - DNA, 21 bp, Artificial Sequence
  Synthetic oligonucleotide
ggtatactgtccaaaacaagg

SEQ ID NO: 5524 - DNA, 21 bp, Artificial Sequence
  Synthetic oligonucleotide
aggcaactggtatactgtcca

SEQ ID NO: 5525 - DNA, 21 bp, Artificial Sequence
  Synthetic oligonucleotide
gggataaaaggcaactggtat

SEQ ID NO: 5526 - DNA, 21 bp, Artificial Sequence
  Synthetic oligonucleotide
tgggataaaaggcaactggta

SEQ ID NO: 5527 - DNA, 21 bp, Artificial Sequence
  Synthetic oligonucleotide
acaactttgggataaaaggca

SEQ ID NO: 5528 - DNA, 21 bp, Artificial Sequence
  Synthetic oligonucleotide
caacaactttgggataaaagg

SEQ ID NO: 5529 - DNA, 21 bp, Artificial Sequence
  Synthetic oligonucleotide
ggttacaacaactttgggata

SEQ ID NO: 5530 - DNA, 21 bp, Artificial Sequence
  Synthetic oligonucleotide
aggttacaacaactttgggat

SEQ ID NO: 5531 - DNA, 21 bp, Artificial Sequence
  Synthetic oligonucleotide
caggttacaacaactttggga

SEQ ID NO: 5532 - DNA, 21 bp, Artificial Sequence
  Synthetic oligonucleotide
tatcacagcaggttacaacaa

SEQ ID NO: 5533 - DNA, 21 bp, Artificial Sequence
  Synthetic oligonucleotide
gtatcacagcaggttacaaca

SEQ ID NO: 5534 - DNA, 21 bp, Artificial Sequence
  Synthetic oligonucleotide
ttgtatcacagcaggttacaa

SEQ ID NO: 5535 - DNA, 21 bp, Artificial Sequence
  Synthetic oligonucleotide
ccgcatctgttgaagcattgt

SEQ ID NO: 5536 - DNA, 21 bp, Artificial Sequence
  Synthetic oligonucleotide
tctgaaccatttctataaccg

SEQ ID NO: 5537 - DNA, 21 bp, Artificial Sequence
  Synthetic oligonucleotide
taattctgaaccatttctata

SEQ ID NO: 5538 - DNA, 21 bp, Artificial Sequence
  Synthetic oligonucleotide
tttaattctgaaccatttcta

SEQ ID NO: 5539 - DNA, 21 bp, Artificial Sequence
  Synthetic oligonucleotide
gtttaattctgaaccatttct

SEQ ID NO: 5540 - DNA, 21 bp, Artificial Sequence
  Synthetic oligonucleotide
agtttaattctgaaccatttc

SEQ ID NO: 5541 - DNA, 21 bp, Artificial Sequence
  Synthetic oligonucleotide
aagtttaattctgaaccattt

SEQ ID NO: 5542 - DNA, 21 bp, Artificial Sequence
  Synthetic oligonucleotide
attaaaagtttaattctgaac

SEQ ID NO: 5543 - DNA, 21 bp, Artificial Sequence
  Synthetic oligonucleotide
aattaaaagtttaattctgaa

SEQ ID NO: 5544 - DNA, 21 bp, Artificial Sequence
  Synthetic oligonucleotide
tgaattaaaagtttaattctg

SEQ ID NO: 5545 - DNA, 21 bp, Artificial Sequence
  Synthetic oligonucleotide
tttgaatgaattaaaagttta

SEQ ID NO: 5546 - DNA, 21 bp, Artificial Sequence
  Synthetic oligonucleotide
tttttttgaatgaattaaaag

SEQ ID NO: 5547 - DNA, 21 bp, Artificial Sequence
  Synthetic oligonucleotide
tttttttttttgaatgaatta

SEQ ID NO: 5548 - DNA, 21 bp, Artificial Sequence
  Synthetic oligonucleotide
ttttttttttttgaatgaatt

SEQ ID NO: 5549 - DNA, 21 bp, Artificial Sequence
  Synthetic oligonucleotide
tttttttttttttgaatgaat

SEQ ID NO: 5550 - DNA, 21 bp, Artificial Sequence
  Synthetic oligonucleotide
ttttttttttttttgaatgaa

SEQ ID NO: 5551 - DNA, 21 bp, Artificial Sequence
  Synthetic oligonucleotide
tttttttttttttttgaatga

SEQ ID NO: 5552 - DNA, 21 bp, Artificial Sequence
  Synthetic oligonucleotide
ttttttttttttttttgaatg

SEQ ID NO: 5553 - RNA, 27 nt, Artificial Sequence
  Synthetic oligonucleotide
cccugaggguauuugaaguauaccacc

SEQ ID NO: 5554 - RNA, 27 nt, Artificial Sequence
  Synthetic oligonucleotide
gaggguauuugaaguauaccauacaca

SEQ ID NO: 5555 - RNA, 27 nt, Artificial Sequence
  Synthetic oligonucleotide
ugaaguauaccauacaacuguuuugcc

SEQ ID NO: 5556 - RNA, 27 nt, Artificial Sequence
  Synthetic oligonucleotide
auaccauacaacuguuuugaaaaucac

SEQ ID NO: 5557 - RNA, 27 nt, Artificial Sequence
  Synthetic oligonucleotide
auacaacuguuuugaaaauccagcgca

SEQ ID NO: 5558 - RNA, 27 nt, Artificial Sequence
  Synthetic oligonucleotide
cagggauuuucucaguccuucacuccc

SEQ ID NO: 5559 - RNA, 27 nt, Artificial Sequence
  Synthetic oligonucleotide
cacucaagaacaaguagcugauauuac

SEQ ID NO: 5560 - RNA, 27 nt, Artificial Sequence
  Synthetic oligonucleotide
agaacaaguagcugauauugauggaac

SEQ ID NO: 5561 - RNA, 27 nt, Artificial Sequence
  Synthetic oligonucleotide
aacaaguagcugauauugauggacaac

SEQ ID NO: 5562 - RNA, 27 nt, Artificial Sequence
  Synthetic oligonucleotide
ugauggacaguaugcaaugacucgaaa

SEQ ID NO: 5563 - RNA, 27 nt, Artificial Sequence
  Synthetic oligonucleotide
ugcuauguucccugagacauuagauac

SEQ ID NO: 5564 - RNA, 27 nt, Artificial Sequence
  Synthetic oligonucleotide
ugcugaaacaugcaguuguaaacuuac

SEQ ID NO: 5565 - RNA, 27 nt, Artificial Sequence
  Synthetic oligonucleotide
aacaugcaguuguaaacuugauuaaac

SEQ ID NO: 5566 - RNA, 27 nt, Artificial Sequence
  Synthetic oligonucleotide
gcaguuguaaacuugauuaacuauccc

SEQ ID NO: 5567 - RNA, 27 nt, Artificial Sequence
  Synthetic oligonucleotide
acuugauuaacuaucaagaugaugcca

SEQ ID NO: 5568 - RNA, 27 nt, Artificial Sequence
  Synthetic oligonucleotide
cccugaacugacaaaacugcuaaauac

SEQ ID NO: 5569 - RNA, 27 nt, Artificial Sequence
  Synthetic oligonucleotide
ucagauggugucugcuauuguacguca

SEQ ID NO: 5570 - RNA, 27 nt, Artificial Sequence
  Synthetic oligonucleotide
guacguaccaugcagaauacaaaugcc

SEQ ID NO: 5571 - RNA, 27 nt, Artificial Sequence
  Synthetic oligonucleotide
auuacaacucuccacaaccuuuuaucc

SEQ ID NO: 5572 - RNA, 27 nt, Artificial Sequence
  Synthetic oligonucleotide
aacucuccacaaccuuuuauuacauac

SEQ ID NO: 5573 - RNA, 27 nt, Artificial Sequence
  Synthetic oligonucleotide
uccacaaccuuuuauuacaucaagaca

SEQ ID NO: 5574 - RNA, 27 nt, Artificial Sequence
  Synthetic oligonucleotide
accuuuuauuacaucaagaaggagccc

SEQ ID NO: 5575 - RNA, 27 nt, Artificial Sequence
  Synthetic oligonucleotide
acaaaacaaauguuaaauucuuggccc

SEQ ID NO: 5576 - RNA, 27 nt, Artificial Sequence
  Synthetic oligonucleotide
auuacgacagacugccuucaaauuucc

SEQ ID NO: 5577 - RNA, 27 nt, Artificial Sequence
  Synthetic oligonucleotide
gacagacugccuucaaauuuuagcucc

SEQ ID NO: 5578 - RNA, 27 nt, Artificial Sequence
  Synthetic oligonucleotide
agcuuuaguaaauauaaugaggacccc

SEQ ID NO: 5579 - RNA, 27 nt, Artificial Sequence
  Synthetic oligonucleotide
gaaaaacuacuguggaccacaagcaac

SEQ ID NO: 5580 - RNA, 27 nt, Artificial Sequence
  Synthetic oligonucleotide
caagucaacgucuuguucagaacugca

SEQ ID NO: 5581 - RNA, 27 nt, Artificial Sequence
  Synthetic oligonucleotide
aacgucuuguucagaacugucuuugac

SEQ ID NO: 5582 - RNA, 27 nt, Artificial Sequence
  Synthetic oligonucleotide
cuuguucagaacugucuuuggacucca

SEQ ID NO: 5583 - RNA, 27 nt, Artificial Sequence
  Synthetic oligonucleotide
uggguucagaugauauaaaugugguac

SEQ ID NO: 5584 - RNA, 27 nt, Artificial Sequence
  Synthetic oligonucleotide
auucuuucuaaccucacuugcaauacc

SEQ ID NO: 5585 - RNA, 27 nt, Artificial Sequence
  Synthetic oligonucleotide
accucacuugcaauaauuauaagaaac

SEQ ID NO: 5586 - RNA, 27 nt, Artificial Sequence
  Synthetic oligonucleotide
ugcaauaauuauaagaacaagaugaca

SEQ ID NO: 5587 - RNA, 27 nt, Artificial Sequence
  Synthetic oligonucleotide
ugguauagaggcucuugugcguacuac

SEQ ID NO: 5588 - RNA, 27 nt, Artificial Sequence
  Synthetic oligonucleotide
aaggcuacuguuggauugauucgaacc

SEQ ID NO: 5589 - RNA, 27 nt, Artificial Sequence
  Synthetic oligonucleotide
cgcauggaagaaauaguugaagguuac

SEQ ID NO: 5590 - RNA, 27 nt, Artificial Sequence
  Synthetic oligonucleotide
cauggaagaaauaguugaagguuguca

SEQ ID NO: 5591 - RNA, 27 nt, Artificial Sequence
  Synthetic oligonucleotide
ccauugaaaacauccaaagaguagcca

SEQ ID NO: 5592 - RNA, 27 nt, Artificial Sequence
  Synthetic oligonucleotide
cugaggacaagccacaagauuacaaac

SEQ ID NO: 5593 - RNA, 27 nt, Artificial Sequence
  Synthetic oligonucleotide
uugauacugaccuguaaaucauccucc

SEQ ID NO: 5594 - RNA, 27 nt, Artificial Sequence
  Synthetic oligonucleotide
cuuuagguaagaaguuuuaaaaagcac

SEQ ID NO: 5595 - RNA, 27 nt, Artificial Sequence
  Synthetic oligonucleotide
aacagguauauacuuugaaaggagaca

SEQ ID NO: 5596 - RNA, 27 nt, Artificial Sequence
  Synthetic oligonucleotide
uggaaguuauuaacuuuaauguuuucc

SEQ ID NO: 5597 - RNA, 27 nt, Artificial Sequence
  Synthetic oligonucleotide
ugccacagcuuuugcaacuuaauacca

SEQ ID NO: 5598 - RNA, 27 nt, Artificial Sequence
  Synthetic oligonucleotide
aacauuugcuguuuuaaacauuaauca

SEQ ID NO: 5599 - RNA, 27 nt, Artificial Sequence
  Synthetic oligonucleotide
aacaauugaaguaaacuuuuuguucca

SEQ ID NO: 5600 - RNA, 27 nt, Artificial Sequence
  Synthetic oligonucleotide
aaacccuagccuugcuuguuaaauucc

SEQ ID NO: 5601 - RNA, 27 nt, Artificial Sequence
  Synthetic oligonucleotide
uagccuugcuuguuaaauuuuuuuucc

SEQ ID NO: 5602 - RNA, 27 nt, Artificial Sequence
  Synthetic oligonucleotide
uugaaguagcucuuuuuuuuuuuuucc

SEQ ID NO: 5603 - RNA, 27 nt, Artificial Sequence
  Synthetic oligonucleotide
ucguaguguuaaguuauagugaauaac

SEQ ID NO: 5604 - RNA, 27 nt, Artificial Sequence
  Synthetic oligonucleotide
uagugaauacugcuacagcaauuuccc

SEQ ID NO: 5605 - RNA, 27 nt, Artificial Sequence
  Synthetic oligonucleotide
aauacugcuacagcaauuucuaauucc

SEQ ID NO: 5606 - RNA, 27 nt, Artificial Sequence
  Synthetic oligonucleotide
uucuaauuuuuaagaauugaguaauaa

SEQ ID NO: 5607 - RNA, 27 nt, Artificial Sequence
  Synthetic oligonucleotide
auuuuuaagaauugaguaaugguguca

SEQ ID NO: 5608 - RNA, 27 nt, Artificial Sequence
  Synthetic oligonucleotide
uucauaaucacucuaauuaauuguacc

SEQ ID NO: 5609 - RNA, 27 nt, Artificial Sequence
  Synthetic oligonucleotide
auuaauuguaaucugaauaaagugucc

SEQ ID NO: 5610 - RNA, 27 nt, Artificial Sequence
  Synthetic oligonucleotide
uuguaaucugaauaaaguguaacaacc

SEQ ID NO: 5611 - RNA, 27 nt, Artificial Sequence
  Synthetic oligonucleotide
ucugaauaaaguguaacaauuguguca

SEQ ID NO: 5612 - RNA, 27 nt, Artificial Sequence
  Synthetic oligonucleotide
guguagccuuuuuguauaaaauagaac

SEQ ID NO: 5613 - RNA, 27 nt, Artificial Sequence
  Synthetic oligonucleotide
uuuguauaaaauagacaaauagaaacc

SEQ ID NO: 5614 - RNA, 27 nt, Artificial Sequence
  Synthetic oligonucleotide
agaaaaugguccaauuaguuuccuucc

SEQ ID NO: 5615 - RNA, 27 nt, Artificial Sequence
  Synthetic oligonucleotide
guccaauuaguuuccuuuuuaauauaa

SEQ ID NO: 5616 - RNA, 27 nt, Artificial Sequence
  Synthetic oligonucleotide
uuuuugaucaaaaacuauuugggaucc

SEQ ID NO: 5617 - RNA, 27 nt, Artificial Sequence
  Synthetic oligonucleotide
aagagguguuauuuggaaccuuguucc

SEQ ID NO: 5618 - RNA, 27 nt, Artificial Sequence
  Synthetic oligonucleotide
guguuauuuggaaccuuguuuuggaac

SEQ ID NO: 5619 - RNA, 27 nt, Artificial Sequence
  Synthetic oligonucleotide
gaaccuuguuuuggacaguuuaccaac

SEQ ID NO: 5620 - RNA, 27 nt, Artificial Sequence
  Synthetic oligonucleotide
gugauacgaugcuucaagagaaaauaa

SEQ ID NO: 5621 - RNA, 27 nt, Artificial Sequence
  Synthetic oligonucleotide
uucaagagaaaaugcgguuauaaaacc

SEQ ID NO: 5622 - RNA, 27 nt, Artificial Sequence
  Synthetic oligonucleotide
gagaaaaugcgguuauaaaaaauggcc

SEQ ID NO: 5623 - RNA, 27 nt, Artificial Sequence
  Synthetic oligonucleotide
cgguuauaaaaaaugguucagaauucc

SEQ ID NO: 5624 - RNA, 27 nt, Artificial Sequence
  Synthetic oligonucleotide
aaaaaaugguucagaauuaaacuuucc

SEQ ID NO: 5625 - RNA, 27 nt, Artificial Sequence
  Synthetic oligonucleotide
cagcguggacaauggcuacucaagcca

SEQ ID NO: 5626 - RNA, 27 nt, Artificial Sequence
  Synthetic oligonucleotide
agcguggacaauggcuacucaagcuac

SEQ ID NO: 5627 - RNA, 27 nt, Artificial Sequence
  Synthetic oligonucleotide
gcguggacaauggcuacucaagcugcc

SEQ ID NO: 5628 - RNA, 27 nt, Artificial Sequence
  Synthetic oligonucleotide
cguggacaauggcuacucaagcugacc

SEQ ID NO: 5629 - RNA, 27 nt, Artificial Sequence
  Synthetic oligonucleotide
guggacaauggcuacucaagcugaucc

SEQ ID NO: 5630 - RNA, 27 nt, Artificial Sequence
  Synthetic oligonucleotide
uggacaauggcuacucaagcugauuca

SEQ ID NO: 5631 - RNA, 27 nt, Artificial Sequence
  Synthetic oligonucleotide
ggacaauggcuacucaagcugauuuac

SEQ ID NO: 5632 - RNA, 27 nt, Artificial Sequence
  Synthetic oligonucleotide
gacaauggcuacucaagcugauuugcc

SEQ ID NO: 5633 - RNA, 27 nt, Artificial Sequence
  Synthetic oligonucleotide
uuugauggaguuggacauggccaugac

SEQ ID NO: 5634 - RNA, 27 nt, Artificial Sequence
  Synthetic oligonucleotide
uugauggaguuggacauggccauggcc

SEQ ID NO: 5635 - RNA, 27 nt, Artificial Sequence
  Synthetic oligonucleotide
ugauggaguuggacauggccauggaca

SEQ ID NO: 5636 - RNA, 27 nt, Artificial Sequence
  Synthetic oligonucleotide
gauggaguuggacauggccauggaaaa

SEQ ID NO: 5637 - RNA, 27 nt, Artificial Sequence
  Synthetic oligonucleotide
auggaguuggacauggccauggaacac

SEQ ID NO: 5638 - RNA, 27 nt, Artificial Sequence
  Synthetic oligonucleotide
uggaguuggacauggccauggaaccca

SEQ ID NO: 5639 - RNA, 27 nt, Artificial Sequence
  Synthetic oligonucleotide
ggaguuggacauggccauggaaccaac

SEQ ID NO: 5640 - RNA, 27 nt, Artificial Sequence
  Synthetic oligonucleotide
acucuggaauccauucuggugccaccc

SEQ ID NO: 5641 - RNA, 27 nt, Artificial Sequence
  Synthetic oligonucleotide
cucuggaauccauucuggugccacuca

SEQ ID NO: 5642 - RNA, 27 nt, Artificial Sequence
  Synthetic oligonucleotide
ucuggaauccauucuggugccacuaaa

SEQ ID NO: 5643 - RNA, 27 nt, Artificial Sequence
  Synthetic oligonucleotide
cuggaauccauucuggugccacuacac

SEQ ID NO: 5644 - RNA, 27 nt, Artificial Sequence
  Synthetic oligonucleotide
uggaauccauucuggugccacuaccca

SEQ ID NO: 5645 - RNA, 27 nt, Artificial Sequence
  Synthetic oligonucleotide
auuagaugagggcaugcagaucccaca

SEQ ID NO: 5646 - RNA, 27 nt, Artificial Sequence
  Synthetic oligonucleotide
uuagaugagggcaugcagaucccauac

SEQ ID NO: 5647 - RNA, 27 nt, Artificial Sequence
  Synthetic oligonucleotide
uagaugagggcaugcagaucccauccc

SEQ ID NO: 5648 - RNA, 27 nt, Artificial Sequence
  Synthetic oligonucleotide
agaugagggcaugcagaucccaucuca

SEQ ID NO: 5649 - RNA, 27 nt, Artificial Sequence
  Synthetic oligonucleotide
gaugagggcaugcagaucccaucuaac

SEQ ID NO: 5650 - RNA, 27 nt, Artificial Sequence
  Synthetic oligonucleotide
augagggcaugcagaucccaucuacca

SEQ ID NO: 5651 - RNA, 27 nt, Artificial Sequence
  Synthetic oligonucleotide
augcugcucaucccacuaauguccaaa

SEQ ID NO: 5652 - RNA, 27 nt, Artificial Sequence
  Synthetic oligonucleotide
ugcugcucaucccacuaauguccagaa

SEQ ID NO: 5653 - RNA, 27 nt, Artificial Sequence
  Synthetic oligonucleotide
gcugcucaucccacuaauguccagcac

SEQ ID NO: 5654 - RNA, 27 nt, Artificial Sequence
  Synthetic oligonucleotide
cugcucaucccacuaauguccagcgcc

SEQ ID NO: 5655 - RNA, 27 nt, Artificial Sequence
  Synthetic oligonucleotide
ugcucaucccacuaauguccagcgucc

SEQ ID NO: 5656 - RNA, 27 nt, Artificial Sequence
  Synthetic oligonucleotide
gcucaucccacuaauguccagcguuca

SEQ ID NO: 5657 - RNA, 27 nt, Artificial Sequence
  Synthetic oligonucleotide
cucaucccacuaauguccagcguuuaa

SEQ ID NO: 5658 - RNA, 27 nt, Artificial Sequence
  Synthetic oligonucleotide
ucaucccacuaauguccagcguuugaa

SEQ ID NO: 5659 - RNA, 27 nt, Artificial Sequence
  Synthetic oligonucleotide
guuuggcugaaccaucacagaugcuac

SEQ ID NO: 5660 - RNA, 27 nt, Artificial Sequence
  Synthetic oligonucleotide
uuuggcugaaccaucacagaugcugcc

SEQ ID NO: 5661 - RNA, 27 nt, Artificial Sequence
  Synthetic oligonucleotide
uuggcugaaccaucacagaugcugacc

SEQ ID NO: 5662 - RNA, 27 nt, Artificial Sequence
  Synthetic oligonucleotide
cagaacuugccacacgugcaaucccca

SEQ ID NO: 5663 - RNA, 27 nt, Artificial Sequence
  Synthetic oligonucleotide
agaacuugccacacgugcaaucccuac

SEQ ID NO: 5664 - RNA, 27 nt, Artificial Sequence
  Synthetic oligonucleotide
caguuaugguccaucagcuuucuaacc

SEQ ID NO: 5665 - RNA, 27 nt, Artificial Sequence
  Synthetic oligonucleotide
aguuaugguccaucagcuuucuaaacc

SEQ ID NO: 5666 - RNA, 27 nt, Artificial Sequence
  Synthetic oligonucleotide
cuaaaaaggaagcuuccagacacgccc

SEQ ID NO: 5667 - RNA, 27 nt, Artificial Sequence
  Synthetic oligonucleotide
uaaaaaggaagcuuccagacacgcucc

SEQ ID NO: 5668 - RNA, 27 nt, Artificial Sequence
  Synthetic oligonucleotide
guaccaugcagaauacaaaugauguca

SEQ ID NO: 5669 - RNA, 27 nt, Artificial Sequence
  Synthetic oligonucleotide
uaccaugcagaauacaaaugauguaac

SEQ ID NO: 5670 - RNA, 27 nt, Artificial Sequence
  Synthetic oligonucleotide
accaugcagaauacaaaugauguagcc

SEQ ID NO: 5671 - RNA, 27 nt, Artificial Sequence
  Synthetic oligonucleotide
ccaugcagaauacaaaugauguagacc

SEQ ID NO: 5672 - RNA, 27 nt, Artificial Sequence
  Synthetic oligonucleotide
caugcagaauacaaaugauguagaaca

SEQ ID NO: 5673 - RNA, 27 nt, Artificial Sequence
  Synthetic oligonucleotide
augcagaauacaaaugauguagaaaac

SEQ ID NO: 5674 - RNA, 27 nt, Artificial Sequence
  Synthetic oligonucleotide
ugcagaauacaaaugauguagaaacca

SEQ ID NO: 5675 - RNA, 27 nt, Artificial Sequence
  Synthetic oligonucleotide
gcagaauacaaaugauguagaaacaaa

SEQ ID NO: 5676 - RNA, 27 nt, Artificial Sequence
  Synthetic oligonucleotide
uacuggccaucuuuaagucuggaggac

SEQ ID NO: 5677 - RNA, 27 nt, Artificial Sequence
  Synthetic oligonucleotide
acuggccaucuuuaagucuggaggccc

SEQ ID NO: 5678 - RNA, 27 nt, Artificial Sequence
  Synthetic oligonucleotide
aagaaggagcuaaaauggcagugcgcc

SEQ ID NO: 5679 - RNA, 27 nt, Artificial Sequence
  Synthetic oligonucleotide
agaaggagcuaaaauggcagugcgucc

SEQ ID NO: 5680 - RNA, 27 nt, Artificial Sequence
  Synthetic oligonucleotide
gaaggagcuaaaauggcagugcguucc

SEQ ID NO: 5681 - RNA, 27 nt, Artificial Sequence
  Synthetic oligonucleotide
aaggagcuaaaauggcagugcguuuca

SEQ ID NO: 5682 - RNA, 27 nt, Artificial Sequence
  Synthetic oligonucleotide
aggagcuaaaauggcagugcguuuaaa

SEQ ID NO: 5683 - RNA, 27 nt, Artificial Sequence
  Synthetic oligonucleotide
uacuguggaccacaagcagagugcuac

SEQ ID NO: 5684 - RNA, 27 nt, Artificial Sequence
  Synthetic oligonucleotide
acuguggaccacaagcagagugcugcc

SEQ ID NO: 5685 - RNA, 27 nt, Artificial Sequence
  Synthetic oligonucleotide
cuguggaccacaagcagagugcugaca

SEQ ID NO: 5686 - RNA, 27 nt, Artificial Sequence
  Synthetic oligonucleotide
uguggaccacaagcagagugcugaaaa

SEQ ID NO: 5687 - RNA, 27 nt, Artificial Sequence
  Synthetic oligonucleotide
guggaccacaagcagagugcugaagac

SEQ ID NO: 5688 - RNA, 27 nt, Artificial Sequence
  Synthetic oligonucleotide
uggaccacaagcagagugcugaaggca

SEQ ID NO: 5689 - RNA, 27 nt, Artificial Sequence
  Synthetic oligonucleotide
ggaccacaagcagagugcugaagguaa

SEQ ID NO: 5690 - RNA, 27 nt, Artificial Sequence
  Synthetic oligonucleotide
gaccacaagcagagugcugaaggugac

SEQ ID NO: 5691 - RNA, 27 nt, Artificial Sequence
  Synthetic oligonucleotide
accacaagcagagugcugaaggugccc

SEQ ID NO: 5692 - RNA, 27 nt, Artificial Sequence
  Synthetic oligonucleotide
ccacaagcagagugcugaaggugcucc

SEQ ID NO: 5693 - RNA, 27 nt, Artificial Sequence
  Synthetic oligonucleotide
cacaagcagagugcugaaggugcuaca

SEQ ID NO: 5694 - RNA, 27 nt, Artificial Sequence
  Synthetic oligonucleotide
acaagcagagugcugaaggugcuauac

SEQ ID NO: 5695 - RNA, 27 nt, Artificial Sequence
  Synthetic oligonucleotide
caagcagagugcugaaggugcuaucca

SEQ ID NO: 5696 - RNA, 27 nt, Artificial Sequence
  Synthetic oligonucleotide
aagcagagugcugaaggugcuaucuac

SEQ ID NO: 5697 - RNA, 27 nt, Artificial Sequence
  Synthetic oligonucleotide
agaacugucuuuggacucucaggaaca

SEQ ID NO: 5698 - RNA, 27 nt, Artificial Sequence
  Synthetic oligonucleotide
gaacugucuuuggacucucaggaauac

SEQ ID NO: 5699 - RNA, 27 nt, Artificial Sequence
  Synthetic oligonucleotide
cagaugauauaaauguggucaccugca

SEQ ID NO: 5700 - RNA, 27 nt, Artificial Sequence
  Synthetic oligonucleotide
agaugauauaaauguggucaccuguaa

SEQ ID NO: 5701 - RNA, 27 nt, Artificial Sequence
  Synthetic oligonucleotide
gaugauauaaauguggucaccugugac

SEQ ID NO: 5702 - RNA, 27 nt, Artificial Sequence
  Synthetic oligonucleotide
augauauaaauguggucaccugugcca

SEQ ID NO: 5703 - RNA, 27 nt, Artificial Sequence
  Synthetic oligonucleotide
ugauauaaauguggucaccugugcaaa

SEQ ID NO: 5704 - RNA, 27 nt, Artificial Sequence
  Synthetic oligonucleotide
gauauaaauguggucaccugugcagac

SEQ ID NO: 5705 - RNA, 27 nt, Artificial Sequence
  Synthetic oligonucleotide
auauaaauguggucaccugugcagcca

SEQ ID NO: 5706 - RNA, 27 nt, Artificial Sequence
  Synthetic oligonucleotide
uauaaauguggucaccugugcagcuaa

SEQ ID NO: 5707 - RNA, 27 nt, Artificial Sequence
  Synthetic oligonucleotide
auaaauguggucaccugugcagcugac

SEQ ID NO: 5708 - RNA, 27 nt, Artificial Sequence
  Synthetic oligonucleotide
uaaauguggucaccugugcagcuggcc

SEQ ID NO: 5709 - RNA, 27 nt, Artificial Sequence
  Synthetic oligonucleotide
aaauguggucaccugugcagcuggacc

SEQ ID NO: 5710 - RNA, 27 nt, Artificial Sequence
  Synthetic oligonucleotide
aauguggucaccugugcagcuggaacc

SEQ ID NO: 5711 - RNA, 27 nt, Artificial Sequence
  Synthetic oligonucleotide
auguggucaccugugcagcuggaauca

SEQ ID NO: 5712 - RNA, 27 nt, Artificial Sequence
  Synthetic oligonucleotide
uguggucaccugugcagcuggaauuac

SEQ ID NO: 5713 - RNA, 27 nt, Artificial Sequence
  Synthetic oligonucleotide
guggucaccugugcagcuggaauuccc

SEQ ID NO: 5714 - RNA, 27 nt, Artificial Sequence
  Synthetic oligonucleotide
uggucaccugugcagcuggaauucucc

SEQ ID NO: 5715 - RNA, 27 nt, Artificial Sequence
  Synthetic oligonucleotide
ggucaccugugcagcuggaauucuuca

SEQ ID NO: 5716 - RNA, 27 nt, Artificial Sequence
  Synthetic oligonucleotide
gucaccugugcagcuggaauucuuuac

SEQ ID NO: 5717 - RNA, 27 nt, Artificial Sequence
  Synthetic oligonucleotide
ucaccugugcagcuggaauucuuuccc

SEQ ID NO: 5718 - RNA, 27 nt, Artificial Sequence
  Synthetic oligonucleotide
caccugugcagcuggaauucuuucucc

SEQ ID NO: 5719 - RNA, 27 nt, Artificial Sequence
  Synthetic oligonucleotide
uuucuaaccucacuugcaauaauuacc

SEQ ID NO: 5720 - RNA, 27 nt, Artificial Sequence
  Synthetic oligonucleotide
uucuaaccucacuugcaauaauuaucc

SEQ ID NO: 5721 - RNA, 27 nt, Artificial Sequence
  Synthetic oligonucleotide
ucuaaccucacuugcaauaauuauaca

SEQ ID NO: 5722 - RNA, 27 nt, Artificial Sequence
  Synthetic oligonucleotide
cuaaccucacuugcaauaauuauaaac

SEQ ID NO: 5723 - RNA, 27 nt, Artificial Sequence
  Synthetic oligonucleotide
uaaccucacuugcaauaauuauaagcc

SEQ ID NO: 5724 - RNA, 27 nt, Artificial Sequence
  Synthetic oligonucleotide
gggcuggugacagggaagacaucacca

SEQ ID NO: 5725 - RNA, 27 nt, Artificial Sequence
  Synthetic oligonucleotide
ggcuggugacagggaagacaucacuac

SEQ ID NO: 5726 - RNA, 27 nt, Artificial Sequence
  Synthetic oligonucleotide
gcuggugacagggaagacaucacugca

SEQ ID NO: 5727 - RNA, 27 nt, Artificial Sequence
  Synthetic oligonucleotide
cuggugacagggaagacaucacugaaa

SEQ ID NO: 5728 - RNA, 27 nt, Artificial Sequence
  Synthetic oligonucleotide
uggugacagggaagacaucacugagaa

SEQ ID NO: 5729 - RNA, 27 nt, Artificial Sequence
  Synthetic oligonucleotide
ggugacagggaagacaucacugagcac

SEQ ID NO: 5730 - RNA, 27 nt, Artificial Sequence
  Synthetic oligonucleotide
gugacagggaagacaucacugagccca

SEQ ID NO: 5731 - RNA, 27 nt, Artificial Sequence
  Synthetic oligonucleotide
ugacagggaagacaucacugagccuaa

SEQ ID NO: 5732 - RNA, 27 nt, Artificial Sequence
  Synthetic oligonucleotide
gacagggaagacaucacugagccugaa

SEQ ID NO: 5733 - RNA, 27 nt, Artificial Sequence
  Synthetic oligonucleotide
acagggaagacaucacugagccugcac

SEQ ID NO: 5734 - RNA, 27 nt, Artificial Sequence
  Synthetic oligonucleotide
cagggaagacaucacugagccugcccc

SEQ ID NO: 5735 - RNA, 27 nt, Artificial Sequence
  Synthetic oligonucleotide
agggaagacaucacugagccugccaca

SEQ ID NO: 5736 - RNA, 27 nt, Artificial Sequence
  Synthetic oligonucleotide
gggaagacaucacugagccugccauac

SEQ ID NO: 5737 - RNA, 27 nt, Artificial Sequence
  Synthetic oligonucleotide
ggaagacaucacugagccugccaucca

SEQ ID NO: 5738 - RNA, 27 nt, Artificial Sequence
  Synthetic oligonucleotide
gaagacaucacugagccugccaucuac

SEQ ID NO: 5739 - RNA, 27 nt, Artificial Sequence
  Synthetic oligonucleotide
aagacaucacugagccugccaucugca

SEQ ID NO: 5740 - RNA, 27 nt, Artificial Sequence
  Synthetic oligonucleotide
agacaucacugagccugccaucuguaa

SEQ ID NO: 5741 - RNA, 27 nt, Artificial Sequence
  Synthetic oligonucleotide
gacaucacugagccugccaucugugac

SEQ ID NO: 5742 - RNA, 27 nt, Artificial Sequence
  Synthetic oligonucleotide
acaucacugagccugccaucugugcca

SEQ ID NO: 5743 - RNA, 27 nt, Artificial Sequence
  Synthetic oligonucleotide
caucacugagccugccaucugugcuac

SEQ ID NO: 5744 - RNA, 27 nt, Artificial Sequence
  Synthetic oligonucleotide
aucacugagccugccaucugugcuccc

SEQ ID NO: 5745 - RNA, 27 nt, Artificial Sequence
  Synthetic oligonucleotide
ucacugagccugccaucugugcucuca

SEQ ID NO: 5746 - RNA, 27 nt, Artificial Sequence
  Synthetic oligonucleotide
cacugagccugccaucugugcucuuaa

SEQ ID NO: 5747 - RNA, 27 nt, Artificial Sequence
  Synthetic oligonucleotide
acugagccugccaucugugcucuucac

SEQ ID NO: 5748 - RNA, 27 nt, Artificial Sequence
  Synthetic oligonucleotide
cugagccugccaucugugcucuucgca

SEQ ID NO: 5749 - RNA, 27 nt, Artificial Sequence
  Synthetic oligonucleotide
ugagccugccaucugugcucuucguac

SEQ ID NO: 5750 - RNA, 27 nt, Artificial Sequence
  Synthetic oligonucleotide
gagccugccaucugugcucuucguccc

SEQ ID NO: 5751 - RNA, 27 nt, Artificial Sequence
  Synthetic oligonucleotide
agccugccaucugugcucuucgucaca

SEQ ID NO: 5752 - RNA, 27 nt, Artificial Sequence
  Synthetic oligonucleotide
gccugccaucugugcucuucgucauac

SEQ ID NO: 5753 - RNA, 27 nt, Artificial Sequence
  Synthetic oligonucleotide
ccugccaucugugcucuucgucaucca

SEQ ID NO: 5754 - RNA, 27 nt, Artificial Sequence
  Synthetic oligonucleotide
cugccaucugugcucuucgucaucuac

SEQ ID NO: 5755 - RNA, 27 nt, Artificial Sequence
  Synthetic oligonucleotide
ugccaucugugcucuucgucaucugca

SEQ ID NO: 5756 - RNA, 27 nt, Artificial Sequence
  Synthetic oligonucleotide
gccaucugugcucuucgucaucugaaa

SEQ ID NO: 5757 - RNA, 27 nt, Artificial Sequence
  Synthetic oligonucleotide
ccaucugugcucuucgucaucugacac

SEQ ID NO: 5758 - RNA, 27 nt, Artificial Sequence
  Synthetic oligonucleotide
caucugugcucuucgucaucugaccca

SEQ ID NO: 5759 - RNA, 27 nt, Artificial Sequence
  Synthetic oligonucleotide
aucugugcucuucgucaucugaccaaa

SEQ ID NO: 5760 - RNA, 27 nt, Artificial Sequence
  Synthetic oligonucleotide
ucugugcucuucgucaucugaccagaa

SEQ ID NO: 5761 - RNA, 27 nt, Artificial Sequence
  Synthetic oligonucleotide
cugugcucuucgucaucugaccagcaa

SEQ ID NO: 5762 - RNA, 27 nt, Artificial Sequence
  Synthetic oligonucleotide
ugugcucuucgucaucugaccagccac

SEQ ID NO: 5763 - RNA, 27 nt, Artificial Sequence
  Synthetic oligonucleotide
gugcucuucgucaucugaccagccgca

SEQ ID NO: 5764 - RNA, 27 nt, Artificial Sequence
  Synthetic oligonucleotide
ugcucuucgucaucugaccagccgaac

SEQ ID NO: 5765 - RNA, 27 nt, Artificial Sequence
  Synthetic oligonucleotide
gcucuucgucaucugaccagccgacca

SEQ ID NO: 5766 - RNA, 27 nt, Artificial Sequence
  Synthetic oligonucleotide
cucuucgucaucugaccagccgacaaa

SEQ ID NO: 5767 - RNA, 27 nt, Artificial Sequence
  Synthetic oligonucleotide
ucuucgucaucugaccagccgacacac

SEQ ID NO: 5768 - RNA, 27 nt, Artificial Sequence
  Synthetic oligonucleotide
uacacccaccaucccacuggccucuac

SEQ ID NO: 5769 - RNA, 27 nt, Artificial Sequence
  Synthetic oligonucleotide
acacccaccaucccacuggccucugcc

SEQ ID NO: 5770 - RNA, 27 nt, Artificial Sequence
  Synthetic oligonucleotide
cacccaccaucccacuggccucugacc

SEQ ID NO: 5771 - RNA, 27 nt, Artificial Sequence
  Synthetic oligonucleotide
acccaccaucccacuggccucugaucc

SEQ ID NO: 5772 - RNA, 27 nt, Artificial Sequence
  Synthetic oligonucleotide
cccaccaucccacuggccucugauacc

SEQ ID NO: 5773 - RNA, 27 nt, Artificial Sequence
  Synthetic oligonucleotide
ccaccaucccacuggccucugauaaca

SEQ ID NO: 5774 - RNA, 27 nt, Artificial Sequence
  Synthetic oligonucleotide
caccaucccacuggccucugauaaaaa

SEQ ID NO: 5775 - RNA, 27 nt, Artificial Sequence
  Synthetic oligonucleotide
accaucccacuggccucugauaaagaa

SEQ ID NO: 5776 - RNA, 27 nt, Artificial Sequence
  Synthetic oligonucleotide
ccaucccacuggccucugauaaaggac

SEQ ID NO: 5777 - RNA, 27 nt, Artificial Sequence
  Synthetic oligonucleotide
caucccacuggccucugauaaaggccc

SEQ ID NO: 5778 - RNA, 27 nt, Artificial Sequence
  Synthetic oligonucleotide
aucccacuggccucugauaaaggcuca

SEQ ID NO: 5779 - RNA, 27 nt, Artificial Sequence
  Synthetic oligonucleotide
ucccacuggccucugauaaaggcuaac

SEQ ID NO: 5780 - RNA, 27 nt, Artificial Sequence
  Synthetic oligonucleotide
cccacuggccucugauaaaggcuacca

SEQ ID NO: 5781 - RNA, 27 nt, Artificial Sequence
  Synthetic oligonucleotide
ccacuggccucugauaaaggcuacuac

SEQ ID NO: 5782 - RNA, 27 nt, Artificial Sequence
  Synthetic oligonucleotide
cuacuguuggauugauucgaaaucuca

SEQ ID NO: 5783 - RNA, 27 nt, Artificial Sequence
  Synthetic oligonucleotide
uacuguuggauugauucgaaaucuuaa

SEQ ID NO: 5784 - RNA, 27 nt, Artificial Sequence
  Synthetic oligonucleotide
uaaauaccauuccauuguuugugcaaa

SEQ ID NO: 5785 - RNA, 27 nt, Artificial Sequence
  Synthetic oligonucleotide
aaauaccauuccauuguuugugcagac

SEQ ID NO: 5786 - RNA, 27 nt, Artificial Sequence
  Synthetic oligonucleotide
aauaccauuccauuguuugugcagcca

SEQ ID NO: 5787 - RNA, 27 nt, Artificial Sequence
  Synthetic oligonucleotide
auaccauuccauuguuugugcagcuaa

SEQ ID NO: 5788 - RNA, 27 nt, Artificial Sequence
  Synthetic oligonucleotide
uaccauuccauuguuugugcagcugac

SEQ ID NO: 5789 - RNA, 27 nt, Artificial Sequence
  Synthetic oligonucleotide
accauuccauuguuugugcagcugccc

SEQ ID NO: 5790 - RNA, 27 nt, Artificial Sequence
  Synthetic oligonucleotide
gcugcuuuauucucccauugaaaaccc

SEQ ID NO: 5791 - RNA, 27 nt, Artificial Sequence
  Synthetic oligonucleotide
cugcuuuauucucccauugaaaacaca

SEQ ID NO: 5792 - RNA, 27 nt, Artificial Sequence
  Synthetic oligonucleotide
ugcuuuauucucccauugaaaacauaa

SEQ ID NO: 5793 - RNA, 27 nt, Artificial Sequence
  Synthetic oligonucleotide
gcuuuauucucccauugaaaacaucac

SEQ ID NO: 5794 - RNA, 27 nt, Artificial Sequence
  Synthetic oligonucleotide
ggguccucugugaacuugcucaggaac

SEQ ID NO: 5795 - RNA, 27 nt, Artificial Sequence
  Synthetic oligonucleotide
gguccucugugaacuugcucaggaccc

SEQ ID NO: 5796 - RNA, 27 nt, Artificial Sequence
  Synthetic oligonucleotide
guccucugugaacuugcucaggacaca

SEQ ID NO: 5797 - RNA, 27 nt, Artificial Sequence
  Synthetic oligonucleotide
uccucugugaacuugcucaggacaaaa

SEQ ID NO: 5798 - RNA, 27 nt, Artificial Sequence
  Synthetic oligonucleotide
ccucugugaacuugcucaggacaagac

SEQ ID NO: 5799 - RNA, 27 nt, Artificial Sequence
  Synthetic oligonucleotide
cucugugaacuugcucaggacaaggcc

SEQ ID NO: 5800 - RNA, 27 nt, Artificial Sequence
  Synthetic oligonucleotide
ucugugaacuugcucaggacaaggaca

SEQ ID NO: 5801 - RNA, 27 nt, Artificial Sequence
  Synthetic oligonucleotide
cugugaacuugcucaggacaaggaaaa

SEQ ID NO: 5802 - RNA, 27 nt, Artificial Sequence
  Synthetic oligonucleotide
ugugaacuugcucaggacaaggaagac

SEQ ID NO: 5803 - RNA, 27 nt, Artificial Sequence
  Synthetic oligonucleotide
gugaacuugcucaggacaaggaagcca

SEQ ID NO: 5804 - RNA, 27 nt, Artificial Sequence
  Synthetic oligonucleotide
ugaacuugcucaggacaaggaagcuaa

SEQ ID NO: 5805 - RNA, 27 nt, Artificial Sequence
  Synthetic oligonucleotide
cuauugaagcugagggagccacagcca

SEQ ID NO: 5806 - RNA, 27 nt, Artificial Sequence
  Synthetic oligonucleotide
uauugaagcugagggagccacagcuaa

SEQ ID NO: 5807 - RNA, 27 nt, Artificial Sequence
  Synthetic oligonucleotide
auugaagcugagggagccacagcucac

SEQ ID NO: 5808 - RNA, 27 nt, Artificial Sequence
  Synthetic oligonucleotide
uguuccgaaugucugaggacaagccca

SEQ ID NO: 5809 - RNA, 27 nt, Artificial Sequence
  Synthetic oligonucleotide
guuccgaaugucugaggacaagccaac

SEQ ID NO: 5810 - RNA, 27 nt, Artificial Sequence
  Synthetic oligonucleotide
uuccgaaugucugaggacaagccaccc

SEQ ID NO: 5811 - RNA, 27 nt, Artificial Sequence
  Synthetic oligonucleotide
uccgaaugucugaggacaagccacaca

SEQ ID NO: 5812 - RNA, 27 nt, Artificial Sequence
  Synthetic oligonucleotide
ccgaaugucugaggacaagccacaaac

SEQ ID NO: 5813 - RNA, 27 nt, Artificial Sequence
  Synthetic oligonucleotide
cgaaugucugaggacaagccacaagcc

SEQ ID NO: 5814 - RNA, 27 nt, Artificial Sequence
  Synthetic oligonucleotide
gaaugucugaggacaagccacaagacc

SEQ ID NO: 5815 - RNA, 27 nt, Artificial Sequence
  Synthetic oligonucleotide
aaugucugaggacaagccacaagaucc

SEQ ID NO: 5816 - RNA, 27 nt, Artificial Sequence
  Synthetic oligonucleotide
gaacagagccaauggcuuggaaugaac

SEQ ID NO: 5817 - RNA, 27 nt, Artificial Sequence
  Synthetic oligonucleotide
aacagagccaauggcuuggaaugagca

SEQ ID NO: 5818 - RNA, 27 nt, Artificial Sequence
  Synthetic oligonucleotide
acagagccaauggcuuggaaugagaac

SEQ ID NO: 5819 - RNA, 27 nt, Artificial Sequence
  Synthetic oligonucleotide
cagagccaauggcuuggaaugagacca

SEQ ID NO: 5820 - RNA, 27 nt, Artificial Sequence
  Synthetic oligonucleotide
agagccaauggcuuggaaugagacuaa

SEQ ID NO: 5821 - RNA, 27 nt, Artificial Sequence
  Synthetic oligonucleotide
gagccaauggcuuggaaugagacugac

SEQ ID NO: 5822 - RNA, 27 nt, Artificial Sequence
  Synthetic oligonucleotide
agccaauggcuuggaaugagacugcca

SEQ ID NO: 5823 - RNA, 27 nt, Artificial Sequence
  Synthetic oligonucleotide
gccaauggcuuggaaugagacugcuac

SEQ ID NO: 5824 - RNA, 27 nt, Artificial Sequence
  Synthetic oligonucleotide
ccaauggcuuggaaugagacugcugcc

SEQ ID NO: 5825 - RNA, 27 nt, Artificial Sequence
  Synthetic oligonucleotide
caauggcuuggaaugagacugcugaca

SEQ ID NO: 5826 - RNA, 27 nt, Artificial Sequence
  Synthetic oligonucleotide
aauggcuuggaaugagacugcugauac

SEQ ID NO: 5827 - RNA, 27 nt, Artificial Sequence
  Synthetic oligonucleotide
cccuuggauaucgccaggaugaucccc

SEQ ID NO: 5828 - RNA, 27 nt, Artificial Sequence
  Synthetic oligonucleotide
ccuuggauaucgccaggaugauccuca

SEQ ID NO: 5829 - RNA, 27 nt, Artificial Sequence
  Synthetic oligonucleotide
cuuggauaucgccaggaugauccuaaa

SEQ ID NO: 5830 - RNA, 27 nt, Artificial Sequence
  Synthetic oligonucleotide
uuggauaucgccaggaugauccuagac

SEQ ID NO: 5831 - RNA, 27 nt, Artificial Sequence
  Synthetic oligonucleotide
uggauaucgccaggaugauccuagccc

SEQ ID NO: 5832 - RNA, 27 nt, Artificial Sequence
  Synthetic oligonucleotide
aucguucuuuucacucugguggauaca

SEQ ID NO: 5833 - RNA, 27 nt, Artificial Sequence
  Synthetic oligonucleotide
ucguucuuuucacucugguggauauaa

SEQ ID NO: 5834 - RNA, 27 nt, Artificial Sequence
  Synthetic oligonucleotide
cguucuuuucacucugguggauaugaa

SEQ ID NO: 5835 - RNA, 27 nt, Artificial Sequence
  Synthetic oligonucleotide
guucuuuucacucugguggauauggaa

SEQ ID NO: 5836 - RNA, 27 nt, Artificial Sequence
  Synthetic oligonucleotide
uucuuuucacucugguggauauggcac

SEQ ID NO: 5837 - RNA, 27 nt, Artificial Sequence
  Synthetic oligonucleotide
aacaugagauggguggccaccacccca

SEQ ID NO: 5838 - RNA, 27 nt, Artificial Sequence
  Synthetic oligonucleotide
acaugagauggguggccaccacccuaa

SEQ ID NO: 5839 - RNA, 27 nt, Artificial Sequence
  Synthetic oligonucleotide
caugagauggguggccaccacccugac

SEQ ID NO: 5840 - RNA, 27 nt, Artificial Sequence
  Synthetic oligonucleotide
augagauggguggccaccacccuggca

SEQ ID NO: 5841 - RNA, 27 nt, Artificial Sequence
  Synthetic oligonucleotide
ugagauggguggccaccacccugguaa

SEQ ID NO: 5842 - RNA, 27 nt, Artificial Sequence
  Synthetic oligonucleotide
gagauggguggccaccacccuggugac

SEQ ID NO: 5843 - RNA, 27 nt, Artificial Sequence
  Synthetic oligonucleotide
agauggguggccaccacccuggugcca

SEQ ID NO: 5844 - RNA, 27 nt, Artificial Sequence
  Synthetic oligonucleotide
gauggguggccaccacccuggugcuac

SEQ ID NO: 5845 - RNA, 27 nt, Artificial Sequence
  Synthetic oligonucleotide
auggguggccaccacccuggugcugca

SEQ ID NO: 5846 - RNA, 27 nt, Artificial Sequence
  Synthetic oligonucleotide
uggguggccaccacccuggugcugaac

SEQ ID NO: 5847 - RNA, 27 nt, Artificial Sequence
  Synthetic oligonucleotide
ggguggccaccacccuggugcugaccc

SEQ ID NO: 5848 - RNA, 27 nt, Artificial Sequence
  Synthetic oligonucleotide
gguggccaccacccuggugcugacucc

SEQ ID NO: 5849 - RNA, 27 nt, Artificial Sequence
  Synthetic oligonucleotide
guggccaccacccuggugcugacuaca

SEQ ID NO: 5850 - RNA, 27 nt, Artificial Sequence
  Synthetic oligonucleotide
uggccaccacccuggugcugacuauaa

SEQ ID NO: 5851 - RNA, 27 nt, Artificial Sequence
  Synthetic oligonucleotide
ggccaccacccuggugcugacuaucac

SEQ ID NO: 5852 - RNA, 27 nt, Artificial Sequence
  Synthetic oligonucleotide
gccaccacccuggugcugacuauccca

SEQ ID NO: 5853 - RNA, 27 nt, Artificial Sequence
  Synthetic oligonucleotide
ccaccacccuggugcugacuauccaac

SEQ ID NO: 5854 - RNA, 27 nt, Artificial Sequence
  Synthetic oligonucleotide
caccacccuggugcugacuauccagcc

SEQ ID NO: 5855 - RNA, 27 nt, Artificial Sequence
  Synthetic oligonucleotide
accacccuggugcugacuauccaguca

SEQ ID NO: 5856 - RNA, 27 nt, Artificial Sequence
  Synthetic oligonucleotide
ccacccuggugcugacuauccaguuac

SEQ ID NO: 5857 - RNA, 27 nt, Artificial Sequence
  Synthetic oligonucleotide
cacccuggugcugacuauccaguugcc

SEQ ID NO: 5858 - RNA, 27 nt, Artificial Sequence
  Synthetic oligonucleotide
acccuggugcugacuauccaguugaca

SEQ ID NO: 5859 - RNA, 27 nt, Artificial Sequence
  Synthetic oligonucleotide
cccuggugcugacuauccaguugauaa

SEQ ID NO: 5860 - RNA, 27 nt, Artificial Sequence
  Synthetic oligonucleotide
ccuggugcugacuauccaguugaugaa

SEQ ID NO: 5861 - RNA, 27 nt, Artificial Sequence
  Synthetic oligonucleotide
cuggugcugacuauccaguugauggaa

SEQ ID NO: 5862 - RNA, 27 nt, Artificial Sequence
  Synthetic oligonucleotide
uggugcugacuauccaguugaugggac

SEQ ID NO: 5863 - RNA, 27 nt, Artificial Sequence
  Synthetic oligonucleotide
ggugcugacuauccaguugaugggcca

SEQ ID NO: 5864 - RNA, 27 nt, Artificial Sequence
  Synthetic oligonucleotide
gugcugacuauccaguugaugggcuaa

SEQ ID NO: 5865 - RNA, 27 nt, Artificial Sequence
  Synthetic oligonucleotide
ugcugacuauccaguugaugggcugaa

SEQ ID NO: 5866 - RNA, 27 nt, Artificial Sequence
  Synthetic oligonucleotide
gcugacuauccaguugaugggcugcac

SEQ ID NO: 5867 - RNA, 27 nt, Artificial Sequence
  Synthetic oligonucleotide
cugacuauccaguugaugggcugccca

SEQ ID NO: 5868 - RNA, 27 nt, Artificial Sequence
  Synthetic oligonucleotide
ugacuauccaguugaugggcugccaac

SEQ ID NO: 5869 - RNA, 27 nt, Artificial Sequence
  Synthetic oligonucleotide
gacuauccaguugaugggcugccagcc

SEQ ID NO: 5870 - RNA, 27 nt, Artificial Sequence
  Synthetic oligonucleotide
acuauccaguugaugggcugccagaca

SEQ ID NO: 5871 - RNA, 27 nt, Artificial Sequence
  Synthetic oligonucleotide
cuauccaguugaugggcugccagauac

SEQ ID NO: 5872 - RNA, 27 nt, Artificial Sequence
  Synthetic oligonucleotide
augcccaggaccucauggaugggcuaa

SEQ ID NO: 5873 - RNA, 27 nt, Artificial Sequence
  Synthetic oligonucleotide
ugcccaggaccucauggaugggcugaa

SEQ ID NO: 5874 - RNA, 27 nt, Artificial Sequence
  Synthetic oligonucleotide
gcccaggaccucauggaugggcugcac

SEQ ID NO: 5875 - RNA, 27 nt, Artificial Sequence
  Synthetic oligonucleotide
acagcaaucagcuggccugguuugacc

SEQ ID NO: 5876 - RNA, 27 nt, Artificial Sequence
  Synthetic oligonucleotide
cagcaaucagcuggccugguuugauca

SEQ ID NO: 5877 - RNA, 27 nt, Artificial Sequence
  Synthetic oligonucleotide
agcaaucagcuggccugguuugauaac

SEQ ID NO: 5878 - RNA, 27 nt, Artificial Sequence
  Synthetic oligonucleotide
gcaaucagcuggccugguuugauacca

SEQ ID NO: 5879 - RNA, 27 nt, Artificial Sequence
  Synthetic oligonucleotide
caaucagcuggccugguuugauacuac

SEQ ID NO: 5880 - RNA, 27 nt, Artificial Sequence
  Synthetic oligonucleotide
aaucagcuggccugguuugauacugca

SEQ ID NO: 5881 - RNA, 27 nt, Artificial Sequence
  Synthetic oligonucleotide
aucagcuggccugguuugauacugaaa

SEQ ID NO: 5882 - RNA, 27 nt, Artificial Sequence
  Synthetic oligonucleotide
ucagcuggccugguuugauacugacac

SEQ ID NO: 5883 - RNA, 27 nt, Artificial Sequence
  Synthetic oligonucleotide
cagcuggccugguuugauacugaccca

SEQ ID NO: 5884 - RNA, 27 nt, Artificial Sequence
  Synthetic oligonucleotide
agcuggccugguuugauacugaccuac

SEQ ID NO: 5885 - RNA, 27 nt, Artificial Sequence
  Synthetic oligonucleotide
gcuggccugguuugauacugaccugcc

SEQ ID NO: 5886 - RNA, 27 nt, Artificial Sequence
  Synthetic oligonucleotide
cuggccugguuugauacugaccugucc

SEQ ID NO: 5887 - RNA, 27 nt, Artificial Sequence
  Synthetic oligonucleotide
uggccugguuugauacugaccuguacc

SEQ ID NO: 5888 - RNA, 27 nt, Artificial Sequence
  Synthetic oligonucleotide
ggccugguuugauacugaccuguaacc

SEQ ID NO: 5889 - RNA, 27 nt, Artificial Sequence
  Synthetic oligonucleotide
gccugguuugauacugaccuguaaaca

SEQ ID NO: 5890 - RNA, 27 nt, Artificial Sequence
  Synthetic oligonucleotide
ccugguuugauacugaccuguaaauac

SEQ ID NO: 5891 - RNA, 27 nt, Artificial Sequence
  Synthetic oligonucleotide
cugguuugauacugaccuguaaauccc

SEQ ID NO: 5892 - RNA, 27 nt, Artificial Sequence
  Synthetic oligonucleotide
ugguuugauacugaccuguaaaucaca

SEQ ID NO: 5893 - RNA, 27 nt, Artificial Sequence
  Synthetic oligonucleotide
gguuugauacugaccuguaaaucauaa

SEQ ID NO: 5894 - RNA, 27 nt, Artificial Sequence
  Synthetic oligonucleotide
guuugauacugaccuguaaaucaucac

SEQ ID NO: 5895 - RNA, 27 nt, Artificial Sequence
  Synthetic oligonucleotide
uuugauacugaccuguaaaucaucccc

SEQ ID NO: 5896 - RNA, 27 nt, Artificial Sequence
  Synthetic oligonucleotide
uuuuuugccacagcuuuugcaacuucc

SEQ ID NO: 5897 - RNA, 27 nt, Artificial Sequence
  Synthetic oligonucleotide
aaugaguaacauuugcuguuuuaaaac

SEQ ID NO: 5898 - RNA, 27 nt, Artificial Sequence
  Synthetic oligonucleotide
uaaacauuaauagcagccuuucucuac

SEQ ID NO: 5899 - RNA, 27 nt, Artificial Sequence
  Synthetic oligonucleotide
aacauuaauagcagccuuucucucucc

SEQ ID NO: 5900 - RNA, 27 nt, Artificial Sequence
  Synthetic oligonucleotide
cauuaauagcagccuuucucucuuucc

SEQ ID NO: 5901 - RNA, 27 nt, Artificial Sequence
  Synthetic oligonucleotide
uuaauagcagccuuucucucuuuauca

SEQ ID NO: 5902 - RNA, 27 nt, Artificial Sequence
  Synthetic oligonucleotide
uugcauugugauuggccuguagaguca

SEQ ID NO: 5903 - RNA, 27 nt, Artificial Sequence
  Synthetic oligonucleotide
gcauugugauuggccuguagaguugac

SEQ ID NO: 5904 - RNA, 27 nt, Artificial Sequence
  Synthetic oligonucleotide
auugugauuggccuguagaguugcuac

SEQ ID NO: 5905 - RNA, 27 nt, Artificial Sequence
  Synthetic oligonucleotide
ugugauuggccuguagaguugcugaac

SEQ ID NO: 5906 - RNA, 27 nt, Artificial Sequence
  Synthetic oligonucleotide
ugauuggccuguagaguugcugagaaa

SEQ ID NO: 5907 - RNA, 27 nt, Artificial Sequence
  Synthetic oligonucleotide
auuggccuguagaguugcugagaggaa

SEQ ID NO: 5908 - RNA, 27 nt, Artificial Sequence
  Synthetic oligonucleotide
uggccuguagaguugcugagagggcca

SEQ ID NO: 5909 - RNA, 27 nt, Artificial Sequence
  Synthetic oligonucleotide
gccuguagaguugcugagagggcucac

SEQ ID NO: 5910 - RNA, 27 nt, Artificial Sequence
  Synthetic oligonucleotide
cuguagaguugcugagagggcucgaaa

SEQ ID NO: 5911 - RNA, 27 nt, Artificial Sequence
  Synthetic oligonucleotide
gggugggcugguaucucagaaagugaa

SEQ ID NO: 5912 - RNA, 27 nt, Artificial Sequence
  Synthetic oligonucleotide
gugggcugguaucucagaaagugccca

SEQ ID NO: 5913 - RNA, 27 nt, Artificial Sequence
  Synthetic oligonucleotide
gggcugguaucucagaaagugccugca

SEQ ID NO: 5914 - RNA, 27 nt, Artificial Sequence
  Synthetic oligonucleotide
gcugguaucucagaaagugccugacca

SEQ ID NO: 5915 - RNA, 27 nt, Artificial Sequence
  Synthetic oligonucleotide
acacuaaccaagcugaguuuccuauaa

SEQ ID NO: 5916 - RNA, 27 nt, Artificial Sequence
  Synthetic oligonucleotide
acuaaccaagcugaguuuccuauggac

SEQ ID NO: 5917 - RNA, 27 nt, Artificial Sequence
  Synthetic oligonucleotide
uaaccaagcugaguuuccuaugggaca

SEQ ID NO: 5918 - RNA, 27 nt, Artificial Sequence
  Synthetic oligonucleotide
accaagcugaguuuccuaugggaaccc

SEQ ID NO: 5919 - RNA, 27 nt, Artificial Sequence
  Synthetic oligonucleotide
caagcugaguuuccuaugggaacaacc

SEQ ID NO: 5920 - RNA, 27 nt, Artificial Sequence
  Synthetic oligonucleotide
agcugaguuuccuaugggaacaauuac

SEQ ID NO: 5921 - RNA, 27 nt, Artificial Sequence
  Synthetic oligonucleotide
aacuuuuuguucugguccuuuuuggca

SEQ ID NO: 5922 - RNA, 27 nt, Artificial Sequence
  Synthetic oligonucleotide
cuuuuuguucugguccuuuuuggucac

SEQ ID NO: 5923 - RNA, 27 nt, Artificial Sequence
  Synthetic oligonucleotide
uuuuguucugguccuuuuuggucgaaa

SEQ ID NO: 5924 - RNA, 27 nt, Artificial Sequence
  Synthetic oligonucleotide
uuguucugguccuuuuuggucgaggca

SEQ ID NO: 5925 - RNA, 27 nt, Artificial Sequence
  Synthetic oligonucleotide
guucugguccuuuuuggucgaggagcc

SEQ ID NO: 5926 - RNA, 27 nt, Artificial Sequence
  Synthetic oligonucleotide
ucugguccuuuuuggucgaggaguaca

SEQ ID NO: 5927 - RNA, 27 nt, Artificial Sequence
  Synthetic oligonucleotide
ugguccuuuuuggucgaggaguaaccc

SEQ ID NO: 5928 - RNA, 27 nt, Artificial Sequence
  Synthetic oligonucleotide
guccuuuuuggucgaggaguaacaacc

SEQ ID NO: 5929 - RNA, 27 nt, Artificial Sequence
  Synthetic oligonucleotide
ccuuuuuggucgaggaguaacaauaac

SEQ ID NO: 5930 - RNA, 27 nt, Artificial Sequence
  Synthetic oligonucleotide
uuuuuggucgaggaguaacaauacacc

SEQ ID NO: 5931 - RNA, 27 nt, Artificial Sequence
  Synthetic oligonucleotide
uuuggucgaggaguaacaauacaaaca

SEQ ID NO: 5932 - RNA, 27 nt, Artificial Sequence
  Synthetic oligonucleotide
uggucgaggaguaacaauacaaaugac

SEQ ID NO: 5933 - RNA, 27 nt, Artificial Sequence
  Synthetic oligonucleotide
gucgaggaguaacaauacaaauggacc

SEQ ID NO: 5934 - RNA, 27 nt, Artificial Sequence
  Synthetic oligonucleotide
cgaggaguaacaauacaaauggauucc

SEQ ID NO: 5935 - RNA, 27 nt, Artificial Sequence
  Synthetic oligonucleotide
aggaguaacaauacaaauggauuuuaa

SEQ ID NO: 5936 - RNA, 27 nt, Artificial Sequence
  Synthetic oligonucleotide
uuuaucaaacccuagccuugcuugucc

SEQ ID NO: 5937 - RNA, 27 nt, Artificial Sequence
  Synthetic oligonucleotide
uaucaaacccuagccuugcuuguuacc

SEQ ID NO: 5938 - RNA, 27 nt, Artificial Sequence
  Synthetic oligonucleotide
ucaaacccuagccuugcuuguuaaacc

SEQ ID NO: 5939 - RNA, 27 nt, Artificial Sequence
  Synthetic oligonucleotide
uugaguaaugguguagaacacuaauca

SEQ ID NO: 5940 - RNA, 27 nt, Artificial Sequence
  Synthetic oligonucleotide
gaguaaugguguagaacacuaauuccc

SEQ ID NO: 5941 - RNA, 27 nt, Artificial Sequence
  Synthetic oligonucleotide
guaaugguguagaacacuaauucaucc

SEQ ID NO: 5942 - RNA, 27 nt, Artificial Sequence
  Synthetic oligonucleotide
aaugguguagaacacuaauucauaaca

SEQ ID NO: 5943 - RNA, 27 nt, Artificial Sequence
  Synthetic oligonucleotide
ugguguagaacacuaauucauaaucca

SEQ ID NO: 5944 - RNA, 27 nt, Artificial Sequence
  Synthetic oligonucleotide
guguagaacacuaauucauaaucacca

SEQ ID NO: 5945 - RNA, 27 nt, Artificial Sequence
  Synthetic oligonucleotide
guagaacacuaauucauaaucacuccc

SEQ ID NO: 5946 - RNA, 27 nt, Artificial Sequence
  Synthetic oligonucleotide
agaacacuaauucauaaucacucuacc

SEQ ID NO: 5947 - RNA, 27 nt, Artificial Sequence
  Synthetic oligonucleotide
aauuaguuuccuuuuuaauaugcuucc

SEQ ID NO: 5948 - RNA, 27 nt, Artificial Sequence
  Synthetic oligonucleotide
uuaguuuccuuuuuaauaugcuuaacc

SEQ ID NO: 5949 - RNA, 27 nt, Artificial Sequence
  Synthetic oligonucleotide
aguuuccuuuuuaauaugcuuaaaacc

SEQ ID NO: 5950 - RNA, 27 nt, Artificial Sequence
  Synthetic oligonucleotide
uuuccuuuuuaauaugcuuaaaauaca

SEQ ID NO: 5951 - RNA, 27 nt, Artificial Sequence
  Synthetic oligonucleotide
uccuuuuuaauaugcuuaaaauaagac

SEQ ID NO: 5952 - RNA, 27 nt, Artificial Sequence
  Synthetic oligonucleotide
ccuuuuuaauaugcuuaaaauaagcca

SEQ ID NO: 5953 - RNA, 27 nt, Artificial Sequence
  Synthetic oligonucleotide
cuuuuuaauaugcuuaaaauaagcaaa

SEQ ID NO: 5954 - RNA, 27 nt, Artificial Sequence
  Synthetic oligonucleotide
uuuuaauaugcuuaaaauaagcaggca

SEQ ID NO: 5955 - RNA, 27 nt, Artificial Sequence
  Synthetic oligonucleotide
uuaauaugcuuaaaauaagcaggugac

SEQ ID NO: 5956 - RNA, 27 nt, Artificial Sequence
  Synthetic oligonucleotide
aauaugcuuaaaauaagcagguggaca

SEQ ID NO: 5957 - RNA, 27 nt, Artificial Sequence
  Synthetic oligonucleotide
uaugcuuaaaauaagcagguggauccc

SEQ ID NO: 5958 - RNA, 27 nt, Artificial Sequence
  Synthetic oligonucleotide
ugcuuaaaauaagcagguggaucuacc

SEQ ID NO: 5959 - RNA, 27 nt, Artificial Sequence
  Synthetic oligonucleotide
cuuaaaauaagcagguggaucuauuca

SEQ ID NO: 5960 - RNA, 27 nt, Artificial Sequence
  Synthetic oligonucleotide
uaaaauaagcagguggaucuauuuccc

SEQ ID NO: 5961 - RNA, 27 nt, Artificial Sequence
  Synthetic oligonucleotide
aaauaagcagguggaucuauuucauac

SEQ ID NO: 5962 - RNA, 27 nt, Artificial Sequence
  Synthetic oligonucleotide
auaagcagguggaucuauuucaugucc

SEQ ID NO: 5963 - RNA, 27 nt, Artificial Sequence
  Synthetic oligonucleotide
aagcagguggaucuauuucauguuucc

SEQ ID NO: 5964 - RNA, 27 nt, Artificial Sequence
  Synthetic oligonucleotide
gcagguggaucuauuucauguuuuuac

SEQ ID NO: 5965 - RNA, 27 nt, Artificial Sequence
  Synthetic oligonucleotide
agguggaucuauuucauguuuuugaca

SEQ ID NO: 5966 - RNA, 27 nt, Artificial Sequence
  Synthetic oligonucleotide
guggaucuauuucauguuuuugauccc

SEQ ID NO: 5967 - RNA, 27 nt, Artificial Sequence
  Synthetic oligonucleotide
ggaucuauuucauguuuuugaucaacc

SEQ ID NO: 5968 - RNA, 27 nt, Artificial Sequence
  Synthetic oligonucleotide
ggguaggguaaaucaguaagaggugcc

SEQ ID NO: 5969 - RNA, 27 nt, Artificial Sequence
  Synthetic oligonucleotide
guaggguaaaucaguaagagguguucc

SEQ ID NO: 5970 - RNA, 27 nt, Artificial Sequence
  Synthetic oligonucleotide
aggguaaaucaguaagagguguuaucc

SEQ ID NO: 5971 - RNA, 27 nt, Artificial Sequence
  Synthetic oligonucleotide
gguaaaucaguaagagguguuauuuaa

SEQ ID NO: 5972 - RNA, 27 nt, Artificial Sequence
  Synthetic oligonucleotide
uaaaucaguaagagguguuauuuggcc

SEQ ID NO: 5973 - RNA, 27 nt, Artificial Sequence
  Synthetic oligonucleotide
aaucaguaagagguguuauuuggaaaa

SEQ ID NO: 5974 - RNA, 27 nt, Artificial Sequence
  Synthetic oligonucleotide
uuuaccaguugccuuuuaucccaaaac

SEQ ID NO: 5975 - RNA, 27 nt, Artificial Sequence
  Synthetic oligonucleotide
uaccaguugccuuuuaucccaaaguca

SEQ ID NO: 5976 - RNA, 27 nt, Artificial Sequence
  Synthetic oligonucleotide
ccaguugccuuuuaucccaaaguugcc

SEQ ID NO: 5977 - RNA, 27 nt, Artificial Sequence
  Synthetic oligonucleotide
aguugccuuuuaucccaaaguuguuac

SEQ ID NO: 5978 - RNA, 27 nt, Artificial Sequence
  Synthetic oligonucleotide
uugccuuuuaucccaaaguuguugucc

SEQ ID NO: 5979 - RNA, 27 nt, Artificial Sequence
  Synthetic oligonucleotide
gccuuuuaucccaaaguuguuguaaaa

SEQ ID NO: 5980 - RNA, 27 nt, Artificial Sequence
  Synthetic oligonucleotide
cuuuuaucccaaaguuguuguaaccca

SEQ ID NO: 5981 - RNA, 27 nt, Artificial Sequence
  Synthetic oligonucleotide
uuuaucccaaaguuguuguaaccugac

SEQ ID NO: 5982 - RNA, 27 nt, Artificial Sequence
  Synthetic oligonucleotide
uaucccaaaguuguuguaaccugcuac

SEQ ID NO: 5983 - RNA, 27 nt, Artificial Sequence
  Synthetic oligonucleotide
ucccaaaguuguuguaaccugcuguac

SEQ ID NO: 5984 - RNA, 27 nt, Artificial Sequence
  Synthetic oligonucleotide
ccaaaguuguuguaaccugcugugacc

SEQ ID NO: 5985 - RNA, 27 nt, Artificial Sequence
  Synthetic oligonucleotide
aaaguuguuguaaccugcugugauaaa

SEQ ID NO: 5986 - RNA, 27 nt, Artificial Sequence
  Synthetic oligonucleotide
aguuguuguaaccugcugugauacgcc

SEQ ID NO: 5987 - RNA, 27 nt, Artificial Sequence
  Synthetic oligonucleotide
uuguuguaaccugcugugauacgauaa

SEQ ID NO: 5988 - RNA, 27 nt, Artificial Sequence
  Synthetic oligonucleotide
aaaaaugguucagaauuaaacuuuucc

SEQ ID NO: 5989 - RNA, 27 nt, Artificial Sequence
  Synthetic oligonucleotide
aaaugguucagaauuaaacuuuuaacc

SEQ ID NO: 5990 - RNA, 27 nt, Artificial Sequence
  Synthetic oligonucleotide
augguucagaauuaaacuuuuaauuac

SEQ ID NO: 5991 - RNA, 27 nt, Artificial Sequence
  Synthetic oligonucleotide
gguucagaauuaaacuuuuaauucacc

SEQ ID NO: 5992 - RNA, 27 nt, Artificial Sequence
  Synthetic oligonucleotide
uucagaauuaaacuuuuaauucauuaa

SEQ ID NO: 5993 - RNA, 27 nt, Artificial Sequence
  Synthetic oligonucleotide
cagcagcagucuuacuuggauucugac

SEQ ID NO: 5994 - RNA, 27 nt, Artificial Sequence
  Synthetic oligonucleotide
uuacuuggauucuggaauccauucuaa

SEQ ID NO: 5995 - RNA, 27 nt, Artificial Sequence
  Synthetic oligonucleotide
uugacaccucccaaguccuuuaugacc

SEQ ID NO: 5996 - RNA, 27 nt, Artificial Sequence
  Synthetic oligonucleotide
cacgcaagagcaaguagcugauauuac

SEQ ID NO: 5997 - RNA, 27 nt, Artificial Sequence
  Synthetic oligonucleotide
ugccauguucccugagacgcuagauac

SEQ ID NO: 5998 - RNA, 27 nt, Artificial Sequence
  Synthetic oligonucleotide
guugaaacaugcaguugucaauuugcc

SEQ ID NO: 5999 - RNA, 27 nt, Artificial Sequence
  Synthetic oligonucleotide
aacaugcaguugucaauuugauuaaac

SEQ ID NO: 6000 - RNA, 27 nt, Artificial Sequence
  Synthetic oligonucleotide
caguugucaauuugauuaacuaucaaa

SEQ ID NO: 6001 - RNA, 27 nt, Artificial Sequence
  Synthetic oligonucleotide
augaggaccaggugguaguuaauaaca

SEQ ID NO: 6002 - RNA, 27 nt, Artificial Sequence
  Synthetic oligonucleotide
ugggucaccaguggauucuguacugcc

SEQ ID NO: 6003 - RNA, 27 nt, Artificial Sequence
  Synthetic oligonucleotide
accaguggauucuguacuguucuacaa

SEQ ID NO: 6004 - RNA, 27 nt, Artificial Sequence
  Synthetic oligonucleotide
uggauucuguacuguucuacgccauac

SEQ ID NO: 6005 - RNA, 27 nt, Artificial Sequence
  Synthetic oligonucleotide
ugguggacugcagaaaaugguugcucc

SEQ ID NO: 6006 - RNA, 27 nt, Artificial Sequence
  Synthetic oligonucleotide
aacgugaaauucuuggcuauuacaaac

SEQ ID NO: 6007 - RNA, 27 nt, Artificial Sequence
  Synthetic oligonucleotide
cccaagucagcgacuuguucaaaacca

SEQ ID NO: 6008 - RNA, 27 nt, Artificial Sequence
  Synthetic oligonucleotide
gcgacuuguucaaaacugucuuuggca

SEQ ID NO: 6009 - RNA, 27 nt, Artificial Sequence
  Synthetic oligonucleotide
caaaacugucuuuggacucucagaaca

SEQ ID NO: 6010 - RNA, 27 nt, Artificial Sequence
  Synthetic oligonucleotide
cucucuaaccucacuugcaauaauuca

SEQ ID NO: 6011 - RNA, 27 nt, Artificial Sequence
  Synthetic oligonucleotide
accucacuugcaauaauuacaaaaaac

SEQ ID NO: 6012 - RNA, 27 nt, Artificial Sequence
  Synthetic oligonucleotide
cagaaugccguucgccuucauuaugac

SEQ ID NO: 6013 - RNA, 27 nt, Artificial Sequence
  Synthetic oligonucleotide
ucgccuucauuauggacugccuguuac

SEQ ID NO: 6014 - RNA, 27 nt, Artificial Sequence
  Synthetic oligonucleotide
uucauuauggacugccuguuguggucc

SEQ ID NO: 6015 - RNA, 27 nt, Artificial Sequence
  Synthetic oligonucleotide
uggacugccuguugugguuaaacucac

SEQ ID NO: 6016 - RNA, 27 nt, Artificial Sequence
  Synthetic oligonucleotide
gcaacuguuggauugauucgaaacccc

SEQ ID NO: 6017 - RNA, 27 nt, Artificial Sequence
  Synthetic oligonucleotide
ccgaggacucaauaccauuccauugcc

SEQ ID NO: 6018 - RNA, 27 nt, Artificial Sequence
  Synthetic oligonucleotide
cugaggacaagccacaggauuacaaac

SEQ ID NO: 6019 - RNA, 27 nt, Artificial Sequence
  Synthetic oligonucleotide
ggauggacccuaugauggagcaugaac

SEQ ID NO: 6020 - RNA, 27 nt, Artificial Sequence
  Synthetic oligonucleotide
uugauacugaccuguaaaucguccucc

SEQ ID NO: 6021 - RNA, 27 nt, Artificial Sequence
  Synthetic oligonucleotide
agccagugugggugaauacuuuacuac

SEQ ID NO: 6022 - RNA, 27 nt, Artificial Sequence
  Synthetic oligonucleotide
ugccacagcuuuugcagcguuauacca

SEQ ID NO: 6023 - RNA, 27 nt, Artificial Sequence
  Synthetic oligonucleotide
gcuuuugcagcguuauacucagaugca

SEQ ID NO: 6024 - RNA, 27 nt, Artificial Sequence
  Synthetic oligonucleotide
cagcguuauacucagaugaguaacacc

SEQ ID NO: 6025 - RNA, 27 nt, Artificial Sequence
  Synthetic oligonucleotide
acauuugcuguuuucaacauuaauaaa

SEQ ID NO: 6026 - RNA, 27 nt, Artificial Sequence
  Synthetic oligonucleotide
agcuguagugucugaacgugcauugca

SEQ ID NO: 6027 - RNA, 27 nt, Artificial Sequence
  Synthetic oligonucleotide
gggaacagucgaaguacgcuuuuugcc

SEQ ID NO: 6028 - RNA, 27 nt, Artificial Sequence
  Synthetic oligonucleotide
cagucgaaguacgcuuuuuguucugac

SEQ ID NO: 6029 - RNA, 27 nt, Artificial Sequence
  Synthetic oligonucleotide
aaguacgcuuuuuguucugguccuucc

SEQ ID NO: 6030 - RNA, 27 nt, Artificial Sequence
  Synthetic oligonucleotide
acccuagccuugcuuguucuuuguucc

SEQ ID NO: 6031 - RNA, 27 nt, Artificial Sequence
  Synthetic oligonucleotide
agccuugcuuguucuuuguuuuaaucc

SEQ ID NO: 6032 - RNA, 27 nt, Artificial Sequence
  Synthetic oligonucleotide
ugaaccugcuacagcaauuucugaucc

SEQ ID NO: 6033 - RNA, 27 nt, Artificial Sequence
  Synthetic oligonucleotide
uacagcaauuucugauuucuaagaaaa

SEQ ID NO: 6034 - RNA, 27 nt, Artificial Sequence
  Synthetic oligonucleotide
caguaagagguguuauuugagccuuac

SEQ ID NO: 6035 - RNA, 27 nt, Artificial Sequence
  Synthetic oligonucleotide
gagguguuauuugagccuuguuuugac

SEQ ID NO: 6036 - RNA, 27 nt, Artificial Sequence
  Synthetic oligonucleotide
guuauuugagccuuguuuuggacagcc

SEQ ID NO: 6037 - RNA, 27 nt, Artificial Sequence
  Synthetic oligonucleotide
uugagccuuguuuuggacaguauacac

SEQ ID NO: 6038 - RNA, 27 nt, Artificial Sequence
  Synthetic oligonucleotide
uucaacagaugcgguuauagaaaugac

SEQ ID NO: 6039 - RNA, 27 nt, Artificial Sequence
  Synthetic oligonucleotide
cgguuauagaaaugguucagaauuacc

SEQ ID NO: 6040 - RNA, 27 nt, Artificial Sequence
  Synthetic oligonucleotide
auagaaaugguucagaauuaaacuucc

SEQ ID NO: 6041 - RNA, 27 nt, Artificial Sequence
  Synthetic oligonucleotide
guuguaugguauacuucaaauacccca

SEQ ID NO: 6042 - RNA, 27 nt, Artificial Sequence
  Synthetic oligonucleotide
caaaacaguuguaugguauacuucacc

SEQ ID NO: 6043 - RNA, 27 nt, Artificial Sequence
  Synthetic oligonucleotide
ucaaaacaguuguaugguauacuuccc

SEQ ID NO: 6044 - RNA, 27 nt, Artificial Sequence
  Synthetic oligonucleotide
uuucaaaacaguuguaugguauacuca

SEQ ID NO: 6045 - RNA, 27 nt, Artificial Sequence
  Synthetic oligonucleotide
uuuucaaaacaguuguaugguauaccc

SEQ ID NO: 6046 - RNA, 27 nt, Artificial Sequence
  Synthetic oligonucleotide
auuuucaaaacaguuguaugguauaac

SEQ ID NO: 6047 - RNA, 27 nt, Artificial Sequence
  Synthetic oligonucleotide
uuguccacgcuggauuuucaaaacaac

SEQ ID NO: 6048 - RNA, 27 nt, Artificial Sequence
  Synthetic oligonucleotide
auuguccacgcuggauuuucaaaacca

SEQ ID NO: 6049 - RNA, 27 nt, Artificial Sequence
  Synthetic oligonucleotide
ccaucaaaucagcuugaguagccauca

SEQ ID NO: 6050 - RNA, 27 nt, Artificial Sequence
  Synthetic oligonucleotide
uguccaacuccaucaaaucagcuugca

SEQ ID NO: 6051 - RNA, 27 nt, Artificial Sequence
  Synthetic oligonucleotide
cuuccucaggauugccuuuaccacuac

SEQ ID NO: 6052 - RNA, 27 nt, Artificial Sequence
  Synthetic oligonucleotide
ucuuccucaggauugccuuuaccacca

SEQ ID NO: 6053 - RNA, 27 nt, Artificial Sequence
  Synthetic oligonucleotide
caucaauaucagcuacuuguucuugca

SEQ ID NO: 6054 - RNA, 27 nt, Artificial Sequence
  Synthetic oligonucleotide
ccaucaauaucagcuacuuguucuuac

SEQ ID NO: 6055 - RNA, 27 nt, Artificial Sequence
  Synthetic oligonucleotide
acuguccaucaauaucagcuacuugcc

SEQ ID NO: 6056 - RNA, 27 nt, Artificial Sequence
  Synthetic oligonucleotide
auugcauacuguccaucaauaucagac

SEQ ID NO: 6057 - RNA, 27 nt, Artificial Sequence
  Synthetic oligonucleotide
cgagucauugcauacuguccaucaacc

SEQ ID NO: 6058 - RNA, 27 nt, Artificial Sequence
  Synthetic oligonucleotide
ccucaucuaaugucucagggaacauca

SEQ ID NO: 6059 - RNA, 27 nt, Artificial Sequence
  Synthetic oligonucleotide
uuacaacugcauguuucagcaucugca

SEQ ID NO: 6060 - RNA, 27 nt, Artificial Sequence
  Synthetic oligonucleotide
guuuacaacugcauguuucagcaucca

SEQ ID NO: 6061 - RNA, 27 nt, Artificial Sequence
  Synthetic oligonucleotide
aguuaaucaaguuuacaacugcaugcc

SEQ ID NO: 6062 - RNA, 27 nt, Artificial Sequence
  Synthetic oligonucleotide
cuugauaguuaaucaaguuuacaacca

SEQ ID NO: 6063 - RNA, 27 nt, Artificial Sequence
  Synthetic oligonucleotide
cugcaucaucuugauaguuaaucaaac

SEQ ID NO: 6064 - RNA, 27 nt, Artificial Sequence
  Synthetic oligonucleotide
ucugcaucaucuugauaguuaaucaca

SEQ ID NO: 6065 - RNA, 27 nt, Artificial Sequence
  Synthetic oligonucleotide
cugguccucgucauuuagcaguuuuac

SEQ ID NO: 6066 - RNA, 27 nt, Artificial Sequence
  Synthetic oligonucleotide
cauaacugcagccuuauuaaccaccca

SEQ ID NO: 6067 - RNA, 27 nt, Artificial Sequence
  Synthetic oligonucleotide
ccauaacugcagccuuauuaaccacac

SEQ ID NO: 6068 - RNA, 27 nt, Artificial Sequence
  Synthetic oligonucleotide
ggaccauaacugcagccuuauuaacac

SEQ ID NO: 6069 - RNA, 27 nt, Artificial Sequence
  Synthetic oligonucleotide
ccuuuuuagaaagcugauggaccaucc

SEQ ID NO: 6070 - RNA, 27 nt, Artificial Sequence
  Synthetic oligonucleotide
augguacguacaauagcagacaccaca

SEQ ID NO: 6071 - RNA, 27 nt, Artificial Sequence
  Synthetic oligonucleotide
caucauuuguauucugcaugguacgcc

SEQ ID NO: 6072 - RNA, 27 nt, Artificial Sequence
  Synthetic oligonucleotide
cuguuucuacaucauuuguauucugac

SEQ ID NO: 6073 - RNA, 27 nt, Artificial Sequence
  Synthetic oligonucleotide
gcuguuucuacaucauuuguauucuaa

SEQ ID NO: 6074 - RNA, 27 nt, Artificial Sequence
  Synthetic oligonucleotide
guacaacgagcuguuucuacaucaucc

SEQ ID NO: 6075 - RNA, 27 nt, Artificial Sequence
  Synthetic oligonucleotide
cgguacaacgagcuguuucuacauccc

SEQ ID NO: 6076 - RNA, 27 nt, Artificial Sequence
  Synthetic oligonucleotide
gcgguacaacgagcuguuucuacauac

SEQ ID NO: 6077 - RNA, 27 nt, Artificial Sequence
  Synthetic oligonucleotide
gcauaaaacaacacagaauccacugac

SEQ ID NO: 6078 - RNA, 27 nt, Artificial Sequence
  Synthetic oligonucleotide
uggcauaaaacaacacagaauccacca

SEQ ID NO: 6079 - RNA, 27 nt, Artificial Sequence
  Synthetic oligonucleotide
auggcauaaaacaacacagaauccaac

SEQ ID NO: 6080 - RNA, 27 nt, Artificial Sequence
  Synthetic oligonucleotide
uagcuccuucuugauguaauaaaagac

SEQ ID NO: 6081 - RNA, 27 nt, Artificial Sequence
  Synthetic oligonucleotide
uuagcuccuucuugauguaauaaaaaa

SEQ ID NO: 6082 - RNA, 27 nt, Artificial Sequence
  Synthetic oligonucleotide
uuuaacauuuguuuuguugagcaagaa

SEQ ID NO: 6083 - RNA, 27 nt, Artificial Sequence
  Synthetic oligonucleotide
uagccaagaauuuaacauuuguuuuac

SEQ ID NO: 6084 - RNA, 27 nt, Artificial Sequence
  Synthetic oligonucleotide
cguaauagccaagaauuuaacauuuac

SEQ ID NO: 6085 - RNA, 27 nt, Artificial Sequence
  Synthetic oligonucleotide
ucguaauagccaagaauuuaacauuca

SEQ ID NO: 6086 - RNA, 27 nt, Artificial Sequence
  Synthetic oligonucleotide
uaagcuaaaauuugaaggcagucugca

SEQ ID NO: 6087 - RNA, 27 nt, Artificial Sequence
  Synthetic oligonucleotide
uagguccucauuauauuuacuaaagac

SEQ ID NO: 6088 - RNA, 27 nt, Artificial Sequence
  Synthetic oligonucleotide
aaguauagguccucauuauauuuaccc

SEQ ID NO: 6089 - RNA, 27 nt, Artificial Sequence
  Synthetic oligonucleotide
uaaguauagguccucauuauauuuaac

SEQ ID NO: 6090 - RNA, 27 nt, Artificial Sequence
  Synthetic oligonucleotide
guuuuucguaaguauagguccucaucc

SEQ ID NO: 6091 - RNA, 27 nt, Artificial Sequence
  Synthetic oligonucleotide
aguuuuucguaaguauagguccucacc

SEQ ID NO: 6092 - RNA, 27 nt, Artificial Sequence
  Synthetic oligonucleotide
uaguuuuucguaaguauagguccuccc

SEQ ID NO: 6093 - RNA, 27 nt, Artificial Sequence
  Synthetic oligonucleotide
guaguuuuucguaaguauagguccuac

SEQ ID NO: 6094 - RNA, 27 nt, Artificial Sequence
  Synthetic oligonucleotide
gugguccacaguaguuuuucguaagcc

SEQ ID NO: 6095 - RNA, 27 nt, Artificial Sequence
  Synthetic oligonucleotide
ucuacaauagccggcuuauuacuagca

SEQ ID NO: 6096 - RNA, 27 nt, Artificial Sequence
  Synthetic oligonucleotide
cuucuacaauagccggcuuauuacuca

SEQ ID NO: 6097 - RNA, 27 nt, Artificial Sequence
  Synthetic oligonucleotide
aguccuaaagcuugcauuccaccagac

SEQ ID NO: 6098 - RNA, 27 nt, Artificial Sequence
  Synthetic oligonucleotide
aaguccuaaagcuugcauuccaccaaa

SEQ ID NO: 6099 - RNA, 27 nt, Artificial Sequence
  Synthetic oligonucleotide
gaaguccuaaagcuugcauuccaccca

SEQ ID NO: 6100 - RNA, 27 nt, Artificial Sequence
  Synthetic oligonucleotide
caguucugaacaagacguugacuugac

SEQ ID NO: 6101 - RNA, 27 nt, Artificial Sequence
  Synthetic oligonucleotide
acaguucugaacaagacguugacuuaa

SEQ ID NO: 6102 - RNA, 27 nt, Artificial Sequence
  Synthetic oligonucleotide
gaguccaaagacaguucugaacaagca

SEQ ID NO: 6103 - RNA, 27 nt, Artificial Sequence
  Synthetic oligonucleotide
ccuuccuguuuaguugcagcaucugcc

SEQ ID NO: 6104 - RNA, 27 nt, Artificial Sequence
  Synthetic oligonucleotide
ccacauuuauaucaucugaacccagcc

SEQ ID NO: 6105 - RNA, 27 nt, Artificial Sequence
  Synthetic oligonucleotide
ugaccacauuuauaucaucugaaccac

SEQ ID NO: 6106 - RNA, 27 nt, Artificial Sequence
  Synthetic oligonucleotide
cugcacaggugaccacauuuauauccc

SEQ ID NO: 6107 - RNA, 27 nt, Artificial Sequence
  Synthetic oligonucleotide
gcugcacaggugaccacauuuauauac

SEQ ID NO: 6108 - RNA, 27 nt, Artificial Sequence
  Synthetic oligonucleotide
auugcaagugagguuagaaagaauuaa

SEQ ID NO: 6109 - RNA, 27 nt, Artificial Sequence
  Synthetic oligonucleotide
uuauaauuauugcaagugagguuagcc

SEQ ID NO: 6110 - RNA, 27 nt, Artificial Sequence
  Synthetic oligonucleotide
caucaucuuguucuuauaauuauugac

SEQ ID NO: 6111 - RNA, 27 nt, Artificial Sequence
  Synthetic oligonucleotide
ccaucaucuuguucuuauaauuauuaa

SEQ ID NO: 6112 - RNA, 27 nt, Artificial Sequence
  Synthetic oligonucleotide
agaccaucaucuuguucuuauaauucc

SEQ ID NO: 6113 - RNA, 27 nt, Artificial Sequence
  Synthetic oligonucleotide
gcagaccaucaucuuguucuuauaacc

SEQ ID NO: 6114 - RNA, 27 nt, Artificial Sequence
  Synthetic oligonucleotide
ucaauccaacaguagccuuuaucagca

SEQ ID NO: 6115 - RNA, 27 nt, Artificial Sequence
  Synthetic oligonucleotide
ucgaaucaauccaacaguagccuuucc

SEQ ID NO: 6116 - RNA, 27 nt, Artificial Sequence
  Synthetic oligonucleotide
ccuccacaaauugcugcugugucccca

SEQ ID NO: 6117 - RNA, 27 nt, Artificial Sequence
  Synthetic oligonucleotide
guacaaccuucaacuauuucuuccaca

SEQ ID NO: 6118 - RNA, 27 nt, Artificial Sequence
  Synthetic oligonucleotide
gguacaaccuucaacuauuucuucccc

SEQ ID NO: 6119 - RNA, 27 nt, Artificial Sequence
  Synthetic oligonucleotide
cgguacaaccuucaacuauuucuucac

SEQ ID NO: 6120 - RNA, 27 nt, Artificial Sequence
  Synthetic oligonucleotide
ccgguacaaccuucaacuauuucuuaa

SEQ ID NO: 6121 - RNA, 27 nt, Artificial Sequence
  Synthetic oligonucleotide
gggcuccgguacaaccuucaacuaucc

SEQ ID NO: 6122 - RNA, 27 nt, Artificial Sequence
  Synthetic oligonucleotide
uaacaauucgguugugaacaucccgca

SEQ ID NO: 6123 - RNA, 27 nt, Artificial Sequence
  Synthetic oligonucleotide
auaacaauucgguugugaacaucccac

SEQ ID NO: 6124 - RNA, 27 nt, Artificial Sequence
  Synthetic oligonucleotide
gauaacaauucgguugugaacauccaa

SEQ ID NO: 6125 - RNA, 27 nt, Artificial Sequence
  Synthetic oligonucleotide
ugauaacaauucgguugugaacaucaa

SEQ ID NO: 6126 - RNA, 27 nt, Artificial Sequence
  Synthetic oligonucleotide
cugauaacaauucgguugugaacauaa

SEQ ID NO: 6127 - RNA, 27 nt, Artificial Sequence
  Synthetic oligonucleotide
ucugauaacaauucgguugugaacaca

SEQ ID NO: 6128 - RNA, 27 nt, Artificial Sequence
  Synthetic oligonucleotide
guauuuaguccucugauaacaauucaa

SEQ ID NO: 6129 - RNA, 27 nt, Artificial Sequence
  Synthetic oligonucleotide
gguauuuaguccucugauaacaauuaa

SEQ ID NO: 6130 - RNA, 27 nt, Artificial Sequence
  Synthetic oligonucleotide
ugguauuuaguccucugauaacaauca

SEQ ID NO: 6131 - RNA, 27 nt, Artificial Sequence
  Synthetic oligonucleotide
augguauuuaguccucugauaacaacc

SEQ ID NO: 6132 - RNA, 27 nt, Artificial Sequence
  Synthetic oligonucleotide
aaacaauggaaugguauuuaguccuac

SEQ ID NO: 6133 - RNA, 27 nt, Artificial Sequence
  Synthetic oligonucleotide
gcacaaacaauggaaugguauuuagca

SEQ ID NO: 6134 - RNA, 27 nt, Artificial Sequence
  Synthetic oligonucleotide
cugcacaaacaauggaaugguauuuca

SEQ ID NO: 6135 - RNA, 27 nt, Artificial Sequence
  Synthetic oligonucleotide
gcugcacaaacaauggaaugguauucc

SEQ ID NO: 6136 - RNA, 27 nt, Artificial Sequence
  Synthetic oligonucleotide
cagcuacucuuuggauguuuucaauaa

SEQ ID NO: 6137 - RNA, 27 nt, Artificial Sequence
  Synthetic oligonucleotide
gcagcuacucuuuggauguuuucaaca

SEQ ID NO: 6138 - RNA, 27 nt, Artificial Sequence
  Synthetic oligonucleotide
cagcuucaauagcuucugcagcuucac

SEQ ID NO: 6139 - RNA, 27 nt, Artificial Sequence
  Synthetic oligonucleotide
gcucccucagcuucaauagcuucugac

SEQ ID NO: 6140 - RNA, 27 nt, Artificial Sequence
  Synthetic oligonucleotide
uggcucccucagcuucaauagcuucca

SEQ ID NO: 6141 - RNA, 27 nt, Artificial Sequence
  Synthetic oligonucleotide
ucauuccuagagugaaguaacucugca

SEQ ID NO: 6142 - RNA, 27 nt, Artificial Sequence
  Synthetic oligonucleotide
cuucauuccuagagugaaguaacucca

SEQ ID NO: 6143 - RNA, 27 nt, Artificial Sequence
  Synthetic oligonucleotide
ccuucauuccuagagugaaguaacuac

SEQ ID NO: 6144 - RNA, 27 nt, Artificial Sequence
  Synthetic oligonucleotide
uguccucagacauucggaacaaaacca

SEQ ID NO: 6145 - RNA, 27 nt, Artificial Sequence
  Synthetic oligonucleotide
cuuguccucagacauucggaacaaaca

SEQ ID NO: 6146 - RNA, 27 nt, Artificial Sequence
  Synthetic oligonucleotide
ccguuucuuguaaucuuguggcuugca

SEQ ID NO: 6147 - RNA, 27 nt, Artificial Sequence
  Synthetic oligonucleotide
acugaaagccguuucuuguaaucuuac

SEQ ID NO: 6148 - RNA, 27 nt, Artificial Sequence
  Synthetic oligonucleotide
cagcucaacugaaagccguuucuugcc

SEQ ID NO: 6149 - RNA, 27 nt, Artificial Sequence
  Synthetic oligonucleotide
caaguccaagaucagcagucucauuaa

SEQ ID NO: 6150 - RNA, 27 nt, Artificial Sequence
  Synthetic oligonucleotide
gcaccaauaucaaguccaagaucagac

SEQ ID NO: 6151 - RNA, 27 nt, Artificial Sequence
  Synthetic oligonucleotide
aaagaacgauagcuaggaucauccuaa

SEQ ID NO: 6152 - RNA, 27 nt, Artificial Sequence
  Synthetic oligonucleotide
cauauccaccagagugaaaagaacgcc

SEQ ID NO: 6153 - RNA, 27 nt, Artificial Sequence
  Synthetic oligonucleotide
ugauuuacaggucaguaucaaaccaaa

SEQ ID NO: 6154 - RNA, 27 nt, Artificial Sequence
  Synthetic oligonucleotide
augauuuacaggucaguaucaaaccca

SEQ ID NO: 6155 - RNA, 27 nt, Artificial Sequence
  Synthetic oligonucleotide
gaugauuuacaggucaguaucaaacac

SEQ ID NO: 6156 - RNA, 27 nt, Artificial Sequence
  Synthetic oligonucleotide
cuucuuaccuaaaggaugauuuacaaa

SEQ ID NO: 6157 - RNA, 27 nt, Artificial Sequence
  Synthetic oligonucleotide
acuucuuaccuaaaggaugauuuacca

SEQ ID NO: 6158 - RNA, 27 nt, Artificial Sequence
  Synthetic oligonucleotide
aaacuucuuaccuaaaggaugauuuca

SEQ ID NO: 6159 - RNA, 27 nt, Artificial Sequence
  Synthetic oligonucleotide
gcuuuuuaaaacuucuuaccuaaagac

SEQ ID NO: 6160 - RNA, 27 nt, Artificial Sequence
  Synthetic oligonucleotide
uggcuuuuuaaaacuucuuaccuaaca

SEQ ID NO: 6161 - RNA, 27 nt, Artificial Sequence
  Synthetic oligonucleotide
ccaaacuggcuuuuuaaaacuucuuca

SEQ ID NO: 6162 - RNA, 27 nt, Artificial Sequence
  Synthetic oligonucleotide
uuacccaaacuggcuuuuuaaaacuca

SEQ ID NO: 6163 - RNA, 27 nt, Artificial Sequence
  Synthetic oligonucleotide
uuuacccaaacuggcuuuuuaaaaccc

SEQ ID NO: 6164 - RNA, 27 nt, Artificial Sequence
  Synthetic oligonucleotide
uuuuacccaaacuggcuuuuuaaaaac

SEQ ID NO: 6165 - RNA, 27 nt, Artificial Sequence
  Synthetic oligonucleotide
auuuuacccaaacuggcuuuuuaaaca

SEQ ID NO: 6166 - RNA, 27 nt, Artificial Sequence
  Synthetic oligonucleotide
ccaaccaagucuuucugaaguucugcc

SEQ ID NO: 6167 - RNA, 27 nt, Artificial Sequence
  Synthetic oligonucleotide
ccacccuaccaaccaagucuuucugcc

SEQ ID NO: 6168 - RNA, 27 nt, Artificial Sequence
  Synthetic oligonucleotide
auuuacaaauagccuaaaccacuccac

SEQ ID NO: 6169 - RNA, 27 nt, Artificial Sequence
  Synthetic oligonucleotide
gauuuacaaauagccuaaaccacucaa

SEQ ID NO: 6170 - RNA, 27 nt, Artificial Sequence
  Synthetic oligonucleotide
agauuuacaaauagccuaaaccacuaa

SEQ ID NO: 6171 - RNA, 27 nt, Artificial Sequence
  Synthetic oligonucleotide
cagauuuacaaauagccuaaaccacca

SEQ ID NO: 6172 - RNA, 27 nt, Artificial Sequence
  Synthetic oligonucleotide
uguuuuuguggcagauuuacaaauaaa

SEQ ID NO: 6173 - RNA, 27 nt, Artificial Sequence
  Synthetic oligonucleotide
cuguuuuuguggcagauuuacaaauca

SEQ ID NO: 6174 - RNA, 27 nt, Artificial Sequence
  Synthetic oligonucleotide
ccuguuuuuguggcagauuuacaaacc

SEQ ID NO: 6175 - RNA, 27 nt, Artificial Sequence
  Synthetic oligonucleotide
auauaccuguuuuuguggcagauuuca

SEQ ID NO: 6176 - RNA, 27 nt, Artificial Sequence
  Synthetic oligonucleotide
cuuucaaaguauauaccuguuuuugca

SEQ ID NO: 6177 - RNA, 27 nt, Artificial Sequence
  Synthetic oligonucleotide
caucuccuuucaaaguauauaccugcc

SEQ ID NO: 6178 - RNA, 27 nt, Artificial Sequence
  Synthetic oligonucleotide
acaucuccuuucaaaguauauaccuac

SEQ ID NO: 6179 - RNA, 27 nt, Artificial Sequence
  Synthetic oligonucleotide
agacaucuccuuucaaaguauauacac

SEQ ID NO: 6180 - RNA, 27 nt, Artificial Sequence
  Synthetic oligonucleotide
aagacaucuccuuucaaaguauauaaa

SEQ ID NO: 6181 - RNA, 27 nt, Artificial Sequence
  Synthetic oligonucleotide
caagacaucuccuuucaaaguauauca

SEQ ID NO: 6182 - RNA, 27 nt, Artificial Sequence
  Synthetic oligonucleotide
uguuccaagacaucuccuuucaaagcc

SEQ ID NO: 6183 - RNA, 27 nt, Artificial Sequence
  Synthetic oligonucleotide
cauuccaauguuccaagacaucucccc

SEQ ID NO: 6184 - RNA, 27 nt, Artificial Sequence
  Synthetic oligonucleotide
acauuccaauguuccaagacaucucac

SEQ ID NO: 6185 - RNA, 27 nt, Artificial Sequence
  Synthetic oligonucleotide
gaacauuccaauguuccaagacaucca

SEQ ID NO: 6186 - RNA, 27 nt, Artificial Sequence
  Synthetic oligonucleotide
ccagaaaucugagaacauuccaaugcc

SEQ ID NO: 6187 - RNA, 27 nt, Artificial Sequence
  Synthetic oligonucleotide
acaaccagaaaucugagaacauucccc

SEQ ID NO: 6188 - RNA, 27 nt, Artificial Sequence
  Synthetic oligonucleotide
uaacaaccagaaaucugagaacauuaa

SEQ ID NO: 6189 - RNA, 27 nt, Artificial Sequence
  Synthetic oligonucleotide
auaacaaccagaaaucugagaacauca

SEQ ID NO: 6190 - RNA, 27 nt, Artificial Sequence
  Synthetic oligonucleotide
cauaacaaccagaaaucugagaacacc

SEQ ID NO: 6191 - RNA, 27 nt, Artificial Sequence
  Synthetic oligonucleotide
ugaucacauaacaaccagaaaucugca

SEQ ID NO: 6192 - RNA, 27 nt, Artificial Sequence
  Synthetic oligonucleotide
augaucacauaacaaccagaaaucuac

SEQ ID NO: 6193 - RNA, 27 nt, Artificial Sequence
  Synthetic oligonucleotide
ccacacaugaucacauaacaaccagcc

SEQ ID NO: 6194 - RNA, 27 nt, Artificial Sequence
  Synthetic oligonucleotide
cuuccacacaugaucacauaacaacac

SEQ ID NO: 6195 - RNA, 27 nt, Artificial Sequence
  Synthetic oligonucleotide
aauaacuuccacacaugaucacauaca

SEQ ID NO: 6196 - RNA, 27 nt, Artificial Sequence
  Synthetic oligonucleotide
uaauaacuuccacacaugaucacaucc

SEQ ID NO: 6197 - RNA, 27 nt, Artificial Sequence
  Synthetic oligonucleotide
uuaauaacuuccacacaugaucacacc

SEQ ID NO: 6198 - RNA, 27 nt, Artificial Sequence
  Synthetic oligonucleotide
guuaauaacuuccacacaugaucaccc

SEQ ID NO: 6199 - RNA, 27 nt, Artificial Sequence
  Synthetic oligonucleotide
cauuaaaguuaauaacuuccacacaca

SEQ ID NO: 6200 - RNA, 27 nt, Artificial Sequence
  Synthetic oligonucleotide
acauuaaaguuaauaacuuccacaccc

SEQ ID NO: 6201 - RNA, 27 nt, Artificial Sequence
  Synthetic oligonucleotide
aaacauuaaaguuaauaacuuccacca

SEQ ID NO: 6202 - RNA, 27 nt, Artificial Sequence
  Synthetic oligonucleotide
aaaacauuaaaguuaauaacuuccaac

SEQ ID NO: 6203 - RNA, 27 nt, Artificial Sequence
  Synthetic oligonucleotide
aaaaacauuaaaguuaauaacuuccca

SEQ ID NO: 6204 - RNA, 27 nt, Artificial Sequence
  Synthetic oligonucleotide
aaaaaacauuaaaguuaauaacuucac

SEQ ID NO: 6205 - RNA, 27 nt, Artificial Sequence
  Synthetic oligonucleotide
caaaaaacauuaaaguuaauaacuuaa

SEQ ID NO: 6206 - RNA, 27 nt, Artificial Sequence
  Synthetic oligonucleotide
gcaaaaaacauuaaaguuaauaacuca

SEQ ID NO: 6207 - RNA, 27 nt, Artificial Sequence
  Synthetic oligonucleotide
uggcaaaaaacauuaaaguuaauaaac

SEQ ID NO: 6208 - RNA, 27 nt, Artificial Sequence
  Synthetic oligonucleotide
guggcaaaaaacauuaaaguuaauaca

SEQ ID NO: 6209 - RNA, 27 nt, Artificial Sequence
  Synthetic oligonucleotide
uugcaaaagcuguggcaaaaaacaucc

SEQ ID NO: 6210 - RNA, 27 nt, Artificial Sequence
  Synthetic oligonucleotide
guugcaaaagcuguggcaaaaaacacc

SEQ ID NO: 6211 - RNA, 27 nt, Artificial Sequence
  Synthetic oligonucleotide
acucauuugaguauuaaguugcaaaca

SEQ ID NO: 6212 - RNA, 27 nt, Artificial Sequence
  Synthetic oligonucleotide
uuaaaacagcaaauguuacucauuuac

SEQ ID NO: 6213 - RNA, 27 nt, Artificial Sequence
  Synthetic oligonucleotide
uuuaaaacagcaaauguuacucauuca

SEQ ID NO: 6214 - RNA, 27 nt, Artificial Sequence
  Synthetic oligonucleotide
guuuaaaacagcaaauguuacucaucc

SEQ ID NO: 6215 - RNA, 27 nt, Artificial Sequence
  Synthetic oligonucleotide
uguuuaaaacagcaaauguuacucacc

SEQ ID NO: 6216 - RNA, 27 nt, Artificial Sequence
  Synthetic oligonucleotide
auguuuaaaacagcaaauguuacuccc

SEQ ID NO: 6217 - RNA, 27 nt, Artificial Sequence
  Synthetic oligonucleotide
aauguuuaaaacagcaaauguuacuac

SEQ ID NO: 6218 - RNA, 27 nt, Artificial Sequence
  Synthetic oligonucleotide
cuauuaauguuuaaaacagcaaaugcc

SEQ ID NO: 6219 - RNA, 27 nt, Artificial Sequence
  Synthetic oligonucleotide
agagaaaggcugcuauuaauguuuacc

SEQ ID NO: 6220 - RNA, 27 nt, Artificial Sequence
  Synthetic oligonucleotide
caaguucagacaauacagcuguauacc

SEQ ID NO: 6221 - RNA, 27 nt, Artificial Sequence
  Synthetic oligonucleotide
ucacaaugcaaguucagacaauacaaa

SEQ ID NO: 6222 - RNA, 27 nt, Artificial Sequence
  Synthetic oligonucleotide
aaucacaaugcaaguucagacaauaac

SEQ ID NO: 6223 - RNA, 27 nt, Artificial Sequence
  Synthetic oligonucleotide
ccaaucacaaugcaaguucagacaacc

SEQ ID NO: 6224 - RNA, 27 nt, Artificial Sequence
  Synthetic oligonucleotide
caggccaaucacaaugcaaguucagca

SEQ ID NO: 6225 - RNA, 27 nt, Artificial Sequence
  Synthetic oligonucleotide
uuguucccauaggaaacucagcuugac

SEQ ID NO: 6226 - RNA, 27 nt, Artificial Sequence
  Synthetic oligonucleotide
cuucaauuguucccauaggaaacucca

SEQ ID NO: 6227 - RNA, 27 nt, Artificial Sequence
  Synthetic oligonucleotide
acuucaauuguucccauaggaaacuac

SEQ ID NO: 6228 - RNA, 27 nt, Artificial Sequence
  Synthetic oligonucleotide
aaguuuacuucaauuguucccauagac

SEQ ID NO: 6229 - RNA, 27 nt, Artificial Sequence
  Synthetic oligonucleotide
aaaguuuacuucaauuguucccauaaa

SEQ ID NO: 6230 - RNA, 27 nt, Artificial Sequence
  Synthetic oligonucleotide
acaaaaaguuuacuucaauuguuccac

SEQ ID NO: 6231 - RNA, 27 nt, Artificial Sequence
  Synthetic oligonucleotide
cagaacaaaaaguuuacuucaauugcc

SEQ ID NO: 6232 - RNA, 27 nt, Artificial Sequence
  Synthetic oligonucleotide
aggaccagaacaaaaaguuuacuuccc

SEQ ID NO: 6233 - RNA, 27 nt, Artificial Sequence
  Synthetic oligonucleotide
aaggaccagaacaaaaaguuuacuuac

SEQ ID NO: 6234 - RNA, 27 nt, Artificial Sequence
  Synthetic oligonucleotide
cgaccaaaaaggaccagaacaaaaaac

SEQ ID NO: 6235 - RNA, 27 nt, Artificial Sequence
  Synthetic oligonucleotide
ucgaccaaaaaggaccagaacaaaaca

SEQ ID NO: 6236 - RNA, 27 nt, Artificial Sequence
  Synthetic oligonucleotide
uuacuccucgaccaaaaaggaccagcc

SEQ ID NO: 6237 - RNA, 27 nt, Artificial Sequence
  Synthetic oligonucleotide
aauccauuuguauuguuacuccucgca

SEQ ID NO: 6238 - RNA, 27 nt, Artificial Sequence
  Synthetic oligonucleotide
aaauccauuuguauuguuacuccucac

SEQ ID NO: 6239 - RNA, 27 nt, Artificial Sequence
  Synthetic oligonucleotide
aaaauccauuuguauuguuacuccuaa

SEQ ID NO: 6240 - RNA, 27 nt, Artificial Sequence
  Synthetic oligonucleotide
caaaauccauuuguauuguuacuccca

SEQ ID NO: 6241 - RNA, 27 nt, Artificial Sequence
  Synthetic oligonucleotide
ccaaaauccauuuguauuguuacucac

SEQ ID NO: 6242 - RNA, 27 nt, Artificial Sequence
  Synthetic oligonucleotide
ucacucccaaaauccauuuguauugcc

SEQ ID NO: 6243 - RNA, 27 nt, Artificial Sequence
  Synthetic oligonucleotide
ucuucacuucuugagucacucccaacc

SEQ ID NO: 6244 - RNA, 27 nt, Artificial Sequence
  Synthetic oligonucleotide
auucuucacuucuugagucacuccccc

SEQ ID NO: 6245 - RNA, 27 nt, Artificial Sequence
  Synthetic oligonucleotide
cauucuucacuucuugagucacuccac

SEQ ID NO: 6246 - RNA, 27 nt, Artificial Sequence
  Synthetic oligonucleotide
gcauucuucacuucuugagucacucaa

SEQ ID NO: 6247 - RNA, 27 nt, Artificial Sequence
  Synthetic oligonucleotide
gugcauucuucacuucuugagucacca

SEQ ID NO: 6248 - RNA, 27 nt, Artificial Sequence
  Synthetic oligonucleotide
ccauucuugugcauucuucacuucuca

SEQ ID NO: 6249 - RNA, 27 nt, Artificial Sequence
  Synthetic oligonucleotide
gauccauucuugugcauucuucacuca

SEQ ID NO: 6250 - RNA, 27 nt, Artificial Sequence
  Synthetic oligonucleotide
ugauccauucuugugcauucuucaccc

SEQ ID NO: 6251 - RNA, 27 nt, Artificial Sequence
  Synthetic oligonucleotide
gugauccauucuugugcauucuucaac

SEQ ID NO: 6252 - RNA, 27 nt, Artificial Sequence
  Synthetic oligonucleotide
uaaauuccaucuugugauccauucuca

SEQ ID NO: 6253 - RNA, 27 nt, Artificial Sequence
  Synthetic oligonucleotide
gauaaauuccaucuugugauccauuac

SEQ ID NO: 6254 - RNA, 27 nt, Artificial Sequence
  Synthetic oligonucleotide
ugauaaauuccaucuugugauccauca

SEQ ID NO: 6255 - RNA, 27 nt, Artificial Sequence
  Synthetic oligonucleotide
uugauaaauuccaucuugugauccacc

SEQ ID NO: 6256 - RNA, 27 nt, Artificial Sequence
  Synthetic oligonucleotide
uuugauaaauuccaucuugugaucccc

SEQ ID NO: 6257 - RNA, 27 nt, Artificial Sequence
  Synthetic oligonucleotide
aaggcuaggguuugauaaauuccauac

SEQ ID NO: 6258 - RNA, 27 nt, Artificial Sequence
  Synthetic oligonucleotide
aaaaaaauuuaacaagcaaggcuagaa

SEQ ID NO: 6259 - RNA, 27 nt, Artificial Sequence
  Synthetic oligonucleotide
aaaaaaaaaaaaaaaauuuaacaagac

SEQ ID NO: 6260 - RNA, 27 nt, Artificial Sequence
  Synthetic oligonucleotide
aaaaaaaaaaaaaaaaauuuaacaaaa

SEQ ID NO: 6261 - RNA, 27 nt, Artificial Sequence
  Synthetic oligonucleotide
aaaaaaaaaaaaaaaaaauuuaacaca

SEQ ID NO: 6262 - RNA, 27 nt, Artificial Sequence
  Synthetic oligonucleotide
aaaaaaaaaaaaaaaaaaauuuaaccc

SEQ ID NO: 6263 - RNA, 27 nt, Artificial Sequence
  Synthetic oligonucleotide
uaaaaaaaaaaaaaaaaaaauuuaaac

SEQ ID NO: 6264 - RNA, 27 nt, Artificial Sequence
  Synthetic oligonucleotide
uuaaaaaaaaaaaaaaaaaaauuuaca

SEQ ID NO: 6265 - RNA, 27 nt, Artificial Sequence
  Synthetic oligonucleotide
cuuaaaaaaaaaaaaaaaaaaauuucc

SEQ ID NO: 6266 - RNA, 27 nt, Artificial Sequence
  Synthetic oligonucleotide
ucuuaaaaaaaaaaaaaaaaaaauucc

SEQ ID NO: 6267 - RNA, 27 nt, Artificial Sequence
  Synthetic oligonucleotide
auucuuaaaaaaaaaaaaaaaaaaacc

SEQ ID NO: 6268 - RNA, 27 nt, Artificial Sequence
  Synthetic oligonucleotide
uauucuuaaaaaaaaaaaaaaaaaacc

SEQ ID NO: 6269 - RNA, 27 nt, Artificial Sequence
  Synthetic oligonucleotide
auauucuuaaaaaaaaaaaaaaaaacc

SEQ ID NO: 6270 - RNA, 27 nt, Artificial Sequence
  Synthetic oligonucleotide
gauauucuuaaaaaaaaaaaaaaaacc

SEQ ID NO: 6271 - RNA, 27 nt, Artificial Sequence
  Synthetic oligonucleotide
agauauucuuaaaaaaaaaaaaaaacc

SEQ ID NO: 6272 - RNA, 27 nt, Artificial Sequence
  Synthetic oligonucleotide
cagauauucuuaaaaaaaaaaaaaacc

SEQ ID NO: 6273 - RNA, 27 nt, Artificial Sequence
  Synthetic oligonucleotide
acagauauucuuaaaaaaaaaaaaacc

SEQ ID NO: 6274 - RNA, 27 nt, Artificial Sequence
  Synthetic oligonucleotide
cauuacagauauucuuaaaaaaaaacc

SEQ ID NO: 6275 - RNA, 27 nt, Artificial Sequence
  Synthetic oligonucleotide
ccauuacagauauucuuaaaaaaaacc

SEQ ID NO: 6276 - RNA, 27 nt, Artificial Sequence
  Synthetic oligonucleotide
aguaccauuacagauauucuuaaaacc

SEQ ID NO: 6277 - RNA, 27 nt, Artificial Sequence
  Synthetic oligonucleotide
caguaccauuacagauauucuuaaacc

SEQ ID NO: 6278 - RNA, 27 nt, Artificial Sequence
  Synthetic oligonucleotide
ucaguaccauuacagauauucuuaacc

SEQ ID NO: 6279 - RNA, 27 nt, Artificial Sequence
  Synthetic oligonucleotide
aaagucaguaccauuacagauauuccc

SEQ ID NO: 6280 - RNA, 27 nt, Artificial Sequence
  Synthetic oligonucleotide
gcuacuucaaagcaagcaaagucagcc

SEQ ID NO: 6281 - RNA, 27 nt, Artificial Sequence
  Synthetic oligonucleotide
aaaaaaagagcuacuucaaagcaagac

SEQ ID NO: 6282 - RNA, 27 nt, Artificial Sequence
  Synthetic oligonucleotide
aaaaaaaaaaaagagcuacuucaaaaa

SEQ ID NO: 6283 - RNA, 27 nt, Artificial Sequence
  Synthetic oligonucleotide
aaaaaaaaaaaaagagcuacuucaaca

SEQ ID NO: 6284 - RNA, 27 nt, Artificial Sequence
  Synthetic oligonucleotide
aaaaaaaaaaaaaaagagcuacuuccc

SEQ ID NO: 6285 - RNA, 27 nt, Artificial Sequence
  Synthetic oligonucleotide
aaaaaaaaaaaaaaaagagcuacuuac

SEQ ID NO: 6286 - RNA, 27 nt, Artificial Sequence
  Synthetic oligonucleotide
aaaaaaaaaaaaaaaaagagcuacuca

SEQ ID NO: 6287 - RNA, 27 nt, Artificial Sequence
  Synthetic oligonucleotide
aaaaaaaaaaaaaaaaaagagcuaccc

SEQ ID NO: 6288 - RNA, 27 nt, Artificial Sequence
  Synthetic oligonucleotide
aaaaaaaaaaaaaaaaaaaaaaaagca

SEQ ID NO: 6289 - RNA, 27 nt, Artificial Sequence
  Synthetic oligonucleotide
aaaaaaaaaaaaaaaaaaaaaaaaaac

SEQ ID NO: 6290 - RNA, 27 nt, Artificial Sequence
  Synthetic oligonucleotide
caaaaaaaaaaaaaaaaaaaaaaaaca

SEQ ID NO: 6291 - RNA, 27 nt, Artificial Sequence
  Synthetic oligonucleotide
gcaaaaaaaaaaaaaaaaaaaaaaacc

SEQ ID NO: 6292 - RNA, 27 nt, Artificial Sequence
  Synthetic oligonucleotide
cugcaaaaaaaaaaaaaaaaaaaaacc

SEQ ID NO: 6293 - RNA, 27 nt, Artificial Sequence
  Synthetic oligonucleotide
acugcaaaaaaaaaaaaaaaaaaaacc

SEQ ID NO: 6294 - RNA, 27 nt, Artificial Sequence
  Synthetic oligonucleotide
aguuacugcaaaaaaaaaaaaaaaacc

SEQ ID NO: 6295 - RNA, 27 nt, Artificial Sequence
  Synthetic oligonucleotide
caguuacugcaaaaaaaaaaaaaaacc

SEQ ID NO: 6296 - RNA, 27 nt, Artificial Sequence
  Synthetic oligonucleotide
acaguuacugcaaaaaaaaaaaaaacc

SEQ ID NO: 6297 - RNA, 27 nt, Artificial Sequence
  Synthetic oligonucleotide
aaaaacaguuacugcaaaaaaaaaacc

SEQ ID NO: 6298 - RNA, 27 nt, Artificial Sequence
  Synthetic oligonucleotide
aaaaaacaguuacugcaaaaaaaaacc

SEQ ID NO: 6299 - RNA, 27 nt, Artificial Sequence
  Synthetic oligonucleotide
uaaaaaacaguuacugcaaaaaaaacc

SEQ ID NO: 6300 - RNA, 27 nt, Artificial Sequence
  Synthetic oligonucleotide
cuuaaaaaacaguuacugcaaaaaacc

SEQ ID NO: 6301 - RNA, 27 nt, Artificial Sequence
  Synthetic oligonucleotide
acuuaaaaaacaguuacugcaaaaacc

SEQ ID NO: 6302 - RNA, 27 nt, Artificial Sequence
  Synthetic oligonucleotide
agacuuaaaaaacaguuacugcaaacc

SEQ ID NO: 6303 - RNA, 27 nt, Artificial Sequence
  Synthetic oligonucleotide
acacuacgagagacuuaaaaaacagcc

SEQ ID NO: 6304 - RNA, 27 nt, Artificial Sequence
  Synthetic oligonucleotide
uaacacuacgagagacuuaaaaaacca

SEQ ID NO: 6305 - RNA, 27 nt, Artificial Sequence
  Synthetic oligonucleotide
uuaacacuacgagagacuuaaaaaaac

SEQ ID NO: 6306 - RNA, 27 nt, Artificial Sequence
  Synthetic oligonucleotide
acuuaacacuacgagagacuuaaaacc

SEQ ID NO: 6307 - RNA, 27 nt, Artificial Sequence
  Synthetic oligonucleotide
auaacuuaacacuacgagagacuuacc

SEQ ID NO: 6308 - RNA, 27 nt, Artificial Sequence
  Synthetic oligonucleotide
uauaacuuaacacuacgagagacuucc

SEQ ID NO: 6309 - RNA, 27 nt, Artificial Sequence
  Synthetic oligonucleotide
guauucacuauaacuuaacacuacgca

SEQ ID NO: 6310 - RNA, 27 nt, Artificial Sequence
  Synthetic oligonucleotide
aguauucacuauaacuuaacacuacac

SEQ ID NO: 6311 - RNA, 27 nt, Artificial Sequence
  Synthetic oligonucleotide
caguauucacuauaacuuaacacuaaa

SEQ ID NO: 6312 - RNA, 27 nt, Artificial Sequence
  Synthetic oligonucleotide
gcaguauucacuauaacuuaacacuca

SEQ ID NO: 6313 - RNA, 27 nt, Artificial Sequence
  Synthetic oligonucleotide
agaaauugcuguagcaguauucacucc

SEQ ID NO: 6314 - RNA, 27 nt, Artificial Sequence
  Synthetic oligonucleotide
uagaaauugcuguagcaguauucaccc

SEQ ID NO: 6315 - RNA, 27 nt, Artificial Sequence
  Synthetic oligonucleotide
uuagaaauugcuguagcaguauucaac

SEQ ID NO: 6316 - RNA, 27 nt, Artificial Sequence
  Synthetic oligonucleotide
acucaauucuuaaaaauuagaaauuaa

SEQ ID NO: 6317 - RNA, 27 nt, Artificial Sequence
  Synthetic oligonucleotide
ccauuacucaauucuuaaaaauuagcc

SEQ ID NO: 6318 - RNA, 27 nt, Artificial Sequence
  Synthetic oligonucleotide
acaccauuacucaauucuuaaaaaucc

SEQ ID NO: 6319 - RNA, 27 nt, Artificial Sequence
  Synthetic oligonucleotide
cuacaccauuacucaauucuuaaaacc

SEQ ID NO: 6320 - RNA, 27 nt, Artificial Sequence
  Synthetic oligonucleotide
ucuacaccauuacucaauucuuaaacc

SEQ ID NO: 6321 - RNA, 27 nt, Artificial Sequence
  Synthetic oligonucleotide
guucuacaccauuacucaauucuuacc

SEQ ID NO: 6322 - RNA, 27 nt, Artificial Sequence
  Synthetic oligonucleotide
guguucuacaccauuacucaauucucc

SEQ ID NO: 6323 - RNA, 27 nt, Artificial Sequence
  Synthetic oligonucleotide
augaauuaguguucuacaccauuacca

SEQ ID NO: 6324 - RNA, 27 nt, Artificial Sequence
  Synthetic oligonucleotide
ugauuaugaauuaguguucuacacccc

SEQ ID NO: 6325 - RNA, 27 nt, Artificial Sequence
  Synthetic oligonucleotide
gugauuaugaauuaguguucuacacac

SEQ ID NO: 6326 - RNA, 27 nt, Artificial Sequence
  Synthetic oligonucleotide
agugauuaugaauuaguguucuacaaa

SEQ ID NO: 6327 - RNA, 27 nt, Artificial Sequence
  Synthetic oligonucleotide
auuaauuagagugauuaugaauuagca

SEQ ID NO: 6328 - RNA, 27 nt, Artificial Sequence
  Synthetic oligonucleotide
aauuaauuagagugauuaugaauuaac

SEQ ID NO: 6329 - RNA, 27 nt, Artificial Sequence
  Synthetic oligonucleotide
caauuaauuagagugauuaugaauuca

SEQ ID NO: 6330 - RNA, 27 nt, Artificial Sequence
  Synthetic oligonucleotide
auuacaauuaauuagagugauuaugcc

SEQ ID NO: 6331 - RNA, 27 nt, Artificial Sequence
  Synthetic oligonucleotide
gauuacaauuaauuagagugauuauac

SEQ ID NO: 6332 - RNA, 27 nt, Artificial Sequence
  Synthetic oligonucleotide
agauuacaauuaauuagagugauuaca

SEQ ID NO: 6333 - RNA, 27 nt, Artificial Sequence
  Synthetic oligonucleotide
cuuuauucagauuacaauuaauuagca

SEQ ID NO: 6334 - RNA, 27 nt, Artificial Sequence
  Synthetic oligonucleotide
acuuuauucagauuacaauuaauuaac

SEQ ID NO: 6335 - RNA, 27 nt, Artificial Sequence
  Synthetic oligonucleotide
uuacacuuuauucagauuacaauuacc

SEQ ID NO: 6336 - RNA, 27 nt, Artificial Sequence
  Synthetic oligonucleotide
guuacacuuuauucagauuacaauucc

SEQ ID NO: 6337 - RNA, 27 nt, Artificial Sequence
  Synthetic oligonucleotide
uguuacacuuuauucagauuacaaucc

SEQ ID NO: 6338 - RNA, 27 nt, Artificial Sequence
  Synthetic oligonucleotide
uuguuacacuuuauucagauuacaacc

SEQ ID NO: 6339 - RNA, 27 nt, Artificial Sequence
  Synthetic oligonucleotide
auuguuacacuuuauucagauuacacc

SEQ ID NO: 6340 - RNA, 27 nt, Artificial Sequence
  Synthetic oligonucleotide
cuacacaauuguuacacuuuauucaac

SEQ ID NO: 6341 - RNA, 27 nt, Artificial Sequence
  Synthetic oligonucleotide
aaggcuacacaauuguuacacuuuacc

SEQ ID NO: 6342 - RNA, 27 nt, Artificial Sequence
  Synthetic oligonucleotide
acaaaaaggcuacacaauuguuacaac

SEQ ID NO: 6343 - RNA, 27 nt, Artificial Sequence
  Synthetic oligonucleotide
uuuuauacaaaaaggcuacacaauuac

SEQ ID NO: 6344 - RNA, 27 nt, Artificial Sequence
  Synthetic oligonucleotide
auuuuauacaaaaaggcuacacaauca

SEQ ID NO: 6345 - RNA, 27 nt, Artificial Sequence
  Synthetic oligonucleotide
cuauuuuauacaaaaaggcuacacacc

SEQ ID NO: 6346 - RNA, 27 nt, Artificial Sequence
  Synthetic oligonucleotide
ucuauuuuauacaaaaaggcuacaccc

SEQ ID NO: 6347 - RNA, 27 nt, Artificial Sequence
  Synthetic oligonucleotide
ugucuauuuuauacaaaaaggcuacca

SEQ ID NO: 6348 - RNA, 27 nt, Artificial Sequence
  Synthetic oligonucleotide
ucuauuugucuauuuuauacaaaaaaa

SEQ ID NO: 6349 - RNA, 27 nt, Artificial Sequence
  Synthetic oligonucleotide
uuucuauuugucuauuuuauacaaacc

SEQ ID NO: 6350 - RNA, 27 nt, Artificial Sequence
  Synthetic oligonucleotide
uuuucuauuugucuauuuuauacaacc

SEQ ID NO: 6351 - RNA, 27 nt, Artificial Sequence
  Synthetic oligonucleotide
auuuucuauuugucuauuuuauacacc

SEQ ID NO: 6352 - RNA, 27 nt, Artificial Sequence
  Synthetic oligonucleotide
cauuuucuauuugucuauuuuauaccc

SEQ ID NO: 6353 - RNA, 27 nt, Artificial Sequence
  Synthetic oligonucleotide
ccauuuucuauuugucuauuuuauaac

SEQ ID NO: 6354 - RNA, 27 nt, Artificial Sequence
  Synthetic oligonucleotide
ggaccauuuucuauuugucuauuuucc

SEQ ID NO: 6355 - RNA, 27 nt, Artificial Sequence
  Synthetic oligonucleotide
uggaccauuuucuauuugucuauuucc

SEQ ID NO: 6356 - RNA, 27 nt, Artificial Sequence
  Synthetic oligonucleotide
uuggaccauuuucuauuugucuauucc

SEQ ID NO: 6357 - RNA, 27 nt, Artificial Sequence
  Synthetic oligonucleotide
aaacuaauuggaccauuuucuauuuac

SEQ ID NO: 6358 - RNA, 27 nt, Artificial Sequence
  Synthetic oligonucleotide
gaaacuaauuggaccauuuucuauuca

SEQ ID NO: 6359 - RNA, 27 nt, Artificial Sequence
  Synthetic oligonucleotide
ggaaacuaauuggaccauuuucuaucc

SEQ ID NO: 6360 - RNA, 27 nt, Artificial Sequence
  Synthetic oligonucleotide
aggaaacuaauuggaccauuuucuacc

SEQ ID NO: 6361 - RNA, 27 nt, Artificial Sequence
  Synthetic oligonucleotide
uuaaaaaggaaacuaauuggaccaucc

SEQ ID NO: 6362 - RNA, 27 nt, Artificial Sequence
  Synthetic oligonucleotide
auuaaaaaggaaacuaauuggaccacc

SEQ ID NO: 6363 - RNA, 27 nt, Artificial Sequence
  Synthetic oligonucleotide
aagcauauuaaaaaggaaacuaauuaa

SEQ ID NO: 6364 - RNA, 27 nt, Artificial Sequence
  Synthetic oligonucleotide
uaagcauauuaaaaaggaaacuaauca

SEQ ID NO: 6365 - RNA, 27 nt, Artificial Sequence
  Synthetic oligonucleotide
auuuuaagcauauuaaaaaggaaaccc

SEQ ID NO: 6366 - RNA, 27 nt, Artificial Sequence
  Synthetic oligonucleotide
cugcuuauuuuaagcauauuaaaaaaa

SEQ ID NO: 6367 - RNA, 27 nt, Artificial Sequence
  Synthetic oligonucleotide
ccugcuuauuuuaagcauauuaaaaca

SEQ ID NO: 6368 - RNA, 27 nt, Artificial Sequence
  Synthetic oligonucleotide
gauccaccugcuuauuuuaagcauacc

SEQ ID NO: 6369 - RNA, 27 nt, Artificial Sequence
  Synthetic oligonucleotide
caaaaacaugaaauagauccaccugac

SEQ ID NO: 6370 - RNA, 27 nt, Artificial Sequence
  Synthetic oligonucleotide
ucaaaaacaugaaauagauccaccuaa

SEQ ID NO: 6371 - RNA, 27 nt, Artificial Sequence
  Synthetic oligonucleotide
gaucaaaaacaugaaauagauccacac

SEQ ID NO: 6372 - RNA, 27 nt, Artificial Sequence
  Synthetic oligonucleotide
ugaucaaaaacaugaaauagauccaaa

SEQ ID NO: 6373 - RNA, 27 nt, Artificial Sequence
  Synthetic oligonucleotide
uugaucaaaaacaugaaauagauccca

SEQ ID NO: 6374 - RNA, 27 nt, Artificial Sequence
  Synthetic oligonucleotide
aguuuuugaucaaaaacaugaaauaac

SEQ ID NO: 6375 - RNA, 27 nt, Artificial Sequence
  Synthetic oligonucleotide
ccaaauaguuuuugaucaaaaacauac

SEQ ID NO: 6376 - RNA, 27 nt, Artificial Sequence
  Synthetic oligonucleotide
uaucccaaauaguuuuugaucaaaaca

SEQ ID NO: 6377 - RNA, 27 nt, Artificial Sequence
  Synthetic oligonucleotide
auaucccaaauaguuuuugaucaaacc

SEQ ID NO: 6378 - RNA, 27 nt, Artificial Sequence
  Synthetic oligonucleotide
cauaucccaaauaguuuuugaucaacc

SEQ ID NO: 6379 - RNA, 27 nt, Artificial Sequence
  Synthetic oligonucleotide
acauaucccaaauaguuuuugaucacc

SEQ ID NO: 6380 - RNA, 27 nt, Artificial Sequence
  Synthetic oligonucleotide
ccauacauaucccaaauaguuuuugcc

SEQ ID NO: 6381 - RNA, 27 nt, Artificial Sequence
  Synthetic oligonucleotide
uuacccuacccauacauaucccaaacc

SEQ ID NO: 6382 - RNA, 27 nt, Artificial Sequence
  Synthetic oligonucleotide
uuuacccuacccauacauaucccaacc

SEQ ID NO: 6383 - RNA, 27 nt, Artificial Sequence
  Synthetic oligonucleotide
auuuacccuacccauacauaucccacc

SEQ ID NO: 6384 - RNA, 27 nt, Artificial Sequence
  Synthetic oligonucleotide
acaccucuuacugauuuacccuaccac

SEQ ID NO: 6385 - RNA, 27 nt, Artificial Sequence
  Synthetic oligonucleotide
uaacaccucuuacugauuuacccuaaa

SEQ ID NO: 6386 - RNA, 27 nt, Artificial Sequence
  Synthetic oligonucleotide
auaacaccucuuacugauuuacccuca

SEQ ID NO: 6387 - RNA, 27 nt, Artificial Sequence
  Synthetic oligonucleotide
aauaacaccucuuacugauuuaccccc

SEQ ID NO: 6388 - RNA, 27 nt, Artificial Sequence
  Synthetic oligonucleotide
aaauaacaccucuuacugauuuaccac

SEQ ID NO: 6389 - RNA, 27 nt, Artificial Sequence
  Synthetic oligonucleotide
caaauaacaccucuuacugauuuacaa

SEQ ID NO: 6390 - RNA, 27 nt, Artificial Sequence
  Synthetic oligonucleotide
agguuccaaauaacaccucuuacugcc

SEQ ID NO: 6391 - RNA, 27 nt, Artificial Sequence
  Synthetic oligonucleotide
aaaacaagguuccaaauaacaccuccc

SEQ ID NO: 6392 - RNA, 27 nt, Artificial Sequence
  Synthetic oligonucleotide
caaaacaagguuccaaauaacaccuac

SEQ ID NO: 6393 - RNA, 27 nt, Artificial Sequence
  Synthetic oligonucleotide
ccaaaacaagguuccaaauaacaccca

SEQ ID NO: 6394 - RNA, 27 nt, Artificial Sequence
  Synthetic oligonucleotide
acuguccaaaacaagguuccaaauaca

SEQ ID NO: 6395 - RNA, 27 nt, Artificial Sequence
  Synthetic oligonucleotide
guaaacuguccaaaacaagguuccacc

SEQ ID NO: 6396 - RNA, 27 nt, Artificial Sequence
  Synthetic oligonucleotide
gguaaacuguccaaaacaagguucccc

SEQ ID NO: 6397 - RNA, 27 nt, Artificial Sequence
  Synthetic oligonucleotide
aggcaacugguaaacuguccaaaaccc

SEQ ID NO: 6398 - RNA, 27 nt, Artificial Sequence
  Synthetic oligonucleotide
gggauaaaaggcaacugguaaacugca

SEQ ID NO: 6399 - RNA, 27 nt, Artificial Sequence
  Synthetic oligonucleotide
ugggauaaaaggcaacugguaaacuac

SEQ ID NO: 6400 - RNA, 27 nt, Artificial Sequence
  Synthetic oligonucleotide
acaacuuugggauaaaaggcaacugac

SEQ ID NO: 6401 - RNA, 27 nt, Artificial Sequence
  Synthetic oligonucleotide
caacaacuuugggauaaaaggcaacca

SEQ ID NO: 6402 - RNA, 27 nt, Artificial Sequence
  Synthetic oligonucleotide
gguuacaacaacuuugggauaaaagaa

SEQ ID NO: 6403 - RNA, 27 nt, Artificial Sequence
  Synthetic oligonucleotide
agguuacaacaacuuugggauaaaaaa

SEQ ID NO: 6404 - RNA, 27 nt, Artificial Sequence
  Synthetic oligonucleotide
cagguuacaacaacuuugggauaaaca

SEQ ID NO: 6405 - RNA, 27 nt, Artificial Sequence
  Synthetic oligonucleotide
uaucacagcagguuacaacaacuuuaa

SEQ ID NO: 6406 - RNA, 27 nt, Artificial Sequence
  Synthetic oligonucleotide
guaucacagcagguuacaacaacuuca

SEQ ID NO: 6407 - RNA, 27 nt, Artificial Sequence
  Synthetic oligonucleotide
ucguaucacagcagguuacaacaaccc

SEQ ID NO: 6408 - RNA, 27 nt, Artificial Sequence
  Synthetic oligonucleotide
uuucucuugaagcaucguaucacagac

SEQ ID NO: 6409 - RNA, 27 nt, Artificial Sequence
  Synthetic oligonucleotide
uuuucucuugaagcaucguaucacaaa

SEQ ID NO: 6410 - RNA, 27 nt, Artificial Sequence
  Synthetic oligonucleotide
cauuuucucuugaagcaucguaucaac

SEQ ID NO: 6411 - RNA, 27 nt, Artificial Sequence
  Synthetic oligonucleotide
uuuuuuauaaccgcauuuucucuugcc

SEQ ID NO: 6412 - RNA, 27 nt, Artificial Sequence
  Synthetic oligonucleotide
auuuuuuauaaccgcauuuucucuuac

SEQ ID NO: 6413 - RNA, 27 nt, Artificial Sequence
  Synthetic oligonucleotide
cauuuuuuauaaccgcauuuucucuca

SEQ ID NO: 6414 - RNA, 27 nt, Artificial Sequence
  Synthetic oligonucleotide
ccauuuuuuauaaccgcauuuucuccc

SEQ ID NO: 6415 - RNA, 27 nt, Artificial Sequence
  Synthetic oligonucleotide
cugaaccauuuuuuauaaccgcauucc

SEQ ID NO: 6416 - RNA, 27 nt, Artificial Sequence
  Synthetic oligonucleotide
uaauucugaaccauuuuuuauaaccaa

SEQ ID NO: 6417 - RNA, 27 nt, Artificial Sequence
  Synthetic oligonucleotide
uuaauucugaaccauuuuuuauaacaa

SEQ ID NO: 6418 - RNA, 27 nt, Artificial Sequence
  Synthetic oligonucleotide
uuuaauucugaaccauuuuuuauaaaa

SEQ ID NO: 6419 - RNA, 27 nt, Artificial Sequence
  Synthetic oligonucleotide
guuuaauucugaaccauuuuuuauaca

SEQ ID NO: 6420 - RNA, 27 nt, Artificial Sequence
  Synthetic oligonucleotide
aguuuaauucugaaccauuuuuuaucc

SEQ ID NO: 6421 - RNA, 27 nt, Artificial Sequence
  Synthetic oligonucleotide
aaguuuaauucugaaccauuuuuuacc

SEQ ID NO: 6422 - RNA, 27 nt, Artificial Sequence
  Synthetic oligonucleotide
auuaaaaguuuaauucugaaccauucc

SEQ ID NO: 6423 - RNA, 27 nt, Artificial Sequence
  Synthetic oligonucleotide
aauuaaaaguuuaauucugaaccaucc

SEQ ID NO: 6424 - RNA, 27 nt, Artificial Sequence
  Synthetic oligonucleotide
ugaauuaaaaguuuaauucugaacccc

SEQ ID NO: 6425 - RNA, 27 nt, Artificial Sequence
  Synthetic oligonucleotide
caauacagcuaaaggaugauuuacaaa

SEQ ID NO: 6426 - RNA, 27 nt, Artificial Sequence
  Synthetic oligonucleotide
acaauacagcuaaaggaugauuuacca

SEQ ID NO: 6427 - RNA, 27 nt, Artificial Sequence
  Synthetic oligonucleotide
agacaauacagcuaaaggaugauuuca

SEQ ID NO: 6428 - RNA, 27 nt, Artificial Sequence
  Synthetic oligonucleotide
guuacuccuaaaggaugauuuacagac

SEQ ID NO: 6429 - RNA, 27 nt, Artificial Sequence
  Synthetic oligonucleotide
uguuacuccuaaaggaugauuuacaaa

SEQ ID NO: 6430 - RNA, 27 nt, Artificial Sequence
  Synthetic oligonucleotide
uuguuacuccuaaaggaugauuuacca

SEQ ID NO: 6431 - RNA, 27 nt, Artificial Sequence
  Synthetic oligonucleotide
auuguuacuccuaaaggaugauuuaac

SEQ ID NO: 6432 - RNA, 27 nt, Artificial Sequence
  Synthetic oligonucleotide
ggauuccagaauccaaguaagacugac

SEQ ID NO: 6433 - RNA, 27 nt, Artificial Sequence
  Synthetic oligonucleotide
cuugcucccauucauaaaggacuugaa

SEQ ID NO: 6434 - RNA, 27 nt, Artificial Sequence
  Synthetic oligonucleotide
cgucaauaucagcuacuugcucuugaa

SEQ ID NO: 6435 - RNA, 27 nt, Artificial Sequence
  Synthetic oligonucleotide
ccgucaauaucagcuacuugcucuuaa

SEQ ID NO: 6436 - RNA, 27 nt, Artificial Sequence
  Synthetic oligonucleotide
acugcccgucaauaucagcuacuugac

SEQ ID NO: 6437 - RNA, 27 nt, Artificial Sequence
  Synthetic oligonucleotide
uguuucaacaucugugaugguucagaa

SEQ ID NO: 6438 - RNA, 27 nt, Artificial Sequence
  Synthetic oligonucleotide
auguuucaacaucugugaugguucaaa

SEQ ID NO: 6439 - RNA, 27 nt, Artificial Sequence
  Synthetic oligonucleotide
ugacaacugcauguuucaacaucugca

SEQ ID NO: 6440 - RNA, 27 nt, Artificial Sequence
  Synthetic oligonucleotide
auugacaacugcauguuucaacaucca

SEQ ID NO: 6441 - RNA, 27 nt, Artificial Sequence
  Synthetic oligonucleotide
ucaaauugacaacugcauguuucaaac

SEQ ID NO: 6442 - RNA, 27 nt, Artificial Sequence
  Synthetic oligonucleotide
aguuaaucaaauugacaacugcaugcc

SEQ ID NO: 6443 - RNA, 27 nt, Artificial Sequence
  Synthetic oligonucleotide
ccugauaguuaaucaaauugacaacca

SEQ ID NO: 6444 - RNA, 27 nt, Artificial Sequence
  Synthetic oligonucleotide
cgucauccugauaguuaaucaaauuac

SEQ ID NO: 6445 - RNA, 27 nt, Artificial Sequence
  Synthetic oligonucleotide
gcgucauccugauaguuaaucaaauca

SEQ ID NO: 6446 - RNA, 27 nt, Artificial Sequence
  Synthetic oligonucleotide
ccucaucguuuagcaguuuugucagac

SEQ ID NO: 6447 - RNA, 27 nt, Artificial Sequence
  Synthetic oligonucleotide
cugguccucaucguuuagcaguuuuac

SEQ ID NO: 6448 - RNA, 27 nt, Artificial Sequence
  Synthetic oligonucleotide
cauaacagcagcuuuauuaacuaccca

SEQ ID NO: 6449 - RNA, 27 nt, Artificial Sequence
  Synthetic oligonucleotide
ccauaacagcagcuuuauuaacuacac

SEQ ID NO: 6450 - RNA, 27 nt, Artificial Sequence
  Synthetic oligonucleotide
ggaccauaacagcagcuuuauuaaccc

SEQ ID NO: 6451 - RNA, 27 nt, Artificial Sequence
  Synthetic oligonucleotide
uggaccauaacagcagcuuuauuaaac

SEQ ID NO: 6452 - RNA, 27 nt, Artificial Sequence
  Synthetic oligonucleotide
cugucucuacaucauuuguauucugac

SEQ ID NO: 6453 - RNA, 27 nt, Artificial Sequence
  Synthetic oligonucleotide
gcugucucuacaucauuuguauucuaa

SEQ ID NO: 6454 - RNA, 27 nt, Artificial Sequence
  Synthetic oligonucleotide
gcaaccauuuucugcaguccaccagac

SEQ ID NO: 6455 - RNA, 27 nt, Artificial Sequence
  Synthetic oligonucleotide
aagcaaccauuuucugcaguccaccca

SEQ ID NO: 6456 - RNA, 27 nt, Artificial Sequence
  Synthetic oligonucleotide
uuguuuuguugagcaaagcaaccaucc

SEQ ID NO: 6457 - RNA, 27 nt, Artificial Sequence
  Synthetic oligonucleotide
uuuguuuuguugagcaaagcaaccacc

SEQ ID NO: 6458 - RNA, 27 nt, Artificial Sequence
  Synthetic oligonucleotide
uagccaagaauuucacguuuguuuuac

SEQ ID NO: 6459 - RNA, 27 nt, Artificial Sequence
  Synthetic oligonucleotide
cuugauugccauaagcuaagaucugcc

SEQ ID NO: 6460 - RNA, 27 nt, Artificial Sequence
  Synthetic oligonucleotide
gcucucuugauugccauaagcuaagcc

SEQ ID NO: 6461 - RNA, 27 nt, Artificial Sequence
  Synthetic oligonucleotide
cuucucauaaguguagguccucauucc

SEQ ID NO: 6462 - RNA, 27 nt, Artificial Sequence
  Synthetic oligonucleotide
gcuucucauaaguguagguccucaucc

SEQ ID NO: 6463 - RNA, 27 nt, Artificial Sequence
  Synthetic oligonucleotide
aagcuucucauaaguguagguccuccc

SEQ ID NO: 6464 - RNA, 27 nt, Artificial Sequence
  Synthetic oligonucleotide
gaagcuucucauaaguguagguccuac

SEQ ID NO: 6465 - RNA, 27 nt, Artificial Sequence
  Synthetic oligonucleotide
gaguccaaagacaguuuugaacaagca

SEQ ID NO: 6466 - RNA, 27 nt, Artificial Sequence
  Synthetic oligonucleotide
agaguccaaagacaguuuugaacaaac

SEQ ID NO: 6467 - RNA, 27 nt, Artificial Sequence
  Synthetic oligonucleotide
ccacauuuauaucaucggaacccagcc

SEQ ID NO: 6468 - RNA, 27 nt, Artificial Sequence
  Synthetic oligonucleotide
ugaccacauuuauaucaucggaaccac

SEQ ID NO: 6469 - RNA, 27 nt, Artificial Sequence
  Synthetic oligonucleotide
cugcacaggugaccacauuuauauccc

SEQ ID NO: 6470 - RNA, 27 nt, Artificial Sequence
  Synthetic oligonucleotide
gcugcacaggugaccacauuuauauac

SEQ ID NO: 6471 - RNA, 27 nt, Artificial Sequence
  Synthetic oligonucleotide
uuguaauuauugcaagugagguuagca

SEQ ID NO: 6472 - RNA, 27 nt, Artificial Sequence
  Synthetic oligonucleotide
caucaucuuguuuuuguaauuauugac

SEQ ID NO: 6473 - RNA, 27 nt, Artificial Sequence
  Synthetic oligonucleotide
ccaucaucuuguuuuuguaauuauuaa

SEQ ID NO: 6474 - RNA, 27 nt, Artificial Sequence
  Synthetic oligonucleotide
acaccaucaucuuguuuuuguaauucc

SEQ ID NO: 6475 - RNA, 27 nt, Artificial Sequence
  Synthetic oligonucleotide
uuggcacaccaucaucuuguuuuugcc

SEQ ID NO: 6476 - RNA, 27 nt, Artificial Sequence
  Synthetic oligonucleotide
ucaauccaacaguugccuuuaucagca

SEQ ID NO: 6477 - RNA, 27 nt, Artificial Sequence
  Synthetic oligonucleotide
ucgaaucaauccaacaguugccuuucc

SEQ ID NO: 6478 - RNA, 27 nt, Artificial Sequence
  Synthetic oligonucleotide
gcugaacuagucguggaauagcaccac

SEQ ID NO: 6479 - RNA, 27 nt, Artificial Sequence
  Synthetic oligonucleotide
aguacacccuucuacuaucuccucccc

SEQ ID NO: 6480 - RNA, 27 nt, Artificial Sequence
  Synthetic oligonucleotide
caguacacccuucuacuaucuccucac

SEQ ID NO: 6481 - RNA, 27 nt, Artificial Sequence
  Synthetic oligonucleotide
ccaguacacccuucuacuaucuccuaa

SEQ ID NO: 6482 - RNA, 27 nt, Artificial Sequence
  Synthetic oligonucleotide
gagcuccaguacacccuucuacuauac

SEQ ID NO: 6483 - RNA, 27 nt, Artificial Sequence
  Synthetic oligonucleotide
aaacaauggaaugguauugaguccuaa

SEQ ID NO: 6484 - RNA, 27 nt, Artificial Sequence
  Synthetic oligonucleotide
cugcacaaacaauggaaugguauugca

SEQ ID NO: 6485 - RNA, 27 nt, Artificial Sequence
  Synthetic oligonucleotide
acugcacaaacaauggaaugguauuac

SEQ ID NO: 6486 - RNA, 27 nt, Artificial Sequence
  Synthetic oligonucleotide
aagcaacugcacaaacaauggaaugac

SEQ ID NO: 6487 - RNA, 27 nt, Artificial Sequence
  Synthetic oligonucleotide
gagaauaaagcaacugcacaaacaaca

SEQ ID NO: 6488 - RNA, 27 nt, Artificial Sequence
  Synthetic oligonucleotide
uuucaaugggagaauaaagcaacugac

SEQ ID NO: 6489 - RNA, 27 nt, Artificial Sequence
  Synthetic oligonucleotide
uuuucaaugggagaauaaagcaacuaa

SEQ ID NO: 6490 - RNA, 27 nt, Artificial Sequence
  Synthetic oligonucleotide
auuuucaaugggagaauaaagcaacca

SEQ ID NO: 6491 - RNA, 27 nt, Artificial Sequence
  Synthetic oligonucleotide
ggauauuuucaaugggagaauaaagac

SEQ ID NO: 6492 - RNA, 27 nt, Artificial Sequence
  Synthetic oligonucleotide
uggauauuuucaaugggagaauaaaaa

SEQ ID NO: 6493 - RNA, 27 nt, Artificial Sequence
  Synthetic oligonucleotide
uuggauauuuucaaugggagaauaaca

SEQ ID NO: 6494 - RNA, 27 nt, Artificial Sequence
  Synthetic oligonucleotide
cagcuacucuuuggauauuuucaauaa

SEQ ID NO: 6495 - RNA, 27 nt, Artificial Sequence
  Synthetic oligonucleotide
gcagcuacucuuuggauauuuucaaca

SEQ ID NO: 6496 - RNA, 27 nt, Artificial Sequence
  Synthetic oligonucleotide
ccgcuucuuguaauccuguggcuugca

SEQ ID NO: 6497 - RNA, 27 nt, Artificial Sequence
  Synthetic oligonucleotide
ccaguccaagaucugcagucucauuaa

SEQ ID NO: 6498 - RNA, 27 nt, Artificial Sequence
  Synthetic oligonucleotide
cguauccaccagagugaaaagaacgac

SEQ ID NO: 6499 - RNA, 27 nt, Artificial Sequence
  Synthetic oligonucleotide
caggccagcugauugcuaucaccugaa

SEQ ID NO: 6500 - RNA, 27 nt, Artificial Sequence
  Synthetic oligonucleotide
cgauuuacaggucaguaucaaaccaaa

SEQ ID NO: 6501 - RNA, 27 nt, Artificial Sequence
  Synthetic oligonucleotide
acgauuuacaggucaguaucaaaccca

SEQ ID NO: 6502 - RNA, 27 nt, Artificial Sequence
  Synthetic oligonucleotide
uuucuuaccuaaaggacgauuuacaaa

SEQ ID NO: 6503 - RNA, 27 nt, Artificial Sequence
  Synthetic oligonucleotide
gcuuucuuaccuaaaggacgauuuaac

SEQ ID NO: 6504 - RNA, 27 nt, Artificial Sequence
  Synthetic oligonucleotide
cuuuuauaagcuuucuuaccuaaagac

SEQ ID NO: 6505 - RNA, 27 nt, Artificial Sequence
  Synthetic oligonucleotide
gcuuuuauaagcuuucuuaccuaaaaa

SEQ ID NO: 6506 - RNA, 27 nt, Artificial Sequence
  Synthetic oligonucleotide
cuggcuuuuauaagcuuucuuaccucc

SEQ ID NO: 6507 - RNA, 27 nt, Artificial Sequence
  Synthetic oligonucleotide
ccacacuggcuuuuauaagcuuucucc

SEQ ID NO: 6508 - RNA, 27 nt, Artificial Sequence
  Synthetic oligonucleotide
auucacccacacuggcuuuuauaagac

SEQ ID NO: 6509 - RNA, 27 nt, Artificial Sequence
  Synthetic oligonucleotide
ccuaccaagucuuucuggaguucugac

SEQ ID NO: 6510 - RNA, 27 nt, Artificial Sequence
  Synthetic oligonucleotide
auuuacaaacaggccuaaaaccauuaa

SEQ ID NO: 6511 - RNA, 27 nt, Artificial Sequence
  Synthetic oligonucleotide
gauuuacaaacaggccuaaaaccauca

SEQ ID NO: 6512 - RNA, 27 nt, Artificial Sequence
  Synthetic oligonucleotide
agauuuacaaacaggccuaaaaccacc

SEQ ID NO: 6513 - RNA, 27 nt, Artificial Sequence
  Synthetic oligonucleotide
caucuccuuccaagguauguaucugcc

SEQ ID NO: 6514 - RNA, 27 nt, Artificial Sequence
  Synthetic oligonucleotide
acaucuccuuccaagguauguaucuac

SEQ ID NO: 6515 - RNA, 27 nt, Artificial Sequence
  Synthetic oligonucleotide
acuuccacacaugaacaucuccuucac

SEQ ID NO: 6516 - RNA, 27 nt, Artificial Sequence
  Synthetic oligonucleotide
gaaacuuccacacaugaacaucucccc

SEQ ID NO: 6517 - RNA, 27 nt, Artificial Sequence
  Synthetic oligonucleotide
agaaacuuccacacaugaacaucucac

SEQ ID NO: 6518 - RNA, 27 nt, Artificial Sequence
  Synthetic oligonucleotide
gagaaacuuccacacaugaacaucuaa

SEQ ID NO: 6519 - RNA, 27 nt, Artificial Sequence
  Synthetic oligonucleotide
ugagaaacuuccacacaugaacaucca

SEQ ID NO: 6520 - RNA, 27 nt, Artificial Sequence
  Synthetic oligonucleotide
caucaacgugagaaacuuccacacaca

SEQ ID NO: 6521 - RNA, 27 nt, Artificial Sequence
  Synthetic oligonucleotide
aaacaucaacgugagaaacuuccacca

SEQ ID NO: 6522 - RNA, 27 nt, Artificial Sequence
  Synthetic oligonucleotide
aaaacaucaacgugagaaacuuccaac

SEQ ID NO: 6523 - RNA, 27 nt, Artificial Sequence
  Synthetic oligonucleotide
aaaaacaucaacgugagaaacuuccca

SEQ ID NO: 6524 - RNA, 27 nt, Artificial Sequence
  Synthetic oligonucleotide
caaaaacaucaacgugagaaacuucac

SEQ ID NO: 6525 - RNA, 27 nt, Artificial Sequence
  Synthetic oligonucleotide
gcaaaaacaucaacgugagaaacuuaa

SEQ ID NO: 6526 - RNA, 27 nt, Artificial Sequence
  Synthetic oligonucleotide
uggcaaaaacaucaacgugagaaaccc

SEQ ID NO: 6527 - RNA, 27 nt, Artificial Sequence
  Synthetic oligonucleotide
cugcaaaagcuguggcaaaaacauccc

SEQ ID NO: 6528 - RNA, 27 nt, Artificial Sequence
  Synthetic oligonucleotide
gcugcaaaagcuguggcaaaaacauac

SEQ ID NO: 6529 - RNA, 27 nt, Artificial Sequence
  Synthetic oligonucleotide
acucaucugaguauaacgcugcaaaca

SEQ ID NO: 6530 - RNA, 27 nt, Artificial Sequence
  Synthetic oligonucleotide
ugaaaacagcaaauguuacucaucuac

SEQ ID NO: 6531 - RNA, 27 nt, Artificial Sequence
  Synthetic oligonucleotide
uugaaaacagcaaauguuacucaucca

SEQ ID NO: 6532 - RNA, 27 nt, Artificial Sequence
  Synthetic oligonucleotide
guugaaaacagcaaauguuacucauac

SEQ ID NO: 6533 - RNA, 27 nt, Artificial Sequence
  Synthetic oligonucleotide
cuauuaauguugaaaacagcaaaugcc

SEQ ID NO: 6534 - RNA, 27 nt, Artificial Sequence
  Synthetic oligonucleotide
acacuacagcuguauagagagaaagaa

SEQ ID NO: 6535 - RNA, 27 nt, Artificial Sequence
  Synthetic oligonucleotide
caggccaaucacaaugcacguucagca

SEQ ID NO: 6536 - RNA, 27 nt, Artificial Sequence
  Synthetic oligonucleotide
cuguucccauaggaaacucagcuugac

SEQ ID NO: 6537 - RNA, 27 nt, Artificial Sequence
  Synthetic oligonucleotide
cagaacaaaaagcguacuucgacugcc

SEQ ID NO: 6538 - RNA, 27 nt, Artificial Sequence
  Synthetic oligonucleotide
aaggaccagaacaaaaagcguacuuaa

SEQ ID NO: 6539 - RNA, 27 nt, Artificial Sequence
  Synthetic oligonucleotide
cgaccaaaaaggaccagaacaaaaaaa

SEQ ID NO: 6540 - RNA, 27 nt, Artificial Sequence
  Synthetic oligonucleotide
ucgaccaaaaaggaccagaacaaaaca

SEQ ID NO: 6541 - RNA, 27 nt, Artificial Sequence
  Synthetic oligonucleotide
uuacuccucgaccaaaaaggaccagcc

SEQ ID NO: 6542 - RNA, 27 nt, Artificial Sequence
  Synthetic oligonucleotide
aauccauuuguauuguuacuccucgca

SEQ ID NO: 6543 - RNA, 27 nt, Artificial Sequence
  Synthetic oligonucleotide
aaauccauuuguauuguuacuccucac

SEQ ID NO: 6544 - RNA, 27 nt, Artificial Sequence
  Synthetic oligonucleotide
caaauccauuuguauuguuacuccuaa

SEQ ID NO: 6545 - RNA, 27 nt, Artificial Sequence
  Synthetic oligonucleotide
ccaaauccauuuguauuguuacuccca

SEQ ID NO: 6546 - RNA, 27 nt, Artificial Sequence
  Synthetic oligonucleotide
ucacuccccaaauccauuuguauugcc

SEQ ID NO: 6547 - RNA, 27 nt, Artificial Sequence
  Synthetic oligonucleotide
gauccauucgugugcauucuucacuaa

SEQ ID NO: 6548 - RNA, 27 nt, Artificial Sequence
  Synthetic oligonucleotide
ugauccauucgugugcauucuucacca

SEQ ID NO: 6549 - RNA, 27 nt, Artificial Sequence
  Synthetic oligonucleotide
gugauccauucgugugcauucuucaac

SEQ ID NO: 6550 - RNA, 27 nt, Artificial Sequence
  Synthetic oligonucleotide
uaaaacaaagaacaagcaaggcuagaa

SEQ ID NO: 6551 - RNA, 27 nt, Artificial Sequence
  Synthetic oligonucleotide
gcaccacuacagauauuaaaacaaaac

SEQ ID NO: 6552 - RNA, 27 nt, Artificial Sequence
  Synthetic oligonucleotide
cagcaccacuacagauauuaaaacacc

SEQ ID NO: 6553 - RNA, 27 nt, Artificial Sequence
  Synthetic oligonucleotide
ucagcaccacuacagauauuaaaaccc

SEQ ID NO: 6554 - RNA, 27 nt, Artificial Sequence
  Synthetic oligonucleotide
aaaaaauaaaagcaagcaaagucagac

SEQ ID NO: 6555 - RNA, 27 nt, Artificial Sequence
  Synthetic oligonucleotide
cugcaaaaaauaaaagcaagcaaagca

SEQ ID NO: 6556 - RNA, 27 nt, Artificial Sequence
  Synthetic oligonucleotide
aguuacugcaaaaaauaaaagcaagac

SEQ ID NO: 6557 - RNA, 27 nt, Artificial Sequence
  Synthetic oligonucleotide
acuaacaguuacugcaaaaaauaaaca

SEQ ID NO: 6558 - RNA, 27 nt, Artificial Sequence
  Synthetic oligonucleotide
aaacuaacaguuacugcaaaaaauacc

SEQ ID NO: 6559 - RNA, 27 nt, Artificial Sequence
  Synthetic oligonucleotide
aaaaacuaacaguuacugcaaaaaacc

SEQ ID NO: 6560 - RNA, 27 nt, Artificial Sequence
  Synthetic oligonucleotide
uaaaaacuaacaguuacugcaaaaacc

SEQ ID NO: 6561 - RNA, 27 nt, Artificial Sequence
  Synthetic oligonucleotide
cuuaaaaacuaacaguuacugcaaacc

SEQ ID NO: 6562 - RNA, 27 nt, Artificial Sequence
  Synthetic oligonucleotide
acuacuuaaaaacuaacaguuacugac

SEQ ID NO: 6563 - RNA, 27 nt, Artificial Sequence
  Synthetic oligonucleotide
acacuacuuaaaaacuaacaguuacca

SEQ ID NO: 6564 - RNA, 27 nt, Artificial Sequence
  Synthetic oligonucleotide
cauaacacuacuuaaaaacuaacagcc

SEQ ID NO: 6565 - RNA, 27 nt, Artificial Sequence
  Synthetic oligonucleotide
acauaacacuacuuaaaaacuaacaac

SEQ ID NO: 6566 - RNA, 27 nt, Artificial Sequence
  Synthetic oligonucleotide
gaacauaacacuacuuaaaaacuaaac

SEQ ID NO: 6567 - RNA, 27 nt, Artificial Sequence
  Synthetic oligonucleotide
agaacauaacacuacuuaaaaacuaca

SEQ ID NO: 6568 - RNA, 27 nt, Artificial Sequence
  Synthetic oligonucleotide
uagaacauaacacuacuuaaaaacucc

SEQ ID NO: 6569 - RNA, 27 nt, Artificial Sequence
  Synthetic oligonucleotide
cuagaacauaacacuacuuaaaaaccc

SEQ ID NO: 6570 - RNA, 27 nt, Artificial Sequence
  Synthetic oligonucleotide
guucacuagaacauaacacuacuuacc

SEQ ID NO: 6571 - RNA, 27 nt, Artificial Sequence
  Synthetic oligonucleotide
agguucacuagaacauaacacuacucc

SEQ ID NO: 6572 - RNA, 27 nt, Artificial Sequence
  Synthetic oligonucleotide
cagguucacuagaacauaacacuaccc

SEQ ID NO: 6573 - RNA, 27 nt, Artificial Sequence
  Synthetic oligonucleotide
ccauuacucgguucuuagaaaucagcc

SEQ ID NO: 6574 - RNA, 27 nt, Artificial Sequence
  Synthetic oligonucleotide
acaccauuacucgguucuuagaaauac

SEQ ID NO: 6575 - RNA, 27 nt, Artificial Sequence
  Synthetic oligonucleotide
guucuacaccauuacucgguucuuaac

SEQ ID NO: 6576 - RNA, 27 nt, Artificial Sequence
  Synthetic oligonucleotide
augaauuaguguucuacaccauuacca

SEQ ID NO: 6577 - RNA, 27 nt, Artificial Sequence
  Synthetic oligonucleotide
ugauuaugaauuaguguucuacacccc

SEQ ID NO: 6578 - RNA, 27 nt, Artificial Sequence
  Synthetic oligonucleotide
gugauuaugaauuaguguucuacacac

SEQ ID NO: 6579 - RNA, 27 nt, Artificial Sequence
  Synthetic oligonucleotide
cgugauuaugaauuaguguucuacaaa

SEQ ID NO: 6580 - RNA, 27 nt, Artificial Sequence
  Synthetic oligonucleotide
uuacaauuagcgugauuaugaauuaac

SEQ ID NO: 6581 - RNA, 27 nt, Artificial Sequence
  Synthetic oligonucleotide
auuacaauuagcgugauuaugaauuca

SEQ ID NO: 6582 - RNA, 27 nt, Artificial Sequence
  Synthetic oligonucleotide
ccagauuacaauuagcgugauuaugcc

SEQ ID NO: 6583 - RNA, 27 nt, Artificial Sequence
  Synthetic oligonucleotide
guuacacgucuccagauuacaauuaaa

SEQ ID NO: 6584 - RNA, 27 nt, Artificial Sequence
  Synthetic oligonucleotide
auguuacacgucuccagauuacaaucc

SEQ ID NO: 6585 - RNA, 27 nt, Artificial Sequence
  Synthetic oligonucleotide
gcuacacaauguuacacgucuccagcc

SEQ ID NO: 6586 - RNA, 27 nt, Artificial Sequence
  Synthetic oligonucleotide
aggcuacacaauguuacacgucuccca

SEQ ID NO: 6587 - RNA, 27 nt, Artificial Sequence
  Synthetic oligonucleotide
auacaaaaggcuacacaauguuacaaa

SEQ ID NO: 6588 - RNA, 27 nt, Artificial Sequence
  Synthetic oligonucleotide
uauacaaaaggcuacacaauguuacca

SEQ ID NO: 6589 - RNA, 27 nt, Artificial Sequence
  Synthetic oligonucleotide
uauuuauacaaaaggcuacacaaugcc

SEQ ID NO: 6590 - RNA, 27 nt, Artificial Sequence
  Synthetic oligonucleotide
cuauuuauacaaaaggcuacacaauac

SEQ ID NO: 6591 - RNA, 27 nt, Artificial Sequence
  Synthetic oligonucleotide
ugucuauuuauacaaaaggcuacaccc

SEQ ID NO: 6592 - RNA, 27 nt, Artificial Sequence
  Synthetic oligonucleotide
cugucuauuuauacaaaaggcuacaac

SEQ ID NO: 6593 - RNA, 27 nt, Artificial Sequence
  Synthetic oligonucleotide
ucugucuauuuauacaaaaggcuacca

SEQ ID NO: 6594 - RNA, 27 nt, Artificial Sequence
  Synthetic oligonucleotide
uuucuaucugucuauuuauacaaaaaa

SEQ ID NO: 6595 - RNA, 27 nt, Artificial Sequence
  Synthetic oligonucleotide
auuucuaucugucuauuuauacaaaca

SEQ ID NO: 6596 - RNA, 27 nt, Artificial Sequence
  Synthetic oligonucleotide
cauuucuaucugucuauuuauacaacc

SEQ ID NO: 6597 - RNA, 27 nt, Artificial Sequence
  Synthetic oligonucleotide
ccauuucuaucugucuauuuauacacc

SEQ ID NO: 6598 - RNA, 27 nt, Artificial Sequence
  Synthetic oligonucleotide
cggaccauuucuaucugucuauuuacc

SEQ ID NO: 6599 - RNA, 27 nt, Artificial Sequence
  Synthetic oligonucleotide
ucggaccauuucuaucugucuauuucc

SEQ ID NO: 6600 - RNA, 27 nt, Artificial Sequence
  Synthetic oligonucleotide
aaacuaaucggaccauuucuaucugca

SEQ ID NO: 6601 - RNA, 27 nt, Artificial Sequence
  Synthetic oligonucleotide
gaaacuaaucggaccauuucuaucuac

SEQ ID NO: 6602 - RNA, 27 nt, Artificial Sequence
  Synthetic oligonucleotide
ggaaacuaaucggaccauuucuaucca

SEQ ID NO: 6603 - RNA, 27 nt, Artificial Sequence
  Synthetic oligonucleotide
aggaaacuaaucggaccauuucuauac

SEQ ID NO: 6604 - RNA, 27 nt, Artificial Sequence
  Synthetic oligonucleotide
auuaaaaaggaaacuaaucggaccacc

SEQ ID NO: 6605 - RNA, 27 nt, Artificial Sequence
  Synthetic oligonucleotide
aagcauauuaaaaaggaaacuaaucaa

SEQ ID NO: 6606 - RNA, 27 nt, Artificial Sequence
  Synthetic oligonucleotide
uaagcauauuaaaaaggaaacuaauaa

SEQ ID NO: 6607 - RNA, 27 nt, Artificial Sequence
  Synthetic oligonucleotide
auuuuaagcauauuaaaaaggaaaccc

SEQ ID NO: 6608 - RNA, 27 nt, Artificial Sequence
  Synthetic oligonucleotide
cugcuuauuuuaagcauauuaaaaaaa

SEQ ID NO: 6609 - RNA, 27 nt, Artificial Sequence
  Synthetic oligonucleotide
ccugcuuauuuuaagcauauuaaaaca

SEQ ID NO: 6610 - RNA, 27 nt, Artificial Sequence
  Synthetic oligonucleotide
gauccaccugcuuauuuuaagcauacc

SEQ ID NO: 6611 - RNA, 27 nt, Artificial Sequence
  Synthetic oligonucleotide
caaaaacaugaaauagauccaccugac

SEQ ID NO: 6612 - RNA, 27 nt, Artificial Sequence
  Synthetic oligonucleotide
ucaaaaacaugaaauagauccaccuaa

SEQ ID NO: 6613 - RNA, 27 nt, Artificial Sequence
  Synthetic oligonucleotide
guucaaaaacaugaaauagauccacac

SEQ ID NO: 6614 - RNA, 27 nt, Artificial Sequence
  Synthetic oligonucleotide
uguucaaaaacaugaaauagauccaaa

SEQ ID NO: 6615 - RNA, 27 nt, Artificial Sequence
  Synthetic oligonucleotide
uuguucaaaaacaugaaauagauccca

SEQ ID NO: 6616 - RNA, 27 nt, Artificial Sequence
  Synthetic oligonucleotide
aguuuuuguucaaaaacaugaaauaac

SEQ ID NO: 6617 - RNA, 27 nt, Artificial Sequence
  Synthetic oligonucleotide
cgauaaaguuuuuguucaaaaacauac

SEQ ID NO: 6618 - RNA, 27 nt, Artificial Sequence
  Synthetic oligonucleotide
uauccccgauaaaguuuuuguucaacc

SEQ ID NO: 6619 - RNA, 27 nt, Artificial Sequence
  Synthetic oligonucleotide
guauccccgauaaaguuuuuguucacc

SEQ ID NO: 6620 - RNA, 27 nt, Artificial Sequence
  Synthetic oligonucleotide
acaccucuuacugauuuacccuaccaa

SEQ ID NO: 6621 - RNA, 27 nt, Artificial Sequence
  Synthetic oligonucleotide
uaacaccucuuacugauuuacccuaaa

SEQ ID NO: 6622 - RNA, 27 nt, Artificial Sequence
  Synthetic oligonucleotide
auaacaccucuuacugauuuacccuca

SEQ ID NO: 6623 - RNA, 27 nt, Artificial Sequence
  Synthetic oligonucleotide
aauaacaccucuuacugauuuaccccc

SEQ ID NO: 6624 - RNA, 27 nt, Artificial Sequence
  Synthetic oligonucleotide
aaauaacaccucuuacugauuuaccac

SEQ ID NO: 6625 - RNA, 27 nt, Artificial Sequence
  Synthetic oligonucleotide
caaauaacaccucuuacugauuuacaa

SEQ ID NO: 6626 - RNA, 27 nt, Artificial Sequence
  Synthetic oligonucleotide
aaggcucaaauaacaccucuuacugcc

SEQ ID NO: 6627 - RNA, 27 nt, Artificial Sequence
  Synthetic oligonucleotide
aaaacaaggcucaaauaacaccucucc

SEQ ID NO: 6628 - RNA, 27 nt, Artificial Sequence
  Synthetic oligonucleotide
caaaacaaggcucaaauaacaccuccc

SEQ ID NO: 6629 - RNA, 27 nt, Artificial Sequence
  Synthetic oligonucleotide
ccaaaacaaggcucaaauaacaccuac

SEQ ID NO: 6630 - RNA, 27 nt, Artificial Sequence
  Synthetic oligonucleotide
uguccaaaacaaggcucaaauaacaaa

SEQ ID NO: 6631 - RNA, 27 nt, Artificial Sequence
  Synthetic oligonucleotide
acuguccaaaacaaggcucaaauaaac

SEQ ID NO: 6632 - RNA, 27 nt, Artificial Sequence
  Synthetic oligonucleotide
gguauacuguccaaaacaaggcucacc

SEQ ID NO: 6633 - RNA, 27 nt, Artificial Sequence
  Synthetic oligonucleotide
aggcaacugguauacuguccaaaaccc

SEQ ID NO: 6634 - RNA, 27 nt, Artificial Sequence
  Synthetic oligonucleotide
gggauaaaaggcaacugguauacugca

SEQ ID NO: 6635 - RNA, 27 nt, Artificial Sequence
  Synthetic oligonucleotide
ugggauaaaaggcaacugguauacuac

SEQ ID NO: 6636 - RNA, 27 nt, Artificial Sequence
  Synthetic oligonucleotide
acaacuuugggauaaaaggcaacugac

SEQ ID NO: 6637 - RNA, 27 nt, Artificial Sequence
  Synthetic oligonucleotide
caacaacuuugggauaaaaggcaacca

SEQ ID NO: 6638 - RNA, 27 nt, Artificial Sequence
  Synthetic oligonucleotide
gguuacaacaacuuugggauaaaagaa

SEQ ID NO: 6639 - RNA, 27 nt, Artificial Sequence
  Synthetic oligonucleotide
agguuacaacaacuuugggauaaaaaa

SEQ ID NO: 6640 - RNA, 27 nt, Artificial Sequence
  Synthetic oligonucleotide
cagguuacaacaacuuugggauaaaca

SEQ ID NO: 6641 - RNA, 27 nt, Artificial Sequence
  Synthetic oligonucleotide
uaucacagcagguuacaacaacuuuaa

SEQ ID NO: 6642 - RNA, 27 nt, Artificial Sequence
  Synthetic oligonucleotide
guaucacagcagguuacaacaacuuca

SEQ ID NO: 6643 - RNA, 27 nt, Artificial Sequence
  Synthetic oligonucleotide
uuguaucacagcagguuacaacaaccc

SEQ ID NO: 6644 - RNA, 27 nt, Artificial Sequence
  Synthetic oligonucleotide
ccgcaucuguugaagcauuguaucaac

SEQ ID NO: 6645 - RNA, 27 nt, Artificial Sequence
  Synthetic oligonucleotide
ucugaaccauuucuauaaccgcaucca

SEQ ID NO: 6646 - RNA, 27 nt, Artificial Sequence
  Synthetic oligonucleotide
uaauucugaaccauuucuauaaccgac

SEQ ID NO: 6647 - RNA, 27 nt, Artificial Sequence
  Synthetic oligonucleotide
uuuaauucugaaccauuucuauaacaa

SEQ ID NO: 6648 - RNA, 27 nt, Artificial Sequence
  Synthetic oligonucleotide
guuuaauucugaaccauuucuauaaaa

SEQ ID NO: 6649 - RNA, 27 nt, Artificial Sequence
  Synthetic oligonucleotide
aguuuaauucugaaccauuucuauaca

SEQ ID NO: 6650 - RNA, 27 nt, Artificial Sequence
  Synthetic oligonucleotide
aaguuuaauucugaaccauuucuaucc

SEQ ID NO: 6651 - RNA, 27 nt, Artificial Sequence
  Synthetic oligonucleotide
auuaaaaguuuaauucugaaccauuca

SEQ ID NO: 6652 - RNA, 27 nt, Artificial Sequence
  Synthetic oligonucleotide
aauuaaaaguuuaauucugaaccaucc

SEQ ID NO: 6653 - RNA, 27 nt, Artificial Sequence
  Synthetic oligonucleotide
ugaauuaaaaguuuaauucugaacccc

SEQ ID NO: 6654 - RNA, 27 nt, Artificial Sequence
  Synthetic oligonucleotide
uuugaaugaauuaaaaguuuaauucca

SEQ ID NO: 6655 - RNA, 27 nt, Artificial Sequence
  Synthetic oligonucleotide
uuuuuuugaaugaauuaaaaguuuacc

SEQ ID NO: 6656 - RNA, 27 nt, Artificial Sequence
  Synthetic oligonucleotide
uuuuuuuuuuugaaugaauuaaaagcc

SEQ ID NO: 6657 - RNA, 27 nt, Artificial Sequence
  Synthetic oligonucleotide
uuuuuuuuuuuugaaugaauuaaaaac

SEQ ID NO: 6658 - RNA, 27 nt, Artificial Sequence
  Synthetic oligonucleotide
uuuuuuuuuuuuugaaugaauuaaaca

SEQ ID NO: 6659 - RNA, 27 nt, Artificial Sequence
  Synthetic oligonucleotide
uuuuuuuuuuuuuugaaugaauuaacc

SEQ ID NO: 6660 - RNA, 27 nt, Artificial Sequence
  Synthetic oligonucleotide
uuuuuuuuuuuuuuugaaugaauuacc

SEQ ID NO: 6661 - RNA, 27 nt, Artificial Sequence
  Synthetic oligonucleotide
uuuuuuuuuuuuuuuugaaugaauucc

SEQ ID NO: 6662 - RNA, 27 nt, Artificial Sequence
  Synthetic oligonucleotide
cccugaggguauuugaaguauaccaua

SEQ ID NO: 6663 - RNA, 27 nt, Artificial Sequence
  Synthetic oligonucleotide
gaggguauuugaaguauaccauacaac

SEQ ID NO: 6664 - RNA, 27 nt, Artificial Sequence
  Synthetic oligonucleotide
ugaaguauaccauacaacuguuuugaa

SEQ ID NO: 6665 - RNA, 27 nt, Artificial Sequence
  Synthetic oligonucleotide
auaccauacaacuguuuugaaaaucca

SEQ ID NO: 6666 - RNA, 27 nt, Artificial Sequence
  Synthetic oligonucleotide
auacaacuguuuugaaaauccagcgug

SEQ ID NO: 6667 - RNA, 27 nt, Artificial Sequence
  Synthetic oligonucleotide
cagggauuuucucaguccuucacucaa

SEQ ID NO: 6668 - RNA, 27 nt, Artificial Sequence
  Synthetic oligonucleotide
cacucaagaacaaguagcugauauuga

SEQ ID NO: 6669 - RNA, 27 nt, Artificial Sequence
  Synthetic oligonucleotide
agaacaaguagcugauauugauggaca

SEQ ID NO: 6670 - RNA, 27 nt, Artificial Sequence
  Synthetic oligonucleotide
aacaaguagcugauauugauggacagu

SEQ ID NO: 6671 - RNA, 27 nt, Artificial Sequence
  Synthetic oligonucleotide
ugauggacaguaugcaaugacucgagc

SEQ ID NO: 6672 - RNA, 27 nt, Artificial Sequence
  Synthetic oligonucleotide
ugcuauguucccugagacauuagauga

SEQ ID NO: 6673 - RNA, 27 nt, Artificial Sequence
  Synthetic oligonucleotide
ugcugaaacaugcaguuguaaacuuga

SEQ ID NO: 6674 - RNA, 27 nt, Artificial Sequence
  Synthetic oligonucleotide
aacaugcaguuguaaacuugauuaacu

SEQ ID NO: 6675 - RNA, 27 nt, Artificial Sequence
  Synthetic oligonucleotide
gcaguuguaaacuugauuaacuaucaa

SEQ ID NO: 6676 - RNA, 27 nt, Artificial Sequence
  Synthetic oligonucleotide
acuugauuaacuaucaagaugaugcag

SEQ ID NO: 6677 - RNA, 27 nt, Artificial Sequence
  Synthetic oligonucleotide
cccugaacugacaaaacugcuaaauga

SEQ ID NO: 6678 - RNA, 27 nt, Artificial Sequence
  Synthetic oligonucleotide
ucagauggugucugcuauuguacguac

SEQ ID NO: 6679 - RNA, 27 nt, Artificial Sequence
  Synthetic oligonucleotide
guacguaccaugcagaauacaaaugau

SEQ ID NO: 6680 - RNA, 27 nt, Artificial Sequence
  Synthetic oligonucleotide
auuacaacucuccacaaccuuuuauua

SEQ ID NO: 6681 - RNA, 27 nt, Artificial Sequence
  Synthetic oligonucleotide
aacucuccacaaccuuuuauuacauca

SEQ ID NO: 6682 - RNA, 27 nt, Artificial Sequence
  Synthetic oligonucleotide
uccacaaccuuuuauuacaucaagaag

SEQ ID NO: 6683 - RNA, 27 nt, Artificial Sequence
  Synthetic oligonucleotide
accuuuuauuacaucaagaaggagcua

SEQ ID NO: 6684 - RNA, 27 nt, Artificial Sequence
  Synthetic oligonucleotide
acaaaacaaauguuaaauucuuggcua

SEQ ID NO: 6685 - RNA, 27 nt, Artificial Sequence
  Synthetic oligonucleotide
auuacgacagacugccuucaaauuuua

SEQ ID NO: 6686 - RNA, 27 nt, Artificial Sequence
  Synthetic oligonucleotide
gacagacugccuucaaauuuuagcuua

SEQ ID NO: 6687 - RNA, 27 nt, Artificial Sequence
  Synthetic oligonucleotide
agcuuuaguaaauauaaugaggaccua

SEQ ID NO: 6688 - RNA, 27 nt, Artificial Sequence
  Synthetic oligonucleotide
gaaaaacuacuguggaccacaagcaga

SEQ ID NO: 6689 - RNA, 27 nt, Artificial Sequence
  Synthetic oligonucleotide
caagucaacgucuuguucagaacuguc

SEQ ID NO: 6690 - RNA, 27 nt, Artificial Sequence
  Synthetic oligonucleotide
aacgucuuguucagaacugucuuugga

SEQ ID NO: 6691 - RNA, 27 nt, Artificial Sequence
  Synthetic oligonucleotide
cuuguucagaacugucuuuggacucuc

SEQ ID NO: 6692 - RNA, 27 nt, Artificial Sequence
  Synthetic oligonucleotide
uggguucagaugauauaaaugugguca

SEQ ID NO: 6693 - RNA, 27 nt, Artificial Sequence
  Synthetic oligonucleotide
auucuuucuaaccucacuugcaauaau

SEQ ID NO: 6694 - RNA, 27 nt, Artificial Sequence
  Synthetic oligonucleotide
accucacuugcaauaauuauaagaaca

SEQ ID NO: 6695 - RNA, 27 nt, Artificial Sequence
  Synthetic oligonucleotide
ugcaauaauuauaagaacaagaugaug

SEQ ID NO: 6696 - RNA, 27 nt, Artificial Sequence
  Synthetic oligonucleotide
ugguauagaggcucuugugcguacugu

SEQ ID NO: 6697 - RNA, 27 nt, Artificial Sequence
  Synthetic oligonucleotide
aaggcuacuguuggauugauucgaaau

SEQ ID NO: 6698 - RNA, 27 nt, Artificial Sequence
  Synthetic oligonucleotide
cgcauggaagaaauaguugaagguugu

SEQ ID NO: 6699 - RNA, 27 nt, Artificial Sequence
  Synthetic oligonucleotide
cauggaagaaauaguugaagguuguac

SEQ ID NO: 6700 - RNA, 27 nt, Artificial Sequence
  Synthetic oligonucleotide
ccauugaaaacauccaaagaguagcug

SEQ ID NO: 6701 - RNA, 27 nt, Artificial Sequence
  Synthetic oligonucleotide
cugaggacaagccacaagauuacaaga

SEQ ID NO: 6702 - RNA, 27 nt, Artificial Sequence
  Synthetic oligonucleotide
uugauacugaccuguaaaucauccuuu

SEQ ID NO: 6703 - RNA, 27 nt, Artificial Sequence
  Synthetic oligonucleotide
cuuuagguaagaaguuuuaaaaagcca

SEQ ID NO: 6704 - RNA, 27 nt, Artificial Sequence
  Synthetic oligonucleotide
aacagguauauacuuugaaaggagaug

SEQ ID NO: 6705 - RNA, 27 nt, Artificial Sequence
  Synthetic oligonucleotide
uggaaguuauuaacuuuaauguuuuuu

SEQ ID NO: 6706 - RNA, 27 nt, Artificial Sequence
  Synthetic oligonucleotide
ugccacagcuuuugcaacuuaauacuc

SEQ ID NO: 6707 - RNA, 27 nt, Artificial Sequence
  Synthetic oligonucleotide
aacauuugcuguuuuaaacauuaauag

SEQ ID NO: 6708 - RNA, 27 nt, Artificial Sequence
  Synthetic oligonucleotide
aacaauugaaguaaacuuuuuguucug

SEQ ID NO: 6709 - RNA, 27 nt, Artificial Sequence
  Synthetic oligonucleotide
aaacccuagccuugcuuguuaaauuuu

SEQ ID NO: 6710 - RNA, 27 nt, Artificial Sequence
  Synthetic oligonucleotide
uagccuugcuuguuaaauuuuuuuuuu

SEQ ID NO: 6711 - RNA, 27 nt, Artificial Sequence
  Synthetic oligonucleotide
uugaaguagcucuuuuuuuuuuuuuuu

SEQ ID NO: 6712 - RNA, 27 nt, Artificial Sequence
  Synthetic oligonucleotide
ucguaguguuaaguuauagugaauacu

SEQ ID NO: 6713 - RNA, 27 nt, Artificial Sequence
  Synthetic oligonucleotide
uagugaauacugcuacagcaauuucua

SEQ ID NO: 6714 - RNA, 27 nt, Artificial Sequence
  Synthetic oligonucleotide
aauacugcuacagcaauuucuaauuuu

SEQ ID NO: 6715 - RNA, 27 nt, Artificial Sequence
  Synthetic oligonucleotide
uucuaauuuuuaagaauugaguaaugg

SEQ ID NO: 6716 - RNA, 27 nt, Artificial Sequence
  Synthetic oligonucleotide
auuuuuaagaauugaguaaugguguag

SEQ ID NO: 6717 - RNA, 27 nt, Artificial Sequence
  Synthetic oligonucleotide
uucauaaucacucuaauuaauuguaau

SEQ ID NO: 6718 - RNA, 27 nt, Artificial Sequence
  Synthetic oligonucleotide
auuaauuguaaucugaauaaaguguaa

SEQ ID NO: 6719 - RNA, 27 nt, Artificial Sequence
  Synthetic oligonucleotide
uuguaaucugaauaaaguguaacaauu

SEQ ID NO: 6720 - RNA, 27 nt, Artificial Sequence
  Synthetic oligonucleotide
ucugaauaaaguguaacaauuguguag

SEQ ID NO: 6721 - RNA, 27 nt, Artificial Sequence
  Synthetic oligonucleotide
guguagccuuuuuguauaaaauagaca

SEQ ID NO: 6722 - RNA, 27 nt, Artificial Sequence
  Synthetic oligonucleotide
uuuguauaaaauagacaaauagaaaau

SEQ ID NO: 6723 - RNA, 27 nt, Artificial Sequence
  Synthetic oligonucleotide
agaaaaugguccaauuaguuuccuuuu

SEQ ID NO: 6724 - RNA, 27 nt, Artificial Sequence
  Synthetic oligonucleotide
guccaauuaguuuccuuuuuaauaugc

SEQ ID NO: 6725 - RNA, 27 nt, Artificial Sequence
  Synthetic oligonucleotide
uuuuugaucaaaaacuauuugggauau

SEQ ID NO: 6726 - RNA, 27 nt, Artificial Sequence
  Synthetic oligonucleotide
aagagguguuauuuggaaccuuguuuu

SEQ ID NO: 6727 - RNA, 27 nt, Artificial Sequence
  Synthetic oligonucleotide
guguuauuuggaaccuuguuuuggaca

SEQ ID NO: 6728 - RNA, 27 nt, Artificial Sequence
  Synthetic oligonucleotide
gaaccuuguuuuggacaguuuaccagu

SEQ ID NO: 6729 - RNA, 27 nt, Artificial Sequence
  Synthetic oligonucleotide
gugauacgaugcuucaagagaaaaugc

SEQ ID NO: 6730 - RNA, 27 nt, Artificial Sequence
  Synthetic oligonucleotide
uucaagagaaaaugcgguuauaaaaaa

SEQ ID NO: 6731 - RNA, 27 nt, Artificial Sequence
  Synthetic oligonucleotide
gagaaaaugcgguuauaaaaaaugguu

SEQ ID NO: 6732 - RNA, 27 nt, Artificial Sequence
  Synthetic oligonucleotide
cgguuauaaaaaaugguucagaauuaa

SEQ ID NO: 6733 - RNA, 27 nt, Artificial Sequence
  Synthetic oligonucleotide
aaaaaaugguucagaauuaaacuuuua

SEQ ID NO: 6734 - RNA, 27 nt, Artificial Sequence
  Synthetic oligonucleotide
cagcguggacaauggcuacucaagcug

SEQ ID NO: 6735 - RNA, 27 nt, Artificial Sequence
  Synthetic oligonucleotide
agcguggacaauggcuacucaagcuga

SEQ ID NO: 6736 - RNA, 27 nt, Artificial Sequence
  Synthetic oligonucleotide
gcguggacaauggcuacucaagcugau

SEQ ID NO: 6737 - RNA, 27 nt, Artificial Sequence
  Synthetic oligonucleotide
cguggacaauggcuacucaagcugauu

SEQ ID NO: 6738 - RNA, 27 nt, Artificial Sequence
  Synthetic oligonucleotide
guggacaauggcuacucaagcugauuu

SEQ ID NO: 6739 - RNA, 27 nt, Artificial Sequence
  Synthetic oligonucleotide
uggacaauggcuacucaagcugauuug

SEQ ID NO: 6740 - RNA, 27 nt, Artificial Sequence
  Synthetic oligonucleotide
ggacaauggcuacucaagcugauuuga

SEQ ID NO: 6741 - RNA, 27 nt, Artificial Sequence
  Synthetic oligonucleotide
gacaauggcuacucaagcugauuugau

SEQ ID NO: 6742 - RNA, 27 nt, Artificial Sequence
  Synthetic oligonucleotide
uuugauggaguuggacauggccaugga

SEQ ID NO: 6743 - RNA, 27 nt, Artificial Sequence
  Synthetic oligonucleotide
uugauggaguuggacauggccauggaa

SEQ ID NO: 6744 - RNA, 27 nt, Artificial Sequence
  Synthetic oligonucleotide
ugauggaguuggacauggccauggaac

SEQ ID NO: 6745 - RNA, 27 nt, Artificial Sequence
  Synthetic oligonucleotide
gauggaguuggacauggccauggaacc

SEQ ID NO: 6746 - RNA, 27 nt, Artificial Sequence
  Synthetic oligonucleotide
auggaguuggacauggccauggaacca

SEQ ID NO: 6747 - RNA, 27 nt, Artificial Sequence
  Synthetic oligonucleotide
uggaguuggacauggccauggaaccag

SEQ ID NO: 6748 - RNA, 27 nt, Artificial Sequence
  Synthetic oligonucleotide
ggaguuggacauggccauggaaccaga

SEQ ID NO: 6749 - RNA, 27 nt, Artificial Sequence
  Synthetic oligonucleotide
acucuggaauccauucuggugccacua

SEQ ID NO: 6750 - RNA, 27 nt, Artificial Sequence
  Synthetic oligonucleotide
cucuggaauccauucuggugccacuac

SEQ ID NO: 6751 - RNA, 27 nt, Artificial Sequence
  Synthetic oligonucleotide
ucuggaauccauucuggugccacuacc

SEQ ID NO: 6752 - RNA, 27 nt, Artificial Sequence
  Synthetic oligonucleotide
cuggaauccauucuggugccacuacca

SEQ ID NO: 6753 - RNA, 27 nt, Artificial Sequence
  Synthetic oligonucleotide
uggaauccauucuggugccacuaccac

SEQ ID NO: 6754 - RNA, 27 nt, Artificial Sequence
  Synthetic oligonucleotide
auuagaugagggcaugcagaucccauc

SEQ ID NO: 6755 - RNA, 27 nt, Artificial Sequence
  Synthetic oligonucleotide
uuagaugagggcaugcagaucccaucu

SEQ ID NO: 6756 - RNA, 27 nt, Artificial Sequence
  Synthetic oligonucleotide
uagaugagggcaugcagaucccaucua

SEQ ID NO: 6757 - RNA, 27 nt, Artificial Sequence
  Synthetic oligonucleotide
agaugagggcaugcagaucccaucuac

SEQ ID NO: 6758 - RNA, 27 nt, Artificial Sequence
  Synthetic oligonucleotide
gaugagggcaugcagaucccaucuaca

SEQ ID NO: 6759 - RNA, 27 nt, Artificial Sequence
  Synthetic oligonucleotide
augagggcaugcagaucccaucuacac

SEQ ID NO: 6760 - RNA, 27 nt, Artificial Sequence
  Synthetic oligonucleotide
augcugcucaucccacuaauguccagc

SEQ ID NO: 6761 - RNA, 27 nt, Artificial Sequence
  Synthetic oligonucleotide
ugcugcucaucccacuaauguccagcg

SEQ ID NO: 6762 - RNA, 27 nt, Artificial Sequence
  Synthetic oligonucleotide
gcugcucaucccacuaauguccagcgu

SEQ ID NO: 6763 - RNA, 27 nt, Artificial Sequence
  Synthetic oligonucleotide
cugcucaucccacuaauguccagcguu

SEQ ID NO: 6764 - RNA, 27 nt, Artificial Sequence
  Synthetic oligonucleotide
ugcucaucccacuaauguccagcguuu

SEQ ID NO: 6765 - RNA, 27 nt, Artificial Sequence
  Synthetic oligonucleotide
gcucaucccacuaauguccagcguuug

SEQ ID NO: 6766 - RNA, 27 nt, Artificial Sequence
  Synthetic oligonucleotide
cucaucccacuaauguccagcguuugg

SEQ ID NO: 6767 - RNA, 27 nt, Artificial Sequence
  Synthetic oligonucleotide
ucaucccacuaauguccagcguuuggc

SEQ ID NO: 6768 - RNA, 27 nt, Artificial Sequence
  Synthetic oligonucleotide
guuuggcugaaccaucacagaugcuga

SEQ ID NO: 6769 - RNA, 27 nt, Artificial Sequence
  Synthetic oligonucleotide
uuuggcugaaccaucacagaugcugaa

SEQ ID NO: 6770 - RNA, 27 nt, Artificial Sequence
  Synthetic oligonucleotide
uuggcugaaccaucacagaugcugaaa

SEQ ID NO: 6771 - RNA, 27 nt, Artificial Sequence
  Synthetic oligonucleotide
cagaacuugccacacgugcaaucccug

SEQ ID NO: 6772 - RNA, 27 nt, Artificial Sequence
  Synthetic oligonucleotide
agaacuugccacacgugcaaucccuga

SEQ ID NO: 6773 - RNA, 27 nt, Artificial Sequence
  Synthetic oligonucleotide
caguuaugguccaucagcuuucuaaaa

SEQ ID NO: 6774 - RNA, 27 nt, Artificial Sequence
  Synthetic oligonucleotide
aguuaugguccaucagcuuucuaaaaa

SEQ ID NO: 6775 - RNA, 27 nt, Artificial Sequence
  Synthetic oligonucleotide
cuaaaaaggaagcuuccagacacgcua

SEQ ID NO: 6776 - RNA, 27 nt, Artificial Sequence
  Synthetic oligonucleotide
uaaaaaggaagcuuccagacacgcuau

SEQ ID NO: 6777 - RNA, 27 nt, Artificial Sequence
  Synthetic oligonucleotide
guaccaugcagaauacaaaugauguag

SEQ ID NO: 6778 - RNA, 27 nt, Artificial Sequence
  Synthetic oligonucleotide
uaccaugcagaauacaaaugauguaga

SEQ ID NO: 6779 - RNA, 27 nt, Artificial Sequence
  Synthetic oligonucleotide
accaugcagaauacaaaugauguagaa

SEQ ID NO: 6780 - RNA, 27 nt, Artificial Sequence
  Synthetic oligonucleotide
ccaugcagaauacaaaugauguagaaa

SEQ ID NO: 6781 - RNA, 27 nt, Artificial Sequence
  Synthetic oligonucleotide
caugcagaauacaaaugauguagaaac

SEQ ID NO: 6782 - RNA, 27 nt, Artificial Sequence
  Synthetic oligonucleotide
augcagaauacaaaugauguagaaaca

SEQ ID NO: 6783 - RNA, 27 nt, Artificial Sequence
  Synthetic oligonucleotide
ugcagaauacaaaugauguagaaacag

SEQ ID NO: 6784 - RNA, 27 nt, Artificial Sequence
  Synthetic oligonucleotide
gcagaauacaaaugauguagaaacagc

SEQ ID NO: 6785 - RNA, 27 nt, Artificial Sequence
  Synthetic oligonucleotide
uacuggccaucuuuaagucuggaggca

SEQ ID NO: 6786 - RNA, 27 nt, Artificial Sequence
  Synthetic oligonucleotide
acuggccaucuuuaagucuggaggcau

SEQ ID NO: 6787 - RNA, 27 nt, Artificial Sequence
  Synthetic oligonucleotide
aagaaggagcuaaaauggcagugcguu

SEQ ID NO: 6788 - RNA, 27 nt, Artificial Sequence
  Synthetic oligonucleotide
agaaggagcuaaaauggcagugcguuu

SEQ ID NO: 6789 - RNA, 27 nt, Artificial Sequence
  Synthetic oligonucleotide
gaaggagcuaaaauggcagugcguuua

SEQ ID NO: 6790 - RNA, 27 nt, Artificial Sequence
  Synthetic oligonucleotide
aaggagcuaaaauggcagugcguuuag

SEQ ID NO: 6791 - RNA, 27 nt, Artificial Sequence
  Synthetic oligonucleotide
aggagcuaaaauggcagugcguuuagc

SEQ ID NO: 6792 - RNA, 27 nt, Artificial Sequence
  Synthetic oligonucleotide
uacuguggaccacaagcagagugcuga

SEQ ID NO: 6793 - RNA, 27 nt, Artificial Sequence
  Synthetic oligonucleotide
acuguggaccacaagcagagugcugaa

SEQ ID NO: 6794 - RNA, 27 nt, Artificial Sequence
  Synthetic oligonucleotide
cuguggaccacaagcagagugcugaag

SEQ ID NO: 6795 - RNA, 27 nt, Artificial Sequence
  Synthetic oligonucleotide
uguggaccacaagcagagugcugaagg

SEQ ID NO: 6796 - RNA, 27 nt, Artificial Sequence
  Synthetic oligonucleotide
guggaccacaagcagagugcugaaggu

SEQ ID NO: 6797 - RNA, 27 nt, Artificial Sequence
  Synthetic oligonucleotide
uggaccacaagcagagugcugaaggug

SEQ ID NO: 6798 - RNA, 27 nt, Artificial Sequence
  Synthetic oligonucleotide
ggaccacaagcagagugcugaaggugc

SEQ ID NO: 6799 - RNA, 27 nt, Artificial Sequence
  Synthetic oligonucleotide
gaccacaagcagagugcugaaggugcu

SEQ ID NO: 6800 - RNA, 27 nt, Artificial Sequence
  Synthetic oligonucleotide
accacaagcagagugcugaaggugcua

SEQ ID NO: 6801 - RNA, 27 nt, Artificial Sequence
  Synthetic oligonucleotide
ccacaagcagagugcugaaggugcuau

SEQ ID NO: 6802 - RNA, 27 nt, Artificial Sequence
  Synthetic oligonucleotide
cacaagcagagugcugaaggugcuauc

SEQ ID NO: 6803 - RNA, 27 nt, Artificial Sequence
  Synthetic oligonucleotide
acaagcagagugcugaaggugcuaucu

SEQ ID NO: 6804 - RNA, 27 nt, Artificial Sequence
  Synthetic oligonucleotide
caagcagagugcugaaggugcuaucug

SEQ ID NO: 6805 - RNA, 27 nt, Artificial Sequence
  Synthetic oligonucleotide
aagcagagugcugaaggugcuaucugu

SEQ ID NO: 6806 - RNA, 27 nt, Artificial Sequence
  Synthetic oligonucleotide
agaacugucuuuggacucucaggaauc

SEQ ID NO: 6807 - RNA, 27 nt, Artificial Sequence
  Synthetic oligonucleotide
gaacugucuuuggacucucaggaaucu

SEQ ID NO: 6808 - RNA, 27 nt, Artificial Sequence
  Synthetic oligonucleotide
cagaugauauaaauguggucaccugug

SEQ ID NO: 6809 - RNA, 27 nt, Artificial Sequence
  Synthetic oligonucleotide
agaugauauaaauguggucaccugugc

SEQ ID NO: 6810 - RNA, 27 nt, Artificial Sequence
  Synthetic oligonucleotide
gaugauauaaauguggucaccugugca

SEQ ID NO: 6811 - RNA, 27 nt, Artificial Sequence
  Synthetic oligonucleotide
augauauaaauguggucaccugugcag

SEQ ID NO: 6812 - RNA, 27 nt, Artificial Sequence
  Synthetic oligonucleotide
ugauauaaauguggucaccugugcagc

SEQ ID NO: 6813 - RNA, 27 nt, Artificial Sequence
  Synthetic oligonucleotide
gauauaaauguggucaccugugcagcu

SEQ ID NO: 6814 - RNA, 27 nt, Artificial Sequence
  Synthetic oligonucleotide
auauaaauguggucaccugugcagcug

SEQ ID NO: 6815 - RNA, 27 nt, Artificial Sequence
  Synthetic oligonucleotide
uauaaauguggucaccugugcagcugg

SEQ ID NO: 6816 - RNA, 27 nt, Artificial Sequence
  Synthetic oligonucleotide
auaaauguggucaccugugcagcugga

SEQ ID NO: 6817 - RNA, 27 nt, Artificial Sequence
  Synthetic oligonucleotide
uaaauguggucaccugugcagcuggaa

SEQ ID NO: 6818 - RNA, 27 nt, Artificial Sequence
  Synthetic oligonucleotide
aaauguggucaccugugcagcuggaau

SEQ ID NO: 6819 - RNA, 27 nt, Artificial Sequence
  Synthetic oligonucleotide
aauguggucaccugugcagcuggaauu

SEQ ID NO: 6820 - RNA, 27 nt, Artificial Sequence
  Synthetic oligonucleotide
auguggucaccugugcagcuggaauuc

SEQ ID NO: 6821 - RNA, 27 nt, Artificial Sequence
  Synthetic oligonucleotide
uguggucaccugugcagcuggaauucu

SEQ ID NO: 6822 - RNA, 27 nt, Artificial Sequence
  Synthetic oligonucleotide
guggucaccugugcagcuggaauucuu

SEQ ID NO: 6823 - RNA, 27 nt, Artificial Sequence
  Synthetic oligonucleotide
uggucaccugugcagcuggaauucuuu

SEQ ID NO: 6824 - RNA, 27 nt, Artificial Sequence
  Synthetic oligonucleotide
ggucaccugugcagcuggaauucuuuc

SEQ ID NO: 6825 - RNA, 27 nt, Artificial Sequence
  Synthetic oligonucleotide
gucaccugugcagcuggaauucuuucu

SEQ ID NO: 6826 - RNA, 27 nt, Artificial Sequence
  Synthetic oligonucleotide
ucaccugugcagcuggaauucuuucua

SEQ ID NO: 6827 - RNA, 27 nt, Artificial Sequence
  Synthetic oligonucleotide
caccugugcagcuggaauucuuucuaa

SEQ ID NO: 6828 - RNA, 27 nt, Artificial Sequence
  Synthetic oligonucleotide
uuucuaaccucacuugcaauaauuaua

SEQ ID NO: 6829 - RNA, 27 nt, Artificial Sequence
  Synthetic oligonucleotide
uucuaaccucacuugcaauaauuauaa

SEQ ID NO: 6830 - RNA, 27 nt, Artificial Sequence
  Synthetic oligonucleotide
ucuaaccucacuugcaauaauuauaag

SEQ ID NO: 6831 - RNA, 27 nt, Artificial Sequence
  Synthetic oligonucleotide
cuaaccucacuugcaauaauuauaaga

SEQ ID NO: 6832 - RNA, 27 nt, Artificial Sequence
  Synthetic oligonucleotide
uaaccucacuugcaauaauuauaagaa

SEQ ID NO: 6833 - RNA, 27 nt, Artificial Sequence
  Synthetic oligonucleotide
gggcuggugacagggaagacaucacug

SEQ ID NO: 6834 - RNA, 27 nt, Artificial Sequence
  Synthetic oligonucleotide
ggcuggugacagggaagacaucacuga

SEQ ID NO: 6835 - RNA, 27 nt, Artificial Sequence
  Synthetic oligonucleotide
gcuggugacagggaagacaucacugag

SEQ ID NO: 6836 - RNA, 27 nt, Artificial Sequence
  Synthetic oligonucleotide
cuggugacagggaagacaucacugagc

SEQ ID NO: 6837 - RNA, 27 nt, Artificial Sequence
  Synthetic oligonucleotide
uggugacagggaagacaucacugagcc

SEQ ID NO: 6838 - RNA, 27 nt, Artificial Sequence
  Synthetic oligonucleotide
ggugacagggaagacaucacugagccu

SEQ ID NO: 6839 - RNA, 27 nt, Artificial Sequence
  Synthetic oligonucleotide
gugacagggaagacaucacugagccug

SEQ ID NO: 6840 - RNA, 27 nt, Artificial Sequence
  Synthetic oligonucleotide
ugacagggaagacaucacugagccugc

SEQ ID NO: 6841 - RNA, 27 nt, Artificial Sequence
  Synthetic oligonucleotide
gacagggaagacaucacugagccugcc

SEQ ID NO: 6842 - RNA, 27 nt, Artificial Sequence
  Synthetic oligonucleotide
acagggaagacaucacugagccugcca

SEQ ID NO: 6843 - RNA, 27 nt, Artificial Sequence
  Synthetic oligonucleotide
cagggaagacaucacugagccugccau

SEQ ID NO: 6844 - RNA, 27 nt, Artificial Sequence
  Synthetic oligonucleotide
agggaagacaucacugagccugccauc

SEQ ID NO: 6845 - RNA, 27 nt, Artificial Sequence
  Synthetic oligonucleotide
gggaagacaucacugagccugccaucu

SEQ ID NO: 6846 - RNA, 27 nt, Artificial Sequence
  Synthetic oligonucleotide
ggaagacaucacugagccugccaucug

SEQ ID NO: 6847 - RNA, 27 nt, Artificial Sequence
  Synthetic oligonucleotide
gaagacaucacugagccugccaucugu

SEQ ID NO: 6848 - RNA, 27 nt, Artificial Sequence
  Synthetic oligonucleotide
aagacaucacugagccugccaucugug

SEQ ID NO: 6849 - RNA, 27 nt, Artificial Sequence
  Synthetic oligonucleotide
agacaucacugagccugccaucugugc

SEQ ID NO: 6850 - RNA, 27 nt, Artificial Sequence
  Synthetic oligonucleotide
gacaucacugagccugccaucugugcu

SEQ ID NO: 6851 - RNA, 27 nt, Artificial Sequence
  Synthetic oligonucleotide
acaucacugagccugccaucugugcuc

SEQ ID NO: 6852 - RNA, 27 nt, Artificial Sequence
  Synthetic oligonucleotide
caucacugagccugccaucugugcucu

SEQ ID NO: 6853 - RNA, 27 nt, Artificial Sequence
  Synthetic oligonucleotide
aucacugagccugccaucugugcucuu

SEQ ID NO: 6854 - RNA, 27 nt, Artificial Sequence
  Synthetic oligonucleotide
ucacugagccugccaucugugcucuuc

SEQ ID NO: 6855 - RNA, 27 nt, Artificial Sequence
  Synthetic oligonucleotide
cacugagccugccaucugugcucuucg

SEQ ID NO: 6856 - RNA, 27 nt, Artificial Sequence
  Synthetic oligonucleotide
acugagccugccaucugugcucuucgu

SEQ ID NO: 6857 - RNA, 27 nt, Artificial Sequence
  Synthetic oligonucleotide
cugagccugccaucugugcucuucguc

SEQ ID NO: 6858 - RNA, 27 nt, Artificial Sequence
  Synthetic oligonucleotide
ugagccugccaucugugcucuucguca

SEQ ID NO: 6859 - RNA, 27 nt, Artificial Sequence
  Synthetic oligonucleotide
gagccugccaucugugcucuucgucau

SEQ ID NO: 6860 - RNA, 27 nt, Artificial Sequence
  Synthetic oligonucleotide
agccugccaucugugcucuucgucauc

SEQ ID NO: 6861 - RNA, 27 nt, Artificial Sequence
  Synthetic oligonucleotide
gccugccaucugugcucuucgucaucu

SEQ ID NO: 6862 - RNA, 27 nt, Artificial Sequence
  Synthetic oligonucleotide
ccugccaucugugcucuucgucaucug

SEQ ID NO: 6863 - RNA, 27 nt, Artificial Sequence
  Synthetic oligonucleotide
cugccaucugugcucuucgucaucuga

SEQ ID NO: 6864 - RNA, 27 nt, Artificial Sequence
  Synthetic oligonucleotide
ugccaucugugcucuucgucaucugac

SEQ ID NO: 6865 - RNA, 27 nt, Artificial Sequence
  Synthetic oligonucleotide
gccaucugugcucuucgucaucugacc

SEQ ID NO: 6866 - RNA, 27 nt, Artificial Sequence
  Synthetic oligonucleotide
ccaucugugcucuucgucaucugacca

SEQ ID NO: 6867 - RNA, 27 nt, Artificial Sequence
  Synthetic oligonucleotide
caucugugcucuucgucaucugaccag

SEQ ID NO: 6868 - RNA, 27 nt, Artificial Sequence
  Synthetic oligonucleotide
aucugugcucuucgucaucugaccagc

SEQ ID NO: 6869 - RNA, 27 nt, Artificial Sequence
  Synthetic oligonucleotide
ucugugcucuucgucaucugaccagcc

SEQ ID NO: 6870 - RNA, 27 nt, Artificial Sequence
  Synthetic oligonucleotide
cugugcucuucgucaucugaccagccg

SEQ ID NO: 6871 - RNA, 27 nt, Artificial Sequence
  Synthetic oligonucleotide
ugugcucuucgucaucugaccagccga

SEQ ID NO: 6872 - RNA, 27 nt, Artificial Sequence
  Synthetic oligonucleotide
gugcucuucgucaucugaccagccgac

SEQ ID NO: 6873 - RNA, 27 nt, Artificial Sequence
  Synthetic oligonucleotide
ugcucuucgucaucugaccagccgaca

SEQ ID NO: 6874 - RNA, 27 nt, Artificial Sequence
  Synthetic oligonucleotide
gcucuucgucaucugaccagccgacac

SEQ ID NO: 6875 - RNA, 27 nt, Artificial Sequence
  Synthetic oligonucleotide
cucuucgucaucugaccagccgacacc

SEQ ID NO: 6876 - RNA, 27 nt, Artificial Sequence
  Synthetic oligonucleotide
ucuucgucaucugaccagccgacacca

SEQ ID NO: 6877 - RNA, 27 nt, Artificial Sequence
  Synthetic oligonucleotide
uacacccaccaucccacuggccucuga

SEQ ID NO: 6878 - RNA, 27 nt, Artificial Sequence
  Synthetic oligonucleotide
acacccaccaucccacuggccucugau

SEQ ID NO: 6879 - RNA, 27 nt, Artificial Sequence
  Synthetic oligonucleotide
cacccaccaucccacuggccucugaua

SEQ ID NO: 6880 - RNA, 27 nt, Artificial Sequence
  Synthetic oligonucleotide
acccaccaucccacuggccucugauaa

SEQ ID NO: 6881 - RNA, 27 nt, Artificial Sequence
  Synthetic oligonucleotide
cccaccaucccacuggccucugauaaa

SEQ ID NO: 6882 - RNA, 27 nt, Artificial Sequence
  Synthetic oligonucleotide
ccaccaucccacuggccucugauaaag

SEQ ID NO: 6883 - RNA, 27 nt, Artificial Sequence
  Synthetic oligonucleotide
caccaucccacuggccucugauaaagg

SEQ ID NO: 6884 - RNA, 27 nt, Artificial Sequence
  Synthetic oligonucleotide
accaucccacuggccucugauaaaggc

SEQ ID NO: 6885 - RNA, 27 nt, Artificial Sequence
  Synthetic oligonucleotide
ccaucccacuggccucugauaaaggcu

SEQ ID NO: 6886 - RNA, 27 nt, Artificial Sequence
  Synthetic oligonucleotide
caucccacuggccucugauaaaggcua

SEQ ID NO: 6887 - RNA, 27 nt, Artificial Sequence
  Synthetic oligonucleotide
aucccacuggccucugauaaaggcuac

SEQ ID NO: 6888 - RNA, 27 nt, Artificial Sequence
  Synthetic oligonucleotide
ucccacuggccucugauaaaggcuacu

SEQ ID NO: 6889 - RNA, 27 nt, Artificial Sequence
  Synthetic oligonucleotide
cccacuggccucugauaaaggcuacug

SEQ ID NO: 6890 - RNA, 27 nt, Artificial Sequence
  Synthetic oligonucleotide
ccacuggccucugauaaaggcuacugu

SEQ ID NO: 6891 - RNA, 27 nt, Artificial Sequence
  Synthetic oligonucleotide
cuacuguuggauugauucgaaaucuug

SEQ ID NO: 6892 - RNA, 27 nt, Artificial Sequence
  Synthetic oligonucleotide
uacuguuggauugauucgaaaucuugc

SEQ ID NO: 6893 - RNA, 27 nt, Artificial Sequence
  Synthetic oligonucleotide
uaaauaccauuccauuguuugugcagc

SEQ ID NO: 6894 - RNA, 27 nt, Artificial Sequence
  Synthetic oligonucleotide
aaauaccauuccauuguuugugcagcu

SEQ ID NO: 6895 - RNA, 27 nt, Artificial Sequence
  Synthetic oligonucleotide
aauaccauuccauuguuugugcagcug

SEQ ID NO: 6896 - RNA, 27 nt, Artificial Sequence
  Synthetic oligonucleotide
auaccauuccauuguuugugcagcugc

SEQ ID NO: 6897 - RNA, 27 nt, Artificial Sequence
  Synthetic oligonucleotide
uaccauuccauuguuugugcagcugcu

SEQ ID NO: 6898 - RNA, 27 nt, Artificial Sequence
  Synthetic oligonucleotide
accauuccauuguuugugcagcugcuu

SEQ ID NO: 6899 - RNA, 27 nt, Artificial Sequence
  Synthetic oligonucleotide
gcugcuuuauucucccauugaaaacau

SEQ ID NO: 6900 - RNA, 27 nt, Artificial Sequence
  Synthetic oligonucleotide
cugcuuuauucucccauugaaaacauc

SEQ ID NO: 6901 - RNA, 27 nt, Artificial Sequence
  Synthetic oligonucleotide
ugcuuuauucucccauugaaaacaucc

SEQ ID NO: 6902 - RNA, 27 nt, Artificial Sequence
  Synthetic oligonucleotide
gcuuuauucucccauugaaaacaucca

SEQ ID NO: 6903 - RNA, 27 nt, Artificial Sequence
  Synthetic oligonucleotide
ggguccucugugaacuugcucaggaca

SEQ ID NO: 6904 - RNA, 27 nt, Artificial Sequence
  Synthetic oligonucleotide
gguccucugugaacuugcucaggacaa

SEQ ID NO: 6905 - RNA, 27 nt, Artificial Sequence
  Synthetic oligonucleotide
guccucugugaacuugcucaggacaag

SEQ ID NO: 6906 - RNA, 27 nt, Artificial Sequence
  Synthetic oligonucleotide
uccucugugaacuugcucaggacaagg

SEQ ID NO: 6907 - RNA, 27 nt, Artificial Sequence
  Synthetic oligonucleotide
ccucugugaacuugcucaggacaagga

SEQ ID NO: 6908 - RNA, 27 nt, Artificial Sequence
  Synthetic oligonucleotide
cucugugaacuugcucaggacaaggaa

SEQ ID NO: 6909 - RNA, 27 nt, Artificial Sequence
  Synthetic oligonucleotide
ucugugaacuugcucaggacaaggaag

SEQ ID NO: 6910 - RNA, 27 nt, Artificial Sequence
  Synthetic oligonucleotide
cugugaacuugcucaggacaaggaagc

SEQ ID NO: 6911 - RNA, 27 nt, Artificial Sequence
  Synthetic oligonucleotide
ugugaacuugcucaggacaaggaagcu

SEQ ID NO: 6912 - RNA, 27 nt, Artificial Sequence
  Synthetic oligonucleotide
gugaacuugcucaggacaaggaagcug

SEQ ID NO: 6913 - RNA, 27 nt, Artificial Sequence
  Synthetic oligonucleotide
ugaacuugcucaggacaaggaagcugc

SEQ ID NO: 6914 - RNA, 27 nt, Artificial Sequence
  Synthetic oligonucleotide
cuauugaagcugagggagccacagcuc

SEQ ID NO: 6915 - RNA, 27 nt, Artificial Sequence
  Synthetic oligonucleotide
uauugaagcugagggagccacagcucc

SEQ ID NO: 6916 - RNA, 27 nt, Artificial Sequence
  Synthetic oligonucleotide
auugaagcugagggagccacagcuccu

SEQ ID NO: 6917 - RNA, 27 nt, Artificial Sequence
  Synthetic oligonucleotide
uguuccgaaugucugaggacaagccac

SEQ ID NO: 6918 - RNA, 27 nt, Artificial Sequence
  Synthetic oligonucleotide
guuccgaaugucugaggacaagccaca

SEQ ID NO: 6919 - RNA, 27 nt, Artificial Sequence
  Synthetic oligonucleotide
uuccgaaugucugaggacaagccacaa

SEQ ID NO: 6920 - RNA, 27 nt, Artificial Sequence
  Synthetic oligonucleotide
uccgaaugucugaggacaagccacaag

SEQ ID NO: 6921 - RNA, 27 nt, Artificial Sequence
  Synthetic oligonucleotide
ccgaaugucugaggacaagccacaaga

SEQ ID NO: 6922 - RNA, 27 nt, Artificial Sequence
  Synthetic oligonucleotide
cgaaugucugaggacaagccacaagau

SEQ ID NO: 6923 - RNA, 27 nt, Artificial Sequence
  Synthetic oligonucleotide
gaaugucugaggacaagccacaagauu

SEQ ID NO: 6924 - RNA, 27 nt, Artificial Sequence
  Synthetic oligonucleotide
aaugucugaggacaagccacaagauua

SEQ ID NO: 6925 - RNA, 27 nt, Artificial Sequence
  Synthetic oligonucleotide
gaacagagccaauggcuuggaaugaga

SEQ ID NO: 6926 - RNA, 27 nt, Artificial Sequence
  Synthetic oligonucleotide
aacagagccaauggcuuggaaugagac

SEQ ID NO: 6927 - RNA, 27 nt, Artificial Sequence
  Synthetic oligonucleotide
acagagccaauggcuuggaaugagacu

SEQ ID NO: 6928 - RNA, 27 nt, Artificial Sequence
  Synthetic oligonucleotide
cagagccaauggcuuggaaugagacug

SEQ ID NO: 6929 - RNA, 27 nt, Artificial Sequence
  Synthetic oligonucleotide
agagccaauggcuuggaaugagacugc

SEQ ID NO: 6930 - RNA, 27 nt, Artificial Sequence
  Synthetic oligonucleotide
gagccaauggcuuggaaugagacugcu

SEQ ID NO: 6931 - RNA, 27 nt, Artificial Sequence
  Synthetic oligonucleotide
agccaauggcuuggaaugagacugcug

SEQ ID NO: 6932 - RNA, 27 nt, Artificial Sequence
  Synthetic oligonucleotide
gccaauggcuuggaaugagacugcuga

SEQ ID NO: 6933 - RNA, 27 nt, Artificial Sequence
  Synthetic oligonucleotide
ccaauggcuuggaaugagacugcugau

SEQ ID NO: 6934 - RNA, 27 nt, Artificial Sequence
  Synthetic oligonucleotide
caauggcuuggaaugagacugcugauc

SEQ ID NO: 6935 - RNA, 27 nt, Artificial Sequence
  Synthetic oligonucleotide
aauggcuuggaaugagacugcugaucu

SEQ ID NO: 6936 - RNA, 27 nt, Artificial Sequence
  Synthetic oligonucleotide
cccuuggauaucgccaggaugauccua

SEQ ID NO: 6937 - RNA, 27 nt, Artificial Sequence
  Synthetic oligonucleotide
ccuuggauaucgccaggaugauccuag

SEQ ID NO: 6938 - RNA, 27 nt, Artificial Sequence
  Synthetic oligonucleotide
cuuggauaucgccaggaugauccuagc

SEQ ID NO: 6939 - RNA, 27 nt, Artificial Sequence
  Synthetic oligonucleotide
uuggauaucgccaggaugauccuagcu

SEQ ID NO: 6940 - RNA, 27 nt, Artificial Sequence
  Synthetic oligonucleotide
uggauaucgccaggaugauccuagcua

SEQ ID NO: 6941 - RNA, 27 nt, Artificial Sequence
  Synthetic oligonucleotide
aucguucuuuucacucugguggauaug

SEQ ID NO: 6942 - RNA, 27 nt, Artificial Sequence
  Synthetic oligonucleotide
ucguucuuuucacucugguggauaugg

SEQ ID NO: 6943 - RNA, 27 nt, Artificial Sequence
  Synthetic oligonucleotide
cguucuuuucacucugguggauauggc

SEQ ID NO: 6944 - RNA, 27 nt, Artificial Sequence
  Synthetic oligonucleotide
guucuuuucacucugguggauauggcc

SEQ ID NO: 6945 - RNA, 27 nt, Artificial Sequence
  Synthetic oligonucleotide
uucuuuucacucugguggauauggcca

SEQ ID NO: 6946 - RNA, 27 nt, Artificial Sequence
  Synthetic oligonucleotide
aacaugagauggguggccaccacccug

SEQ ID NO: 6947 - RNA, 27 nt, Artificial Sequence
  Synthetic oligonucleotide
acaugagauggguggccaccacccugg

SEQ ID NO: 6948 - RNA, 27 nt, Artificial Sequence
  Synthetic oligonucleotide
caugagauggguggccaccacccuggu

SEQ ID NO: 6949 - RNA, 27 nt, Artificial Sequence
  Synthetic oligonucleotide
augagauggguggccaccacccuggug

SEQ ID NO: 6950 - RNA, 27 nt, Artificial Sequence
  Synthetic oligonucleotide
ugagauggguggccaccacccuggugc

SEQ ID NO: 6951 - RNA, 27 nt, Artificial Sequence
  Synthetic oligonucleotide
gagauggguggccaccacccuggugcu

SEQ ID NO: 6952 - RNA, 27 nt, Artificial Sequence
  Synthetic oligonucleotide
agauggguggccaccacccuggugcug

SEQ ID NO: 6953 - RNA, 27 nt, Artificial Sequence
  Synthetic oligonucleotide
gauggguggccaccacccuggugcuga

SEQ ID NO: 6954 - RNA, 27 nt, Artificial Sequence
  Synthetic oligonucleotide
auggguggccaccacccuggugcugac

SEQ ID NO: 6955 - RNA, 27 nt, Artificial Sequence
  Synthetic oligonucleotide
uggguggccaccacccuggugcugacu

SEQ ID NO: 6956 - RNA, 27 nt, Artificial Sequence
  Synthetic oligonucleotide
ggguggccaccacccuggugcugacua

SEQ ID NO: 6957 - RNA, 27 nt, Artificial Sequence
  Synthetic oligonucleotide
gguggccaccacccuggugcugacuau

SEQ ID NO: 6958 - RNA, 27 nt, Artificial Sequence
  Synthetic oligonucleotide
guggccaccacccuggugcugacuauc

SEQ ID NO: 6959 - RNA, 27 nt, Artificial Sequence
  Synthetic oligonucleotide
uggccaccacccuggugcugacuaucc

SEQ ID NO: 6960 - RNA, 27 nt, Artificial Sequence
  Synthetic oligonucleotide
ggccaccacccuggugcugacuaucca

SEQ ID NO: 6961 - RNA, 27 nt, Artificial Sequence
  Synthetic oligonucleotide
gccaccacccuggugcugacuauccag

SEQ ID NO: 6962 - RNA, 27 nt, Artificial Sequence
  Synthetic oligonucleotide
ccaccacccuggugcugacuauccagu

SEQ ID NO: 6963 - RNA, 27 nt, Artificial Sequence
  Synthetic oligonucleotide
caccacccuggugcugacuauccaguu

SEQ ID NO: 6964 - RNA, 27 nt, Artificial Sequence
  Synthetic oligonucleotide
accacccuggugcugacuauccaguug

SEQ ID NO: 6965 - RNA, 27 nt, Artificial Sequence
  Synthetic oligonucleotide
ccacccuggugcugacuauccaguuga

SEQ ID NO: 6966 - RNA, 27 nt, Artificial Sequence
  Synthetic oligonucleotide
cacccuggugcugacuauccaguugau

SEQ ID NO: 6967 - RNA, 27 nt, Artificial Sequence
  Synthetic oligonucleotide
acccuggugcugacuauccaguugaug

SEQ ID NO: 6968 - RNA, 27 nt, Artificial Sequence
  Synthetic oligonucleotide
cccuggugcugacuauccaguugaugg

SEQ ID NO: 6969 - RNA, 27 nt, Artificial Sequence
  Synthetic oligonucleotide
ccuggugcugacuauccaguugauggg

SEQ ID NO: 6970 - RNA, 27 nt, Artificial Sequence
  Synthetic oligonucleotide
cuggugcugacuauccaguugaugggc

SEQ ID NO: 6971 - RNA, 27 nt, Artificial Sequence
  Synthetic oligonucleotide
uggugcugacuauccaguugaugggcu

SEQ ID NO: 6972 - RNA, 27 nt, Artificial Sequence
  Synthetic oligonucleotide
ggugcugacuauccaguugaugggcug

SEQ ID NO: 6973 - RNA, 27 nt, Artificial Sequence
  Synthetic oligonucleotide
gugcugacuauccaguugaugggcugc

SEQ ID NO: 6974 - RNA, 27 nt, Artificial Sequence
  Synthetic oligonucleotide
ugcugacuauccaguugaugggcugcc

SEQ ID NO: 6975 - RNA, 27 nt, Artificial Sequence
  Synthetic oligonucleotide
gcugacuauccaguugaugggcugcca

SEQ ID NO: 6976 - RNA, 27 nt, Artificial Sequence
  Synthetic oligonucleotide
cugacuauccaguugaugggcugccag

SEQ ID NO: 6977 - RNA, 27 nt, Artificial Sequence
  Synthetic oligonucleotide
ugacuauccaguugaugggcugccaga

SEQ ID NO: 6978 - RNA, 27 nt, Artificial Sequence
  Synthetic oligonucleotide
gacuauccaguugaugggcugccagau

SEQ ID NO: 6979 - RNA, 27 nt, Artificial Sequence
  Synthetic oligonucleotide
acuauccaguugaugggcugccagauc

SEQ ID NO: 6980 - RNA, 27 nt, Artificial Sequence
  Synthetic oligonucleotide
cuauccaguugaugggcugccagaucu

SEQ ID NO: 6981 - RNA, 27 nt, Artificial Sequence
  Synthetic oligonucleotide
augcccaggaccucauggaugggcugc

SEQ ID NO: 6982 - RNA, 27 nt, Artificial Sequence
  Synthetic oligonucleotide
ugcccaggaccucauggaugggcugcc

SEQ ID NO: 6983 - RNA, 27 nt, Artificial Sequence
  Synthetic oligonucleotide
gcccaggaccucauggaugggcugccu

SEQ ID NO: 6984 - RNA, 27 nt, Artificial Sequence
  Synthetic oligonucleotide
acagcaaucagcuggccugguuugaua

SEQ ID NO: 6985 - RNA, 27 nt, Artificial Sequence
  Synthetic oligonucleotide
cagcaaucagcuggccugguuugauac

SEQ ID NO: 6986 - RNA, 27 nt, Artificial Sequence
  Synthetic oligonucleotide
agcaaucagcuggccugguuugauacu

SEQ ID NO: 6987 - RNA, 27 nt, Artificial Sequence
  Synthetic oligonucleotide
gcaaucagcuggccugguuugauacug

SEQ ID NO: 6988 - RNA, 27 nt, Artificial Sequence
  Synthetic oligonucleotide
caaucagcuggccugguuugauacuga

SEQ ID NO: 6989 - RNA, 27 nt, Artificial Sequence
  Synthetic oligonucleotide
aaucagcuggccugguuugauacugac

SEQ ID NO: 6990 - RNA, 27 nt, Artificial Sequence
  Synthetic oligonucleotide
aucagcuggccugguuugauacugacc

SEQ ID NO: 6991 - RNA, 27 nt, Artificial Sequence
  Synthetic oligonucleotide
ucagcuggccugguuugauacugaccu

SEQ ID NO: 6992 - RNA, 27 nt, Artificial Sequence
  Synthetic oligonucleotide
cagcuggccugguuugauacugaccug

SEQ ID NO: 6993 - RNA, 27 nt, Artificial Sequence
  Synthetic oligonucleotide
agcuggccugguuugauacugaccugu

SEQ ID NO: 6994 - RNA, 27 nt, Artificial Sequence
  Synthetic oligonucleotide
gcuggccugguuugauacugaccugua

SEQ ID NO: 6995 - RNA, 27 nt, Artificial Sequence
  Synthetic oligonucleotide
cuggccugguuugauacugaccuguaa

SEQ ID NO: 6996 - RNA, 27 nt, Artificial Sequence
  Synthetic oligonucleotide
uggccugguuugauacugaccuguaaa

SEQ ID NO: 6997 - RNA, 27 nt, Artificial Sequence
  Synthetic oligonucleotide
ggccugguuugauacugaccuguaaau

SEQ ID NO: 6998 - RNA, 27 nt, Artificial Sequence
  Synthetic oligonucleotide
gccugguuugauacugaccuguaaauc

SEQ ID NO: 6999 - RNA, 27 nt, Artificial Sequence
  Synthetic oligonucleotide
ccugguuugauacugaccuguaaauca

SEQ ID NO: 7000 - RNA, 27 nt, Artificial Sequence
  Synthetic oligonucleotide
cugguuugauacugaccuguaaaucau

SEQ ID NO: 7001 - RNA, 27 nt, Artificial Sequence
  Synthetic oligonucleotide
ugguuugauacugaccuguaaaucauc

SEQ ID NO: 7002 - RNA, 27 nt, Artificial Sequence
  Synthetic oligonucleotide
gguuugauacugaccuguaaaucaucc

SEQ ID NO: 7003 - RNA, 27 nt, Artificial Sequence
  Synthetic oligonucleotide
guuugauacugaccuguaaaucauccu

SEQ ID NO: 7004 - RNA, 27 nt, Artificial Sequence
  Synthetic oligonucleotide
uuugauacugaccuguaaaucauccuu

SEQ ID NO: 7005 - RNA, 27 nt, Artificial Sequence
  Synthetic oligonucleotide
uuuuuugccacagcuuuugcaacuuaa

SEQ ID NO: 7006 - RNA, 27 nt, Artificial Sequence
  Synthetic oligonucleotide
aaugaguaacauuugcuguuuuaaaca

SEQ ID NO: 7007 - RNA, 27 nt, Artificial Sequence
  Synthetic oligonucleotide
uaaacauuaauagcagccuuucucucu

SEQ ID NO: 7008 - RNA, 27 nt, Artificial Sequence
  Synthetic oligonucleotide
aacauuaauagcagccuuucucucuuu

SEQ ID NO: 7009 - RNA, 27 nt, Artificial Sequence
  Synthetic oligonucleotide
cauuaauagcagccuuucucucuuuau

SEQ ID NO: 7010 - RNA, 27 nt, Artificial Sequence
  Synthetic oligonucleotide
uuaauagcagccuuucucucuuuauac

SEQ ID NO: 7011 - RNA, 27 nt, Artificial Sequence
  Synthetic oligonucleotide
uugcauugugauuggccuguagaguug

SEQ ID NO: 7012 - RNA, 27 nt, Artificial Sequence
  Synthetic oligonucleotide
gcauugugauuggccuguagaguugcu

SEQ ID NO: 7013 - RNA, 27 nt, Artificial Sequence
  Synthetic oligonucleotide
auugugauuggccuguagaguugcuga

SEQ ID NO: 7014 - RNA, 27 nt, Artificial Sequence
  Synthetic oligonucleotide
ugugauuggccuguagaguugcugaga

SEQ ID NO: 7015 - RNA, 27 nt, Artificial Sequence
  Synthetic oligonucleotide
ugauuggccuguagaguugcugagagg

SEQ ID NO: 7016 - RNA, 27 nt, Artificial Sequence
  Synthetic oligonucleotide
auuggccuguagaguugcugagagggc

SEQ ID NO: 7017 - RNA, 27 nt, Artificial Sequence
  Synthetic oligonucleotide
uggccuguagaguugcugagagggcuc

SEQ ID NO: 7018 - RNA, 27 nt, Artificial Sequence
  Synthetic oligonucleotide
gccuguagaguugcugagagggcucga

SEQ ID NO: 7019 - RNA, 27 nt, Artificial Sequence
  Synthetic oligonucleotide
cuguagaguugcugagagggcucgagg

SEQ ID NO: 7020 - RNA, 27 nt, Artificial Sequence
  Synthetic oligonucleotide
gggugggcugguaucucagaaagugcc

SEQ ID NO: 7021 - RNA, 27 nt, Artificial Sequence
  Synthetic oligonucleotide
gugggcugguaucucagaaagugccug

SEQ ID NO: 7022 - RNA, 27 nt, Artificial Sequence
  Synthetic oligonucleotide
gggcugguaucucagaaagugccugac

SEQ ID NO: 7023 - RNA, 27 nt, Artificial Sequence
  Synthetic oligonucleotide
gcugguaucucagaaagugccugacac

SEQ ID NO: 7024 - RNA, 27 nt, Artificial Sequence
  Synthetic oligonucleotide
acacuaaccaagcugaguuuccuaugg

SEQ ID NO: 7025 - RNA, 27 nt, Artificial Sequence
  Synthetic oligonucleotide
acuaaccaagcugaguuuccuauggga

SEQ ID NO: 7026 - RNA, 27 nt, Artificial Sequence
  Synthetic oligonucleotide
uaaccaagcugaguuuccuaugggaac

SEQ ID NO: 7027 - RNA, 27 nt, Artificial Sequence
  Synthetic oligonucleotide
accaagcugaguuuccuaugggaacaa

SEQ ID NO: 7028 - RNA, 27 nt, Artificial Sequence
  Synthetic oligonucleotide
caagcugaguuuccuaugggaacaauu

SEQ ID NO: 7029 - RNA, 27 nt, Artificial Sequence
  Synthetic oligonucleotide
agcugaguuuccuaugggaacaauuga

SEQ ID NO: 7030 - RNA, 27 nt, Artificial Sequence
  Synthetic oligonucleotide
aacuuuuuguucugguccuuuuugguc

SEQ ID NO: 7031 - RNA, 27 nt, Artificial Sequence
  Synthetic oligonucleotide
cuuuuuguucugguccuuuuuggucga

SEQ ID NO: 7032 - RNA, 27 nt, Artificial Sequence
  Synthetic oligonucleotide
uuuuguucugguccuuuuuggucgagg

SEQ ID NO: 7033 - RNA, 27 nt, Artificial Sequence
  Synthetic oligonucleotide
uuguucugguccuuuuuggucgaggag

SEQ ID NO: 7034 - RNA, 27 nt, Artificial Sequence
  Synthetic oligonucleotide
guucugguccuuuuuggucgaggagua

SEQ ID NO: 7035 - RNA, 27 nt, Artificial Sequence
  Synthetic oligonucleotide
ucugguccuuuuuggucgaggaguaac

SEQ ID NO: 7036 - RNA, 27 nt, Artificial Sequence
  Synthetic oligonucleotide
ugguccuuuuuggucgaggaguaacaa

SEQ ID NO: 7037 - RNA, 27 nt, Artificial Sequence
  Synthetic oligonucleotide
guccuuuuuggucgaggaguaacaaua

SEQ ID NO: 7038 - RNA, 27 nt, Artificial Sequence
  Synthetic oligonucleotide
ccuuuuuggucgaggaguaacaauaca

SEQ ID NO: 7039 - RNA, 27 nt, Artificial Sequence
  Synthetic oligonucleotide
uuuuuggucgaggaguaacaauacaaa

SEQ ID NO: 7040 - RNA, 27 nt, Artificial Sequence
  Synthetic oligonucleotide
uuuggucgaggaguaacaauacaaaug

SEQ ID NO: 7041 - RNA, 27 nt, Artificial Sequence
  Synthetic oligonucleotide
uggucgaggaguaacaauacaaaugga

SEQ ID NO: 7042 - RNA, 27 nt, Artificial Sequence
  Synthetic oligonucleotide
gucgaggaguaacaauacaaauggauu

SEQ ID NO: 7043 - RNA, 27 nt, Artificial Sequence
  Synthetic oligonucleotide
cgaggaguaacaauacaaauggauuuu

SEQ ID NO: 7044 - RNA, 27 nt, Artificial Sequence
  Synthetic oligonucleotide
aggaguaacaauacaaauggauuuugg

SEQ ID NO: 7045 - RNA, 27 nt, Artificial Sequence
  Synthetic oligonucleotide
uuuaucaaacccuagccuugcuuguua

SEQ ID NO: 7046 - RNA, 27 nt, Artificial Sequence
  Synthetic oligonucleotide
uaucaaacccuagccuugcuuguuaaa

SEQ ID NO: 7047 - RNA, 27 nt, Artificial Sequence
  Synthetic oligonucleotide
ucaaacccuagccuugcuuguuaaauu

SEQ ID NO: 7048 - RNA, 27 nt, Artificial Sequence
  Synthetic oligonucleotide
uugaguaaugguguagaacacuaauuc

SEQ ID NO: 7049 - RNA, 27 nt, Artificial Sequence
  Synthetic oligonucleotide
gaguaaugguguagaacacuaauucau

SEQ ID NO: 7050 - RNA, 27 nt, Artificial Sequence
  Synthetic oligonucleotide
guaaugguguagaacacuaauucauaa

SEQ ID NO: 7051 - RNA, 27 nt, Artificial Sequence
  Synthetic oligonucleotide
aaugguguagaacacuaauucauaauc

SEQ ID NO: 7052 - RNA, 27 nt, Artificial Sequence
  Synthetic oligonucleotide
ugguguagaacacuaauucauaaucac

SEQ ID NO: 7053 - RNA, 27 nt, Artificial Sequence
  Synthetic oligonucleotide
guguagaacacuaauucauaaucacuc

SEQ ID NO: 7054 - RNA, 27 nt, Artificial Sequence
  Synthetic oligonucleotide
guagaacacuaauucauaaucacucua

SEQ ID NO: 7055 - RNA, 27 nt, Artificial Sequence
  Synthetic oligonucleotide
agaacacuaauucauaaucacucuaau

SEQ ID NO: 7056 - RNA, 27 nt, Artificial Sequence
  Synthetic oligonucleotide
aauuaguuuccuuuuuaauaugcuuaa

SEQ ID NO: 7057 - RNA, 27 nt, Artificial Sequence
  Synthetic oligonucleotide
uuaguuuccuuuuuaauaugcuuaaaa

SEQ ID NO: 7058 - RNA, 27 nt, Artificial Sequence
  Synthetic oligonucleotide
aguuuccuuuuuaauaugcuuaaaaua

SEQ ID NO: 7059 - RNA, 27 nt, Artificial Sequence
  Synthetic oligonucleotide
uuuccuuuuuaauaugcuuaaaauaag

SEQ ID NO: 7060 - RNA, 27 nt, Artificial Sequence
  Synthetic oligonucleotide
uccuuuuuaauaugcuuaaaauaagca

SEQ ID NO: 7061 - RNA, 27 nt, Artificial Sequence
  Synthetic oligonucleotide
ccuuuuuaauaugcuuaaaauaagcag

SEQ ID NO: 7062 - RNA, 27 nt, Artificial Sequence
  Synthetic oligonucleotide
cuuuuuaauaugcuuaaaauaagcagg

SEQ ID NO: 7063 - RNA, 27 nt, Artificial Sequence
  Synthetic oligonucleotide
uuuuaauaugcuuaaaauaagcaggug

SEQ ID NO: 7064 - RNA, 27 nt, Artificial Sequence
  Synthetic oligonucleotide
uuaauaugcuuaaaauaagcaggugga

SEQ ID NO: 7065 - RNA, 27 nt, Artificial Sequence
  Synthetic oligonucleotide
aauaugcuuaaaauaagcagguggauc

SEQ ID NO: 7066 - RNA, 27 nt, Artificial Sequence
  Synthetic oligonucleotide
uaugcuuaaaauaagcagguggaucua

SEQ ID NO: 7067 - RNA, 27 nt, Artificial Sequence
  Synthetic oligonucleotide
ugcuuaaaauaagcagguggaucuauu

SEQ ID NO: 7068 - RNA, 27 nt, Artificial Sequence
  Synthetic oligonucleotide
cuuaaaauaagcagguggaucuauuuc

SEQ ID NO: 7069 - RNA, 27 nt, Artificial Sequence
  Synthetic oligonucleotide
uaaaauaagcagguggaucuauuucau

SEQ ID NO: 7070 - RNA, 27 nt, Artificial Sequence
  Synthetic oligonucleotide
aaauaagcagguggaucuauuucaugu

SEQ ID NO: 7071 - RNA, 27 nt, Artificial Sequence
  Synthetic oligonucleotide
auaagcagguggaucuauuucauguuu

SEQ ID NO: 7072 - RNA, 27 nt, Artificial Sequence
  Synthetic oligonucleotide
aagcagguggaucuauuucauguuuuu

SEQ ID NO: 7073 - RNA, 27 nt, Artificial Sequence
  Synthetic oligonucleotide
gcagguggaucuauuucauguuuuuga

SEQ ID NO: 7074 - RNA, 27 nt, Artificial Sequence
  Synthetic oligonucleotide
agguggaucuauuucauguuuuugauc

SEQ ID NO: 7075 - RNA, 27 nt, Artificial Sequence
  Synthetic oligonucleotide
guggaucuauuucauguuuuugaucaa

SEQ ID NO: 7076 - RNA, 27 nt, Artificial Sequence
  Synthetic oligonucleotide
ggaucuauuucauguuuuugaucaaaa

SEQ ID NO: 7077 - RNA, 27 nt, Artificial Sequence
  Synthetic oligonucleotide
ggguaggguaaaucaguaagagguguu

SEQ ID NO: 7078 - RNA, 27 nt, Artificial Sequence
  Synthetic oligonucleotide
guaggguaaaucaguaagagguguuau

SEQ ID NO: 7079 - RNA, 27 nt, Artificial Sequence
  Synthetic oligonucleotide
aggguaaaucaguaagagguguuauuu

SEQ ID NO: 7080 - RNA, 27 nt, Artificial Sequence
  Synthetic oligonucleotide
gguaaaucaguaagagguguuauuugg

SEQ ID NO: 7081 - RNA, 27 nt, Artificial Sequence
  Synthetic oligonucleotide
uaaaucaguaagagguguuauuuggaa

SEQ ID NO: 7082 - RNA, 27 nt, Artificial Sequence
  Synthetic oligonucleotide
aaucaguaagagguguuauuuggaacc

SEQ ID NO: 7083 - RNA, 27 nt, Artificial Sequence
  Synthetic oligonucleotide
uuuaccaguugccuuuuaucccaaagu

SEQ ID NO: 7084 - RNA, 27 nt, Artificial Sequence
  Synthetic oligonucleotide
uaccaguugccuuuuaucccaaaguug

SEQ ID NO: 7085 - RNA, 27 nt, Artificial Sequence
  Synthetic oligonucleotide
ccaguugccuuuuaucccaaaguuguu

SEQ ID NO: 7086 - RNA, 27 nt, Artificial Sequence
  Synthetic oligonucleotide
aguugccuuuuaucccaaaguuguugu

SEQ ID NO: 7087 - RNA, 27 nt, Artificial Sequence
  Synthetic oligonucleotide
uugccuuuuaucccaaaguuguuguaa

SEQ ID NO: 7088 - RNA, 27 nt, Artificial Sequence
  Synthetic oligonucleotide
gccuuuuaucccaaaguuguuguaacc

SEQ ID NO: 7089 - RNA, 27 nt, Artificial Sequence
  Synthetic oligonucleotide
cuuuuaucccaaaguuguuguaaccug

SEQ ID NO: 7090 - RNA, 27 nt, Artificial Sequence
  Synthetic oligonucleotide
uuuaucccaaaguuguuguaaccugcu

SEQ ID NO: 7091 - RNA, 27 nt, Artificial Sequence
  Synthetic oligonucleotide
uaucccaaaguuguuguaaccugcugu

SEQ ID NO: 7092 - RNA, 27 nt, Artificial Sequence
  Synthetic oligonucleotide
ucccaaaguuguuguaaccugcuguga

SEQ ID NO: 7093 - RNA, 27 nt, Artificial Sequence
  Synthetic oligonucleotide
ccaaaguuguuguaaccugcugugaua

SEQ ID NO: 7094 - RNA, 27 nt, Artificial Sequence
  Synthetic oligonucleotide
aaaguuguuguaaccugcugugauacg

SEQ ID NO: 7095 - RNA, 27 nt, Artificial Sequence
  Synthetic oligonucleotide
aguuguuguaaccugcugugauacgau

SEQ ID NO: 7096 - RNA, 27 nt, Artificial Sequence
  Synthetic oligonucleotide
uuguuguaaccugcugugauacgaugc

SEQ ID NO: 7097 - RNA, 27 nt, Artificial Sequence
  Synthetic oligonucleotide
aaaaaugguucagaauuaaacuuuuaa

SEQ ID NO: 7098 - RNA, 27 nt, Artificial Sequence
  Synthetic oligonucleotide
aaaugguucagaauuaaacuuuuaauu

SEQ ID NO: 7099 - RNA, 27 nt, Artificial Sequence
  Synthetic oligonucleotide
augguucagaauuaaacuuuuaauuca

SEQ ID NO: 7100 - RNA, 27 nt, Artificial Sequence
  Synthetic oligonucleotide
gguucagaauuaaacuuuuaauucauu

SEQ ID NO: 7101 - RNA, 27 nt, Artificial Sequence
  Synthetic oligonucleotide
uucagaauuaaacuuuuaauucauucg

SEQ ID NO: 7102 - RNA, 27 nt, Artificial Sequence
  Synthetic oligonucleotide
cagcagcagucuuacuuggauucugga

SEQ ID NO: 7103 - RNA, 27 nt, Artificial Sequence
  Synthetic oligonucleotide
uuacuuggauucuggaauccauucugg

SEQ ID NO: 7104 - RNA, 27 nt, Artificial Sequence
  Synthetic oligonucleotide
uugacaccucccaaguccuuuaugaau

SEQ ID NO: 7105 - RNA, 27 nt, Artificial Sequence
  Synthetic oligonucleotide
cacgcaagagcaaguagcugauauuga

SEQ ID NO: 7106 - RNA, 27 nt, Artificial Sequence
  Synthetic oligonucleotide
ugccauguucccugagacgcuagauga

SEQ ID NO: 7107 - RNA, 27 nt, Artificial Sequence
  Synthetic oligonucleotide
guugaaacaugcaguugucaauuugau

SEQ ID NO: 7108 - RNA, 27 nt, Artificial Sequence
  Synthetic oligonucleotide
aacaugcaguugucaauuugauuaacu

SEQ ID NO: 7109 - RNA, 27 nt, Artificial Sequence
  Synthetic oligonucleotide
caguugucaauuugauuaacuaucagg

SEQ ID NO: 7110 - RNA, 27 nt, Artificial Sequence
  Synthetic oligonucleotide
augaggaccaggugguaguuaauaaag

SEQ ID NO: 7111 - RNA, 27 nt, Artificial Sequence
  Synthetic oligonucleotide
ugggucaccaguggauucuguacuguu

SEQ ID NO: 7112 - RNA, 27 nt, Artificial Sequence
  Synthetic oligonucleotide
accaguggauucuguacuguucuacgc

SEQ ID NO: 7113 - RNA, 27 nt, Artificial Sequence
  Synthetic oligonucleotide
uggauucuguacuguucuacgccauca

SEQ ID NO: 7114 - RNA, 27 nt, Artificial Sequence
  Synthetic oligonucleotide
ugguggacugcagaaaaugguugcuuu

SEQ ID NO: 7115 - RNA, 27 nt, Artificial Sequence
  Synthetic oligonucleotide
aacgugaaauucuuggcuauuacaaca

SEQ ID NO: 7116 - RNA, 27 nt, Artificial Sequence
  Synthetic oligonucleotide
cccaagucagcgacuuguucaaaacug

SEQ ID NO: 7117 - RNA, 27 nt, Artificial Sequence
  Synthetic oligonucleotide
gcgacuuguucaaaacugucuuuggac

SEQ ID NO: 7118 - RNA, 27 nt, Artificial Sequence
  Synthetic oligonucleotide
caaaacugucuuuggacucucagaaac

SEQ ID NO: 7119 - RNA, 27 nt, Artificial Sequence
  Synthetic oligonucleotide
cucucuaaccucacuugcaauaauuac

SEQ ID NO: 7120 - RNA, 27 nt, Artificial Sequence
  Synthetic oligonucleotide
accucacuugcaauaauuacaaaaaca

SEQ ID NO: 7121 - RNA, 27 nt, Artificial Sequence
  Synthetic oligonucleotide
cagaaugccguucgccuucauuaugga

SEQ ID NO: 7122 - RNA, 27 nt, Artificial Sequence
  Synthetic oligonucleotide
ucgccuucauuauggacugccuguugu

SEQ ID NO: 7123 - RNA, 27 nt, Artificial Sequence
  Synthetic oligonucleotide
uucauuauggacugccuguugugguua

SEQ ID NO: 7124 - RNA, 27 nt, Artificial Sequence
  Synthetic oligonucleotide
uggacugccuguugugguuaaacuccu

SEQ ID NO: 7125 - RNA, 27 nt, Artificial Sequence
  Synthetic oligonucleotide
gcaacuguuggauugauucgaaaccuu

SEQ ID NO: 7126 - RNA, 27 nt, Artificial Sequence
  Synthetic oligonucleotide
ccgaggacucaauaccauuccauuguu

SEQ ID NO: 7127 - RNA, 27 nt, Artificial Sequence
  Synthetic oligonucleotide
cugaggacaagccacaggauuacaaga

SEQ ID NO: 7128 - RNA, 27 nt, Artificial Sequence
  Synthetic oligonucleotide
ggauggacccuaugauggagcaugaga

SEQ ID NO: 7129 - RNA, 27 nt, Artificial Sequence
  Synthetic oligonucleotide
uugauacugaccuguaaaucguccuuu

SEQ ID NO: 7130 - RNA, 27 nt, Artificial Sequence
  Synthetic oligonucleotide
agccagugugggugaauacuuuacucu

SEQ ID NO: 7131 - RNA, 27 nt, Artificial Sequence
  Synthetic oligonucleotide
ugccacagcuuuugcagcguuauacuc

SEQ ID NO: 7132 - RNA, 27 nt, Artificial Sequence
  Synthetic oligonucleotide
gcuuuugcagcguuauacucagaugag

SEQ ID NO: 7133 - RNA, 27 nt, Artificial Sequence
  Synthetic oligonucleotide
cagcguuauacucagaugaguaacauu

SEQ ID NO: 7134 - RNA, 27 nt, Artificial Sequence
  Synthetic oligonucleotide
acauuugcuguuuucaacauuaauagc

SEQ ID NO: 7135 - RNA, 27 nt, Artificial Sequence
  Synthetic oligonucleotide
agcuguagugucugaacgugcauugug

SEQ ID NO: 7136 - RNA, 27 nt, Artificial Sequence
  Synthetic oligonucleotide
gggaacagucgaaguacgcuuuuuguu

SEQ ID NO: 7137 - RNA, 27 nt, Artificial Sequence
  Synthetic oligonucleotide
cagucgaaguacgcuuuuuguucuggu

SEQ ID NO: 7138 - RNA, 27 nt, Artificial Sequence
  Synthetic oligonucleotide
aaguacgcuuuuuguucugguccuuuu

SEQ ID NO: 7139 - RNA, 27 nt, Artificial Sequence
  Synthetic oligonucleotide
acccuagccuugcuuguucuuuguuuu

SEQ ID NO: 7140 - RNA, 27 nt, Artificial Sequence
  Synthetic oligonucleotide
agccuugcuuguucuuuguuuuaauau

SEQ ID NO: 7141 - RNA, 27 nt, Artificial Sequence
  Synthetic oligonucleotide
ugaaccugcuacagcaauuucugauuu

SEQ ID NO: 7142 - RNA, 27 nt, Artificial Sequence
  Synthetic oligonucleotide
uacagcaauuucugauuucuaagaacc

SEQ ID NO: 7143 - RNA, 27 nt, Artificial Sequence
  Synthetic oligonucleotide
caguaagagguguuauuugagccuugu

SEQ ID NO: 7144 - RNA, 27 nt, Artificial Sequence
  Synthetic oligonucleotide
gagguguuauuugagccuuguuuugga

SEQ ID NO: 7145 - RNA, 27 nt, Artificial Sequence
  Synthetic oligonucleotide
guuauuugagccuuguuuuggacagua

SEQ ID NO: 7146 - RNA, 27 nt, Artificial Sequence
  Synthetic oligonucleotide
uugagccuuguuuuggacaguauacca

SEQ ID NO: 7147 - RNA, 27 nt, Artificial Sequence
  Synthetic oligonucleotide
uucaacagaugcgguuauagaaauggu

SEQ ID NO: 7148 - RNA, 27 nt, Artificial Sequence
  Synthetic oligonucleotide
cgguuauagaaaugguucagaauuaaa

SEQ ID NO: 7149 - RNA, 27 nt, Artificial Sequence
  Synthetic oligonucleotide
auagaaaugguucagaauuaaacuuuu

SEQ ID NO: 7150 - RNA, 27 nt, Artificial Sequence
  Synthetic oligonucleotide
guuguaugguauacuucaaauacccca

SEQ ID NO: 7151 - RNA, 27 nt, Artificial Sequence
  Synthetic oligonucleotide
caaaacaguuguaugguauacuucacc

SEQ ID NO: 7152 - RNA, 27 nt, Artificial Sequence
  Synthetic oligonucleotide
ucaaaacaguuguaugguauacuuccc

SEQ ID NO: 7153 - RNA, 27 nt, Artificial Sequence
  Synthetic oligonucleotide
uuucaaaacaguuguaugguauacuca

SEQ ID NO: 7154 - RNA, 27 nt, Artificial Sequence
  Synthetic oligonucleotide
uuuucaaaacaguuguaugguauaccc

SEQ ID NO: 7155 - RNA, 27 nt, Artificial Sequence
  Synthetic oligonucleotide
auuuucaaaacaguuguaugguauaac

SEQ ID NO: 7156 - RNA, 27 nt, Artificial Sequence
  Synthetic oligonucleotide
uuguccacgcuggauuuucaaaacaac

SEQ ID NO: 7157 - RNA, 27 nt, Artificial Sequence
  Synthetic oligonucleotide
auuguccacgcuggauuuucaaaacca

SEQ ID NO: 7158 - RNA, 27 nt, Artificial Sequence
  Synthetic oligonucleotide
ccaucaaaucagcuugaguagccauca

SEQ ID NO: 7159 - RNA, 27 nt, Artificial Sequence
  Synthetic oligonucleotide
uguccaacuccaucaaaucagcuugca

SEQ ID NO: 7160 - RNA, 27 nt, Artificial Sequence
  Synthetic oligonucleotide
cuuccucaggauugccuuuaccacuac

SEQ ID NO: 7161 - RNA, 27 nt, Artificial Sequence
  Synthetic oligonucleotide
ucuuccucaggauugccuuuaccacca

SEQ ID NO: 7162 - RNA, 27 nt, Artificial Sequence
  Synthetic oligonucleotide
caucaauaucagcuacuuguucuugca

SEQ ID NO: 7163 - RNA, 27 nt, Artificial Sequence
  Synthetic oligonucleotide
ccaucaauaucagcuacuuguucuuac

SEQ ID NO: 7164 - RNA, 27 nt, Artificial Sequence
  Synthetic oligonucleotide
acuguccaucaauaucagcuacuugcc

SEQ ID NO: 7165 - RNA, 27 nt, Artificial Sequence
  Synthetic oligonucleotide
auugcauacuguccaucaauaucagac

SEQ ID NO: 7166 - RNA, 27 nt, Artificial Sequence
  Synthetic oligonucleotide
cgagucauugcauacuguccaucaacc

SEQ ID NO: 7167 - RNA, 27 nt, Artificial Sequence
  Synthetic oligonucleotide
ccucaucuaaugucucagggaacauca

SEQ ID NO: 7168 - RNA, 27 nt, Artificial Sequence
  Synthetic oligonucleotide
uuacaacugcauguuucagcaucugca

SEQ ID NO: 7169 - RNA, 27 nt, Artificial Sequence
  Synthetic oligonucleotide
guuuacaacugcauguuucagcaucca

SEQ ID NO: 7170 - RNA, 27 nt, Artificial Sequence
  Synthetic oligonucleotide
aguuaaucaaguuuacaacugcaugcc

SEQ ID NO: 7171 - RNA, 27 nt, Artificial Sequence
  Synthetic oligonucleotide
cuugauaguuaaucaaguuuacaacca

SEQ ID NO: 7172 - RNA, 27 nt, Artificial Sequence
  Synthetic oligonucleotide
cugcaucaucuugauaguuaaucaaac

SEQ ID NO: 7173 - RNA, 27 nt, Artificial Sequence
  Synthetic oligonucleotide
ucugcaucaucuugauaguuaaucaca

SEQ ID NO: 7174 - RNA, 27 nt, Artificial Sequence
  Synthetic oligonucleotide
cugguccucgucauuuagcaguuuuac

SEQ ID NO: 7175 - RNA, 27 nt, Artificial Sequence
  Synthetic oligonucleotide
cauaacugcagccuuauuaaccaccca

SEQ ID NO: 7176 - RNA, 27 nt, Artificial Sequence
  Synthetic oligonucleotide
ccauaacugcagccuuauuaaccacac

SEQ ID NO: 7177 - RNA, 27 nt, Artificial Sequence
  Synthetic oligonucleotide
ggaccauaacugcagccuuauuaacac

SEQ ID NO: 7178 - RNA, 27 nt, Artificial Sequence
  Synthetic oligonucleotide
ccuuuuuagaaagcugauggaccaucc

SEQ ID NO: 7179 - RNA, 27 nt, Artificial Sequence
  Synthetic oligonucleotide
augguacguacaauagcagacaccaca

SEQ ID NO: 7180 - RNA, 27 nt, Artificial Sequence
  Synthetic oligonucleotide
caucauuuguauucugcaugguacgcc

SEQ ID NO: 7181 - RNA, 27 nt, Artificial Sequence
  Synthetic oligonucleotide
cuguuucuacaucauuuguauucugac

SEQ ID NO: 7182 - RNA, 27 nt, Artificial Sequence
  Synthetic oligonucleotide
gcuguuucuacaucauuuguauucuaa

SEQ ID NO: 7183 - RNA, 27 nt, Artificial Sequence
  Synthetic oligonucleotide
guacaacgagcuguuucuacaucaucc

SEQ ID NO: 7184 - RNA, 27 nt, Artificial Sequence
  Synthetic oligonucleotide
cgguacaacgagcuguuucuacauccc

SEQ ID NO: 7185 - RNA, 27 nt, Artificial Sequence
  Synthetic oligonucleotide
gcgguacaacgagcuguuucuacauac

SEQ ID NO: 7186 - RNA, 27 nt, Artificial Sequence
  Synthetic oligonucleotide
gcauaaaacaacacagaauccacugac

SEQ ID NO: 7187 - RNA, 27 nt, Artificial Sequence
  Synthetic oligonucleotide
uggcauaaaacaacacagaauccacca

SEQ ID NO: 7188 - RNA, 27 nt, Artificial Sequence
  Synthetic oligonucleotide
auggcauaaaacaacacagaauccaac

SEQ ID NO: 7189 - RNA, 27 nt, Artificial Sequence
  Synthetic oligonucleotide
uagcuccuucuugauguaauaaaagac

SEQ ID NO: 7190 - RNA, 27 nt, Artificial Sequence
  Synthetic oligonucleotide
uuagcuccuucuugauguaauaaaaaa

SEQ ID NO: 7191 - RNA, 27 nt, Artificial Sequence
  Synthetic oligonucleotide
uuuaacauuuguuuuguugagcaagaa

SEQ ID NO: 7192 - RNA, 27 nt, Artificial Sequence
  Synthetic oligonucleotide
uagccaagaauuuaacauuuguuuuac

SEQ ID NO: 7193 - RNA, 27 nt, Artificial Sequence
  Synthetic oligonucleotide
cguaauagccaagaauuuaacauuuac

SEQ ID NO: 7194 - RNA, 27 nt, Artificial Sequence
  Synthetic oligonucleotide
ucguaauagccaagaauuuaacauuca

SEQ ID NO: 7195 - RNA, 27 nt, Artificial Sequence
  Synthetic oligonucleotide
uaagcuaaaauuugaaggcagucugca

SEQ ID NO: 7196 - RNA, 27 nt, Artificial Sequence
  Synthetic oligonucleotide
uagguccucauuauauuuacuaaagac

SEQ ID NO: 7197 - RNA, 27 nt, Artificial Sequence
  Synthetic oligonucleotide
aaguauagguccucauuauauuuaccc

SEQ ID NO: 7198 - RNA, 27 nt, Artificial Sequence
  Synthetic oligonucleotide
uaaguauagguccucauuauauuuaac

SEQ ID NO: 7199 - RNA, 27 nt, Artificial Sequence
  Synthetic oligonucleotide
guuuuucguaaguauagguccucaucc

SEQ ID NO: 7200 - RNA, 27 nt, Artificial Sequence
  Synthetic oligonucleotide
aguuuuucguaaguauagguccucacc

SEQ ID NO: 7201 - RNA, 27 nt, Artificial Sequence
  Synthetic oligonucleotide
uaguuuuucguaaguauagguccuccc

SEQ ID NO: 7202 - RNA, 27 nt, Artificial Sequence
  Synthetic oligonucleotide
guaguuuuucguaaguauagguccuac

SEQ ID NO: 7203 - RNA, 27 nt, Artificial Sequence
  Synthetic oligonucleotide
gugguccacaguaguuuuucguaagcc

SEQ ID NO: 7204 - RNA, 27 nt, Artificial Sequence
  Synthetic oligonucleotide
ucuacaauagccggcuuauuacuagca

SEQ ID NO: 7205 - RNA, 27 nt, Artificial Sequence
  Synthetic oligonucleotide
cuucuacaauagccggcuuauuacuca

SEQ ID NO: 7206 - RNA, 27 nt, Artificial Sequence
  Synthetic oligonucleotide
aguccuaaagcuugcauuccaccagac

SEQ ID NO: 7207 - RNA, 27 nt, Artificial Sequence
  Synthetic oligonucleotide
aaguccuaaagcuugcauuccaccaaa

SEQ ID NO: 7208 - RNA, 27 nt, Artificial Sequence
  Synthetic oligonucleotide
gaaguccuaaagcuugcauuccaccca

SEQ ID NO: 7209 - RNA, 27 nt, Artificial Sequence
  Synthetic oligonucleotide
caguucugaacaagacguugacuugac

SEQ ID NO: 7210 - RNA, 27 nt, Artificial Sequence
  Synthetic oligonucleotide
acaguucugaacaagacguugacuuaa

SEQ ID NO: 7211 - RNA, 27 nt, Artificial Sequence
  Synthetic oligonucleotide
gaguccaaagacaguucugaacaagca

SEQ ID NO: 7212 - RNA, 27 nt, Artificial Sequence
  Synthetic oligonucleotide
ccuuccuguuuaguugcagcaucugcc

SEQ ID NO: 7213 - RNA, 27 nt, Artificial Sequence
  Synthetic oligonucleotide
ccacauuuauaucaucugaacccagcc

SEQ ID NO: 7214 - RNA, 27 nt, Artificial Sequence
  Synthetic oligonucleotide
ugaccacauuuauaucaucugaaccac

SEQ ID NO: 7215 - RNA, 27 nt, Artificial Sequence
  Synthetic oligonucleotide
cugcacaggugaccacauuuauauccc

SEQ ID NO: 7216 - RNA, 27 nt, Artificial Sequence
  Synthetic oligonucleotide
gcugcacaggugaccacauuuauauac

SEQ ID NO: 7217 - RNA, 27 nt, Artificial Sequence
  Synthetic oligonucleotide
auugcaagugagguuagaaagaauuaa

SEQ ID NO: 7218 - RNA, 27 nt, Artificial Sequence
  Synthetic oligonucleotide
uuauaauuauugcaagugagguuagcc

SEQ ID NO: 7219 - RNA, 27 nt, Artificial Sequence
  Synthetic oligonucleotide
caucaucuuguucuuauaauuauugac

SEQ ID NO: 7220 - RNA, 27 nt, Artificial Sequence
  Synthetic oligonucleotide
ccaucaucuuguucuuauaauuauuaa

SEQ ID NO: 7221 - RNA, 27 nt, Artificial Sequence
  Synthetic oligonucleotide
agaccaucaucuuguucuuauaauucc

SEQ ID NO: 7222 - RNA, 27 nt, Artificial Sequence
  Synthetic oligonucleotide
gcagaccaucaucuuguucuuauaacc

SEQ ID NO: 7223 - RNA, 27 nt, Artificial Sequence
  Synthetic oligonucleotide
ucaauccaacaguagccuuuaucagca

SEQ ID NO: 7224 - RNA, 27 nt, Artificial Sequence
  Synthetic oligonucleotide
ucgaaucaauccaacaguagccuuucc

SEQ ID NO: 7225 - RNA, 27 nt, Artificial Sequence
  Synthetic oligonucleotide
ccuccacaaauugcugcugugucccca

SEQ ID NO: 7226 - RNA, 27 nt, Artificial Sequence
  Synthetic oligonucleotide
guacaaccuucaacuauuucuuccaca

SEQ ID NO: 7227 - RNA, 27 nt, Artificial Sequence
  Synthetic oligonucleotide
gguacaaccuucaacuauuucuucccc

SEQ ID NO: 7228 - RNA, 27 nt, Artificial Sequence
  Synthetic oligonucleotide
cgguacaaccuucaacuauuucuucac

SEQ ID NO: 7229 - RNA, 27 nt, Artificial Sequence
  Synthetic oligonucleotide
ccgguacaaccuucaacuauuucuuaa

SEQ ID NO: 7230 - RNA, 27 nt, Artificial Sequence
  Synthetic oligonucleotide
gggcuccgguacaaccuucaacuaucc

SEQ ID NO: 7231 - RNA, 27 nt, Artificial Sequence
  Synthetic oligonucleotide
uaacaauucgguugugaacaucccgca

SEQ ID NO: 7232 - RNA, 27 nt, Artificial Sequence
  Synthetic oligonucleotide
auaacaauucgguugugaacaucccac

SEQ ID NO: 7233 - RNA, 27 nt, Artificial Sequence
  Synthetic oligonucleotide
gauaacaauucgguugugaacauccaa

SEQ ID NO: 7234 - RNA, 27 nt, Artificial Sequence
  Synthetic oligonucleotide
ugauaacaauucgguugugaacaucaa

SEQ ID NO: 7235 - RNA, 27 nt, Artificial Sequence
  Synthetic oligonucleotide
cugauaacaauucgguugugaacauaa

SEQ ID NO: 7236 - RNA, 27 nt, Artificial Sequence
  Synthetic oligonucleotide
ucugauaacaauucgguugugaacaca

SEQ ID NO: 7237 - RNA, 27 nt, Artificial Sequence
  Synthetic oligonucleotide
guauuuaguccucugauaacaauucaa

SEQ ID NO: 7238 - RNA, 27 nt, Artificial Sequence
  Synthetic oligonucleotide
gguauuuaguccucugauaacaauuaa

SEQ ID NO: 7239 - RNA, 27 nt, Artificial Sequence
  Synthetic oligonucleotide
ugguauuuaguccucugauaacaauca

SEQ ID NO: 7240 - RNA, 27 nt, Artificial Sequence
  Synthetic oligonucleotide
augguauuuaguccucugauaacaacc

SEQ ID NO: 7241 - RNA, 27 nt, Artificial Sequence
  Synthetic oligonucleotide
aaacaauggaaugguauuuaguccuac

SEQ ID NO: 7242 - RNA, 27 nt, Artificial Sequence
  Synthetic oligonucleotide
gcacaaacaauggaaugguauuuagca

SEQ ID NO: 7243 - RNA, 27 nt, Artificial Sequence
  Synthetic oligonucleotide
cugcacaaacaauggaaugguauuuca

SEQ ID NO: 7244 - RNA, 27 nt, Artificial Sequence
  Synthetic oligonucleotide
gcugcacaaacaauggaaugguauucc

SEQ ID NO: 7245 - RNA, 27 nt, Artificial Sequence
  Synthetic oligonucleotide
cagcuacucuuuggauguuuucaauaa

SEQ ID NO: 7246 - RNA, 27 nt, Artificial Sequence
  Synthetic oligonucleotide
gcagcuacucuuuggauguuuucaaca

SEQ ID NO: 7247 - RNA, 27 nt, Artificial Sequence
  Synthetic oligonucleotide
cagcuucaauagcuucugcagcuucac

SEQ ID NO: 7248 - RNA, 27 nt, Artificial Sequence
  Synthetic oligonucleotide
gcucccucagcuucaauagcuucugac

SEQ ID NO: 7249 - RNA, 27 nt, Artificial Sequence
  Synthetic oligonucleotide
uggcucccucagcuucaauagcuucca

SEQ ID NO: 7250 - RNA, 27 nt, Artificial Sequence
  Synthetic oligonucleotide
ucauuccuagagugaaguaacucugca

SEQ ID NO: 7251 - RNA, 27 nt, Artificial Sequence
  Synthetic oligonucleotide
cuucauuccuagagugaaguaacucca

SEQ ID NO: 7252 - RNA, 27 nt, Artificial Sequence
  Synthetic oligonucleotide
ccuucauuccuagagugaaguaacuac

SEQ ID NO: 7253 - RNA, 27 nt, Artificial Sequence
  Synthetic oligonucleotide
uguccucagacauucggaacaaaacca

SEQ ID NO: 7254 - RNA, 27 nt, Artificial Sequence
  Synthetic oligonucleotide
cuuguccucagacauucggaacaaaca

SEQ ID NO: 7255 - RNA, 27 nt, Artificial Sequence
  Synthetic oligonucleotide
ccguuucuuguaaucuuguggcuugca

SEQ ID NO: 7256 - RNA, 27 nt, Artificial Sequence
  Synthetic oligonucleotide
acugaaagccguuucuuguaaucuuac

SEQ ID NO: 7257 - RNA, 27 nt, Artificial Sequence
  Synthetic oligonucleotide
cagcucaacugaaagccguuucuugcc

SEQ ID NO: 7258 - RNA, 27 nt, Artificial Sequence
  Synthetic oligonucleotide
caaguccaagaucagcagucucauuaa

SEQ ID NO: 7259 - RNA, 27 nt, Artificial Sequence
  Synthetic oligonucleotide
gcaccaauaucaaguccaagaucagac

SEQ ID NO: 7260 - RNA, 27 nt, Artificial Sequence
  Synthetic oligonucleotide
aaagaacgauagcuaggaucauccuaa

SEQ ID NO: 7261 - RNA, 27 nt, Artificial Sequence
  Synthetic oligonucleotide
cauauccaccagagugaaaagaacgcc

SEQ ID NO: 7262 - RNA, 27 nt, Artificial Sequence
  Synthetic oligonucleotide
ugauuuacaggucaguaucaaaccaaa

SEQ ID NO: 7263 - RNA, 27 nt, Artificial Sequence
  Synthetic oligonucleotide
augauuuacaggucaguaucaaaccca

SEQ ID NO: 7264 - RNA, 27 nt, Artificial Sequence
  Synthetic oligonucleotide
gaugauuuacaggucaguaucaaacac

SEQ ID NO: 7265 - RNA, 27 nt, Artificial Sequence
  Synthetic oligonucleotide
cuucuuaccuaaaggaugauuuacaaa

SEQ ID NO: 7266 - RNA, 27 nt, Artificial Sequence
  Synthetic oligonucleotide
acuucuuaccuaaaggaugauuuacca

SEQ ID NO: 7267 - RNA, 27 nt, Artificial Sequence
  Synthetic oligonucleotide
aaacuucuuaccuaaaggaugauuuca

SEQ ID NO: 7268 - RNA, 27 nt, Artificial Sequence
  Synthetic oligonucleotide
gcuuuuuaaaacuucuuaccuaaagac

SEQ ID NO: 7269 - RNA, 27 nt, Artificial Sequence
  Synthetic oligonucleotide
uggcuuuuuaaaacuucuuaccuaaca

SEQ ID NO: 7270 - RNA, 27 nt, Artificial Sequence
  Synthetic oligonucleotide
ccaaacuggcuuuuuaaaacuucuuca

SEQ ID NO: 7271 - RNA, 27 nt, Artificial Sequence
  Synthetic oligonucleotide
uuacccaaacuggcuuuuuaaaacuca

SEQ ID NO: 7272 - RNA, 27 nt, Artificial Sequence
  Synthetic oligonucleotide
uuuacccaaacuggcuuuuuaaaaccc

SEQ ID NO: 7273 - RNA, 27 nt, Artificial Sequence
  Synthetic oligonucleotide
uuuuacccaaacuggcuuuuuaaaaac

SEQ ID NO: 7274 - RNA, 27 nt, Artificial Sequence
  Synthetic oligonucleotide
auuuuacccaaacuggcuuuuuaaaca

SEQ ID NO: 7275 - RNA, 27 nt, Artificial Sequence
  Synthetic oligonucleotide
ccaaccaagucuuucugaaguucugcc

SEQ ID NO: 7276 - RNA, 27 nt, Artificial Sequence
  Synthetic oligonucleotide
ccacccuaccaaccaagucuuucugcc

SEQ ID NO: 7277 - RNA, 27 nt, Artificial Sequence
  Synthetic oligonucleotide
auuuacaaauagccuaaaccacuccac

SEQ ID NO: 7278 - RNA, 27 nt, Artificial Sequence
  Synthetic oligonucleotide
gauuuacaaauagccuaaaccacucaa

SEQ ID NO: 7279 - RNA, 27 nt, Artificial Sequence
  Synthetic oligonucleotide
agauuuacaaauagccuaaaccacuaa

SEQ ID NO: 7280 - RNA, 27 nt, Artificial Sequence
  Synthetic oligonucleotide
cagauuuacaaauagccuaaaccacca

SEQ ID NO: 7281 - RNA, 27 nt, Artificial Sequence
  Synthetic oligonucleotide
uguuuuuguggcagauuuacaaauaaa

SEQ ID NO: 7282 - RNA, 27 nt, Artificial Sequence
  Synthetic oligonucleotide
cuguuuuuguggcagauuuacaaauca

SEQ ID NO: 7283 - RNA, 27 nt, Artificial Sequence
  Synthetic oligonucleotide
ccuguuuuuguggcagauuuacaaacc

SEQ ID NO: 7284 - RNA, 27 nt, Artificial Sequence
  Synthetic oligonucleotide
auauaccuguuuuuguggcagauuuca

SEQ ID NO: 7285 - RNA, 27 nt, Artificial Sequence
  Synthetic oligonucleotide
cuuucaaaguauauaccuguuuuugca

SEQ ID NO: 7286 - RNA, 27 nt, Artificial Sequence
  Synthetic oligonucleotide
caucuccuuucaaaguauauaccugcc

SEQ ID NO: 7287 - RNA, 27 nt, Artificial Sequence
  Synthetic oligonucleotide
acaucuccuuucaaaguauauaccuac

SEQ ID NO: 7288 - RNA, 27 nt, Artificial Sequence
  Synthetic oligonucleotide
agacaucuccuuucaaaguauauacac

SEQ ID NO: 7289 - RNA, 27 nt, Artificial Sequence
  Synthetic oligonucleotide
aagacaucuccuuucaaaguauauaaa

SEQ ID NO: 7290 - RNA, 27 nt, Artificial Sequence
  Synthetic oligonucleotide
caagacaucuccuuucaaaguauauca

SEQ ID NO: 7291 - RNA, 27 nt, Artificial Sequence
  Synthetic oligonucleotide
uguuccaagacaucuccuuucaaagcc

SEQ ID NO: 7292 - RNA, 27 nt, Artificial Sequence
  Synthetic oligonucleotide
cauuccaauguuccaagacaucucccc

SEQ ID NO: 7293 - RNA, 27 nt, Artificial Sequence
  Synthetic oligonucleotide
acauuccaauguuccaagacaucucac

SEQ ID NO: 7294 - RNA, 27 nt, Artificial Sequence
  Synthetic oligonucleotide
gaacauuccaauguuccaagacaucca

SEQ ID NO: 7295 - RNA, 27 nt, Artificial Sequence
  Synthetic oligonucleotide
ccagaaaucugagaacauuccaaugcc

SEQ ID NO: 7296 - RNA, 27 nt, Artificial Sequence
  Synthetic oligonucleotide
acaaccagaaaucugagaacauucccc

SEQ ID NO: 7297 - RNA, 27 nt, Artificial Sequence
  Synthetic oligonucleotide
uaacaaccagaaaucugagaacauuaa

SEQ ID NO: 7298 - RNA, 27 nt, Artificial Sequence
  Synthetic oligonucleotide
auaacaaccagaaaucugagaacauca

SEQ ID NO: 7299 - RNA, 27 nt, Artificial Sequence
  Synthetic oligonucleotide
cauaacaaccagaaaucugagaacacc

SEQ ID NO: 7300 - RNA, 27 nt, Artificial Sequence
  Synthetic oligonucleotide
ugaucacauaacaaccagaaaucugca

SEQ ID NO: 7301 - RNA, 27 nt, Artificial Sequence
  Synthetic oligonucleotide
augaucacauaacaaccagaaaucuac

SEQ ID NO: 7302 - RNA, 27 nt, Artificial Sequence
  Synthetic oligonucleotide
ccacacaugaucacauaacaaccagcc

SEQ ID NO: 7303 - RNA, 27 nt, Artificial Sequence
  Synthetic oligonucleotide
cuuccacacaugaucacauaacaacac

SEQ ID NO: 7304 - RNA, 27 nt, Artificial Sequence
  Synthetic oligonucleotide
aauaacuuccacacaugaucacauaca

SEQ ID NO: 7305 - RNA, 27 nt, Artificial Sequence
  Synthetic oligonucleotide
uaauaacuuccacacaugaucacaucc

SEQ ID NO: 7306 - RNA, 27 nt, Artificial Sequence
  Synthetic oligonucleotide
uuaauaacuuccacacaugaucacacc

SEQ ID NO: 7307 - RNA, 27 nt, Artificial Sequence
  Synthetic oligonucleotide
guuaauaacuuccacacaugaucaccc

SEQ ID NO: 7308 - RNA, 27 nt, Artificial Sequence
  Synthetic oligonucleotide
cauuaaaguuaauaacuuccacacaca

SEQ ID NO: 7309 - RNA, 27 nt, Artificial Sequence
  Synthetic oligonucleotide
acauuaaaguuaauaacuuccacaccc

SEQ ID NO: 7310 - RNA, 27 nt, Artificial Sequence
  Synthetic oligonucleotide
aaacauuaaaguuaauaacuuccacca

SEQ ID NO: 7311 - RNA, 27 nt, Artificial Sequence
  Synthetic oligonucleotide
aaaacauuaaaguuaauaacuuccaac

SEQ ID NO: 7312 - RNA, 27 nt, Artificial Sequence
  Synthetic oligonucleotide
aaaaacauuaaaguuaauaacuuccca

SEQ ID NO: 7313 - RNA, 27 nt, Artificial Sequence
  Synthetic oligonucleotide
aaaaaacauuaaaguuaauaacuucac

SEQ ID NO: 7314 - RNA, 27 nt, Artificial Sequence
  Synthetic oligonucleotide
caaaaaacauuaaaguuaauaacuuaa

SEQ ID NO: 7315 - RNA, 27 nt, Artificial Sequence
  Synthetic oligonucleotide
gcaaaaaacauuaaaguuaauaacuca

SEQ ID NO: 7316 - RNA, 27 nt, Artificial Sequence
  Synthetic oligonucleotide
uggcaaaaaacauuaaaguuaauaaac

SEQ ID NO: 7317 - RNA, 27 nt, Artificial Sequence
  Synthetic oligonucleotide
guggcaaaaaacauuaaaguuaauaca

SEQ ID NO: 7318 - RNA, 27 nt, Artificial Sequence
  Synthetic oligonucleotide
uugcaaaagcuguggcaaaaaacaucc

SEQ ID NO: 7319 - RNA, 27 nt, Artificial Sequence
  Synthetic oligonucleotide
guugcaaaagcuguggcaaaaaacacc

SEQ ID NO: 7320 - RNA, 27 nt, Artificial Sequence
  Synthetic oligonucleotide
acucauuugaguauuaaguugcaaaca

SEQ ID NO: 7321 - RNA, 27 nt, Artificial Sequence
  Synthetic oligonucleotide
uuaaaacagcaaauguuacucauuuac

SEQ ID NO: 7322 - RNA, 27 nt, Artificial Sequence
  Synthetic oligonucleotide
uuuaaaacagcaaauguuacucauuca

SEQ ID NO: 7323 - RNA, 27 nt, Artificial Sequence
  Synthetic oligonucleotide
guuuaaaacagcaaauguuacucaucc

SEQ ID NO: 7324 - RNA, 27 nt, Artificial Sequence
  Synthetic oligonucleotide
uguuuaaaacagcaaauguuacucacc

SEQ ID NO: 7325 - RNA, 27 nt, Artificial Sequence
  Synthetic oligonucleotide
auguuuaaaacagcaaauguuacuccc

SEQ ID NO: 7326 - RNA, 27 nt, Artificial Sequence
  Synthetic oligonucleotide
aauguuuaaaacagcaaauguuacuac

SEQ ID NO: 7327 - RNA, 27 nt, Artificial Sequence
  Synthetic oligonucleotide
cuauuaauguuuaaaacagcaaaugcc

SEQ ID NO: 7328 - RNA, 27 nt, Artificial Sequence
  Synthetic oligonucleotide
agagaaaggcugcuauuaauguuuacc

SEQ ID NO: 7329 - RNA, 27 nt, Artificial Sequence
  Synthetic oligonucleotide
caaguucagacaauacagcuguauacc

SEQ ID NO: 7330 - RNA, 27 nt, Artificial Sequence
  Synthetic oligonucleotide
ucacaaugcaaguucagacaauacaaa

SEQ ID NO: 7331 - RNA, 27 nt, Artificial Sequence
  Synthetic oligonucleotide
aaucacaaugcaaguucagacaauaac

SEQ ID NO: 7332 - RNA, 27 nt, Artificial Sequence
  Synthetic oligonucleotide
ccaaucacaaugcaaguucagacaacc

SEQ ID NO: 7333 - RNA, 27 nt, Artificial Sequence
  Synthetic oligonucleotide
caggccaaucacaaugcaaguucagca

SEQ ID NO: 7334 - RNA, 27 nt, Artificial Sequence
  Synthetic oligonucleotide
uuguucccauaggaaacucagcuugac

SEQ ID NO: 7335 - RNA, 27 nt, Artificial Sequence
  Synthetic oligonucleotide
cuucaauuguucccauaggaaacucca

SEQ ID NO: 7336 - RNA, 27 nt, Artificial Sequence
  Synthetic oligonucleotide
acuucaauuguucccauaggaaacuac

SEQ ID NO: 7337 - RNA, 27 nt, Artificial Sequence
  Synthetic oligonucleotide
aaguuuacuucaauuguucccauagac

SEQ ID NO: 7338 - RNA, 27 nt, Artificial Sequence
  Synthetic oligonucleotide
aaaguuuacuucaauuguucccauaaa

SEQ ID NO: 7339 - RNA, 27 nt, Artificial Sequence
  Synthetic oligonucleotide
acaaaaaguuuacuucaauuguuccac

SEQ ID NO: 7340 - RNA, 27 nt, Artificial Sequence
  Synthetic oligonucleotide
cagaacaaaaaguuuacuucaauugcc

SEQ ID NO: 7341 - RNA, 27 nt, Artificial Sequence
  Synthetic oligonucleotide
aggaccagaacaaaaaguuuacuuccc

SEQ ID NO: 7342 - RNA, 27 nt, Artificial Sequence
  Synthetic oligonucleotide
aaggaccagaacaaaaaguuuacuuac

SEQ ID NO: 7343 - RNA, 27 nt, Artificial Sequence
  Synthetic oligonucleotide
cgaccaaaaaggaccagaacaaaaaac

SEQ ID NO: 7344 - RNA, 27 nt, Artificial Sequence
  Synthetic oligonucleotide
ucgaccaaaaaggaccagaacaaaaca

SEQ ID NO: 7345 - RNA, 27 nt, Artificial Sequence
  Synthetic oligonucleotide
uuacuccucgaccaaaaaggaccagcc

SEQ ID NO: 7346 - RNA, 27 nt, Artificial Sequence
  Synthetic oligonucleotide
aauccauuuguauuguuacuccucgca

SEQ ID NO: 7347 - RNA, 27 nt, Artificial Sequence
  Synthetic oligonucleotide
aaauccauuuguauuguuacuccucac

SEQ ID NO: 7348 - RNA, 27 nt, Artificial Sequence
  Synthetic oligonucleotide
aaaauccauuuguauuguuacuccuaa

SEQ ID NO: 7349 - RNA, 27 nt, Artificial Sequence
  Synthetic oligonucleotide
caaaauccauuuguauuguuacuccca

SEQ ID NO: 7350 - RNA, 27 nt, Artificial Sequence
  Synthetic oligonucleotide
ccaaaauccauuuguauuguuacucac

SEQ ID NO: 7351 - RNA, 27 nt, Artificial Sequence
  Synthetic oligonucleotide
ucacucccaaaauccauuuguauugcc

SEQ ID NO: 7352 - RNA, 27 nt, Artificial Sequence
  Synthetic oligonucleotide
ucuucacuucuugagucacucccaacc

SEQ ID NO: 7353 - RNA, 27 nt, Artificial Sequence
  Synthetic oligonucleotide
auucuucacuucuugagucacuccccc

SEQ ID NO: 7354 - RNA, 27 nt, Artificial Sequence
  Synthetic oligonucleotide
cauucuucacuucuugagucacuccac

SEQ ID NO: 7355 - RNA, 27 nt, Artificial Sequence
  Synthetic oligonucleotide
gcauucuucacuucuugagucacucaa

SEQ ID NO: 7356 - RNA, 27 nt, Artificial Sequence
  Synthetic oligonucleotide
gugcauucuucacuucuugagucacca

SEQ ID NO: 7357 - RNA, 27 nt, Artificial Sequence
  Synthetic oligonucleotide
ccauucuugugcauucuucacuucuca

SEQ ID NO: 7358 - RNA, 27 nt, Artificial Sequence
  Synthetic oligonucleotide
gauccauucuugugcauucuucacuca

SEQ ID NO: 7359 - RNA, 27 nt, Artificial Sequence
  Synthetic oligonucleotide
ugauccauucuugugcauucuucaccc

SEQ ID NO: 7360 - RNA, 27 nt, Artificial Sequence
  Synthetic oligonucleotide
gugauccauucuugugcauucuucaac

SEQ ID NO: 7361 - RNA, 27 nt, Artificial Sequence
  Synthetic oligonucleotide
uaaauuccaucuugugauccauucuca

SEQ ID NO: 7362 - RNA, 27 nt, Artificial Sequence
  Synthetic oligonucleotide
gauaaauuccaucuugugauccauuac

SEQ ID NO: 7363 - RNA, 27 nt, Artificial Sequence
  Synthetic oligonucleotide
ugauaaauuccaucuugugauccauca

SEQ ID NO: 7364 - RNA, 27 nt, Artificial Sequence
  Synthetic oligonucleotide
uugauaaauuccaucuugugauccacc

SEQ ID NO: 7365 - RNA, 27 nt, Artificial Sequence
  Synthetic oligonucleotide
uuugauaaauuccaucuugugaucccc

SEQ ID NO: 7366 - RNA, 27 nt, Artificial Sequence
  Synthetic oligonucleotide
aaggcuaggguuugauaaauuccauac

SEQ ID NO: 7367 - RNA, 27 nt, Artificial Sequence
  Synthetic oligonucleotide
aaaaaaauuuaacaagcaaggcuagaa

SEQ ID NO: 7368 - RNA, 27 nt, Artificial Sequence
  Synthetic oligonucleotide
aaaaaaaaaaaaaaaauuuaacaagac

SEQ ID NO: 7369 - RNA, 27 nt, Artificial Sequence
  Synthetic oligonucleotide
aaaaaaaaaaaaaaaaauuuaacaaaa

SEQ ID NO: 7370 - RNA, 27 nt, Artificial Sequence
  Synthetic oligonucleotide
aaaaaaaaaaaaaaaaaauuuaacaca

SEQ ID NO: 7371 - RNA, 27 nt, Artificial Sequence
  Synthetic oligonucleotide
aaaaaaaaaaaaaaaaaaauuuaaccc

SEQ ID NO: 7372 - RNA, 27 nt, Artificial Sequence
  Synthetic oligonucleotide
uaaaaaaaaaaaaaaaaaaauuuaaac

SEQ ID NO: 7373 - RNA, 27 nt, Artificial Sequence
  Synthetic oligonucleotide
uuaaaaaaaaaaaaaaaaaaauuuaca

SEQ ID NO: 7374 - RNA, 27 nt, Artificial Sequence
  Synthetic oligonucleotide
cuuaaaaaaaaaaaaaaaaaaauuucc

SEQ ID NO: 7375 - RNA, 27 nt, Artificial Sequence
  Synthetic oligonucleotide
ucuuaaaaaaaaaaaaaaaaaaauucc

SEQ ID NO: 7376 - RNA, 27 nt, Artificial Sequence
  Synthetic oligonucleotide
auucuuaaaaaaaaaaaaaaaaaaacc

SEQ ID NO: 7377 - RNA, 27 nt, Artificial Sequence
  Synthetic oligonucleotide
uauucuuaaaaaaaaaaaaaaaaaacc

SEQ ID NO: 7378 - RNA, 27 nt, Artificial Sequence
  Synthetic oligonucleotide
auauucuuaaaaaaaaaaaaaaaaacc

SEQ ID NO: 7379 - RNA, 27 nt, Artificial Sequence
  Synthetic oligonucleotide
gauauucuuaaaaaaaaaaaaaaaacc

SEQ ID NO: 7380 - RNA, 27 nt, Artificial Sequence
  Synthetic oligonucleotide
agauauucuuaaaaaaaaaaaaaaacc

SEQ ID NO: 7381 - RNA, 27 nt, Artificial Sequence
  Synthetic oligonucleotide
cagauauucuuaaaaaaaaaaaaaacc

SEQ ID NO: 7382 - RNA, 27 nt, Artificial Sequence
  Synthetic oligonucleotide
acagauauucuuaaaaaaaaaaaaacc

SEQ ID NO: 7383 - RNA, 27 nt, Artificial Sequence
  Synthetic oligonucleotide
cauuacagauauucuuaaaaaaaaacc

SEQ ID NO: 7384 - RNA, 27 nt, Artificial Sequence
  Synthetic oligonucleotide
ccauuacagauauucuuaaaaaaaacc

SEQ ID NO: 7385 - RNA, 27 nt, Artificial Sequence
  Synthetic oligonucleotide
aguaccauuacagauauucuuaaaacc

SEQ ID NO: 7386 - RNA, 27 nt, Artificial Sequence
  Synthetic oligonucleotide
caguaccauuacagauauucuuaaacc

SEQ ID NO: 7387 - RNA, 27 nt, Artificial Sequence
  Synthetic oligonucleotide
ucaguaccauuacagauauucuuaacc

SEQ ID NO: 7388 - RNA, 27 nt, Artificial Sequence
  Synthetic oligonucleotide
aaagucaguaccauuacagauauuccc

SEQ ID NO: 7389 - RNA, 27 nt, Artificial Sequence
  Synthetic oligonucleotide
gcuacuucaaagcaagcaaagucagcc

SEQ ID NO: 7390 - RNA, 27 nt, Artificial Sequence
  Synthetic oligonucleotide
aaaaaaagagcuacuucaaagcaagac

SEQ ID NO: 7391 - RNA, 27 nt, Artificial Sequence
  Synthetic oligonucleotide
aaaaaaaaaaaagagcuacuucaaaaa

SEQ ID NO: 7392 - RNA, 27 nt, Artificial Sequence
  Synthetic oligonucleotide
aaaaaaaaaaaaagagcuacuucaaca

SEQ ID NO: 7393 - RNA, 27 nt, Artificial Sequence
  Synthetic oligonucleotide
aaaaaaaaaaaaaaagagcuacuuccc

SEQ ID NO: 7394 - RNA, 27 nt, Artificial Sequence
  Synthetic oligonucleotide
aaaaaaaaaaaaaaaagagcuacuuac

SEQ ID NO: 7395 - RNA, 27 nt, Artificial Sequence
  Synthetic oligonucleotide
aaaaaaaaaaaaaaaaagagcuacuca

SEQ ID NO: 7396 - RNA, 27 nt, Artificial Sequence
  Synthetic oligonucleotide
aaaaaaaaaaaaaaaaaagagcuaccc

SEQ ID NO: 7397 - RNA, 27 nt, Artificial Sequence
  Synthetic oligonucleotide
aaaaaaaaaaaaaaaaaaaaaaaagca

SEQ ID NO: 7398 - RNA, 27 nt, Artificial Sequence
  Synthetic oligonucleotide
aaaaaaaaaaaaaaaaaaaaaaaaaac

SEQ ID NO: 7399 - RNA, 27 nt, Artificial Sequence
  Synthetic oligonucleotide
caaaaaaaaaaaaaaaaaaaaaaaaca

SEQ ID NO: 7400 - RNA, 27 nt, Artificial Sequence
  Synthetic oligonucleotide
gcaaaaaaaaaaaaaaaaaaaaaaacc

SEQ ID NO: 7401 - RNA, 27 nt, Artificial Sequence
  Synthetic oligonucleotide
cugcaaaaaaaaaaaaaaaaaaaaacc

SEQ ID NO: 7402 - RNA, 27 nt, Artificial Sequence
  Synthetic oligonucleotide
acugcaaaaaaaaaaaaaaaaaaaacc

SEQ ID NO: 7403 - RNA, 27 nt, Artificial Sequence
  Synthetic oligonucleotide
aguuacugcaaaaaaaaaaaaaaaacc

SEQ ID NO: 7404 - RNA, 27 nt, Artificial Sequence
  Synthetic oligonucleotide
caguuacugcaaaaaaaaaaaaaaacc

SEQ ID NO: 7405 - RNA, 27 nt, Artificial Sequence
  Synthetic oligonucleotide
acaguuacugcaaaaaaaaaaaaaacc

SEQ ID NO: 7406 - RNA, 27 nt, Artificial Sequence
  Synthetic oligonucleotide
aaaaacaguuacugcaaaaaaaaaacc

SEQ ID NO: 7407 - RNA, 27 nt, Artificial Sequence
  Synthetic oligonucleotide
aaaaaacaguuacugcaaaaaaaaacc

SEQ ID NO: 7408 - RNA, 27 nt, Artificial Sequence
  Synthetic oligonucleotide
uaaaaaacaguuacugcaaaaaaaacc

SEQ ID NO: 7409 - RNA, 27 nt, Artificial Sequence
  Synthetic oligonucleotide
cuuaaaaaacaguuacugcaaaaaacc

SEQ ID NO: 7410 - RNA, 27 nt, Artificial Sequence
  Synthetic oligonucleotide
acuuaaaaaacaguuacugcaaaaacc

SEQ ID NO: 7411 - RNA, 27 nt, Artificial Sequence
  Synthetic oligonucleotide
agacuuaaaaaacaguuacugcaaacc

SEQ ID NO: 7412 - RNA, 27 nt, Artificial Sequence
  Synthetic oligonucleotide
acacuacgagagacuuaaaaaacagcc

SEQ ID NO: 7413 - RNA, 27 nt, Artificial Sequence
  Synthetic oligonucleotide
uaacacuacgagagacuuaaaaaacca

SEQ ID NO: 7414 - RNA, 27 nt, Artificial Sequence
  Synthetic oligonucleotide
uuaacacuacgagagacuuaaaaaaac

SEQ ID NO: 7415 - RNA, 27 nt, Artificial Sequence
  Synthetic oligonucleotide
acuuaacacuacgagagacuuaaaacc

SEQ ID NO: 7416 - RNA, 27 nt, Artificial Sequence
  Synthetic oligonucleotide
auaacuuaacacuacgagagacuuacc

SEQ ID NO: 7417 - RNA, 27 nt, Artificial Sequence
  Synthetic oligonucleotide
uauaacuuaacacuacgagagacuucc

SEQ ID NO: 7418 - RNA, 27 nt, Artificial Sequence
  Synthetic oligonucleotide
guauucacuauaacuuaacacuacgca

SEQ ID NO: 7419 - RNA, 27 nt, Artificial Sequence
  Synthetic oligonucleotide
aguauucacuauaacuuaacacuacac

SEQ ID NO: 7420 - RNA, 27 nt, Artificial Sequence
  Synthetic oligonucleotide
caguauucacuauaacuuaacacuaaa

SEQ ID NO: 7421 - RNA, 27 nt, Artificial Sequence
  Synthetic oligonucleotide
gcaguauucacuauaacuuaacacuca

SEQ ID NO: 7422 - RNA, 27 nt, Artificial Sequence
  Synthetic oligonucleotide
agaaauugcuguagcaguauucacucc

SEQ ID NO: 7423 - RNA, 27 nt, Artificial Sequence
  Synthetic oligonucleotide
uagaaauugcuguagcaguauucaccc

SEQ ID NO: 7424 - RNA, 27 nt, Artificial Sequence
  Synthetic oligonucleotide
uuagaaauugcuguagcaguauucaac

SEQ ID NO: 7425 - RNA, 27 nt, Artificial Sequence
  Synthetic oligonucleotide
acucaauucuuaaaaauuagaaauuaa

SEQ ID NO: 7426 - RNA, 27 nt, Artificial Sequence
  Synthetic oligonucleotide
ccauuacucaauucuuaaaaauuagcc

SEQ ID NO: 7427 - RNA, 27 nt, Artificial Sequence
  Synthetic oligonucleotide
acaccauuacucaauucuuaaaaaucc

SEQ ID NO: 7428 - RNA, 27 nt, Artificial Sequence
  Synthetic oligonucleotide
cuacaccauuacucaauucuuaaaacc

SEQ ID NO: 7429 - RNA, 27 nt, Artificial Sequence
  Synthetic oligonucleotide
ucuacaccauuacucaauucuuaaacc

SEQ ID NO: 7430 - RNA, 27 nt, Artificial Sequence
  Synthetic oligonucleotide
guucuacaccauuacucaauucuuacc

SEQ ID NO: 7431 - RNA, 27 nt, Artificial Sequence
  Synthetic oligonucleotide
guguucuacaccauuacucaauucucc

SEQ ID NO: 7432 - RNA, 27 nt, Artificial Sequence
  Synthetic oligonucleotide
augaauuaguguucuacaccauuacca

SEQ ID NO: 7433 - RNA, 27 nt, Artificial Sequence
  Synthetic oligonucleotide
ugauuaugaauuaguguucuacacccc

SEQ ID NO: 7434 - RNA, 27 nt, Artificial Sequence
  Synthetic oligonucleotide
gugauuaugaauuaguguucuacacac

SEQ ID NO: 7435 - RNA, 27 nt, Artificial Sequence
  Synthetic oligonucleotide
agugauuaugaauuaguguucuacaaa

SEQ ID NO: 7436 - RNA, 27 nt, Artificial Sequence
  Synthetic oligonucleotide
auuaauuagagugauuaugaauuagca

SEQ ID NO: 7437 - RNA, 27 nt, Artificial Sequence
  Synthetic oligonucleotide
aauuaauuagagugauuaugaauuaac

SEQ ID NO: 7438 - RNA, 27 nt, Artificial Sequence
  Synthetic oligonucleotide
caauuaauuagagugauuaugaauuca

SEQ ID NO: 7439 - RNA, 27 nt, Artificial Sequence
  Synthetic oligonucleotide
auuacaauuaauuagagugauuaugcc

SEQ ID NO: 7440 - RNA, 27 nt, Artificial Sequence
  Synthetic oligonucleotide
gauuacaauuaauuagagugauuauac

SEQ ID NO: 7441 - RNA, 27 nt, Artificial Sequence
  Synthetic oligonucleotide
agauuacaauuaauuagagugauuaca

SEQ ID NO: 7442 - RNA, 27 nt, Artificial Sequence
  Synthetic oligonucleotide
cuuuauucagauuacaauuaauuagca

SEQ ID NO: 7443 - RNA, 27 nt, Artificial Sequence
  Synthetic oligonucleotide
acuuuauucagauuacaauuaauuaac

SEQ ID NO: 7444 - RNA, 27 nt, Artificial Sequence
  Synthetic oligonucleotide
uuacacuuuauucagauuacaauuacc

SEQ ID NO: 7445 - RNA, 27 nt, Artificial Sequence
  Synthetic oligonucleotide
guuacacuuuauucagauuacaauucc

SEQ ID NO: 7446 - RNA, 27 nt, Artificial Sequence
  Synthetic oligonucleotide
uguuacacuuuauucagauuacaaucc

SEQ ID NO: 7447 - RNA, 27 nt, Artificial Sequence
  Synthetic oligonucleotide
uuguuacacuuuauucagauuacaacc

SEQ ID NO: 7448 - RNA, 27 nt, Artificial Sequence
  Synthetic oligonucleotide
auuguuacacuuuauucagauuacacc

SEQ ID NO: 7449 - RNA, 27 nt, Artificial Sequence
  Synthetic oligonucleotide
cuacacaauuguuacacuuuauucaac

SEQ ID NO: 7450 - RNA, 27 nt, Artificial Sequence
  Synthetic oligonucleotide
aaggcuacacaauuguuacacuuuacc

SEQ ID NO: 7451 - RNA, 27 nt, Artificial Sequence
  Synthetic oligonucleotide
acaaaaaggcuacacaauuguuacaac

SEQ ID NO: 7452 - RNA, 27 nt, Artificial Sequence
  Synthetic oligonucleotide
uuuuauacaaaaaggcuacacaauuac

SEQ ID NO: 7453 - RNA, 27 nt, Artificial Sequence
  Synthetic oligonucleotide
auuuuauacaaaaaggcuacacaauca

SEQ ID NO: 7454 - RNA, 27 nt, Artificial Sequence
  Synthetic oligonucleotide
cuauuuuauacaaaaaggcuacacacc

SEQ ID NO: 7455 - RNA, 27 nt, Artificial Sequence
  Synthetic oligonucleotide
ucuauuuuauacaaaaaggcuacaccc

SEQ ID NO: 7456 - RNA, 27 nt, Artificial Sequence
  Synthetic oligonucleotide
ugucuauuuuauacaaaaaggcuacca

SEQ ID NO: 7457 - RNA, 27 nt, Artificial Sequence
  Synthetic oligonucleotide
ucuauuugucuauuuuauacaaaaaaa

SEQ ID NO: 7458 - RNA, 27 nt, Artificial Sequence
  Synthetic oligonucleotide
uuucuauuugucuauuuuauacaaacc

SEQ ID NO: 7459 - RNA, 27 nt, Artificial Sequence
  Synthetic oligonucleotide
uuuucuauuugucuauuuuauacaacc

SEQ ID NO: 7460 - RNA, 27 nt, Artificial Sequence
  Synthetic oligonucleotide
auuuucuauuugucuauuuuauacacc

SEQ ID NO: 7461 - RNA, 27 nt, Artificial Sequence
  Synthetic oligonucleotide
cauuuucuauuugucuauuuuauaccc

SEQ ID NO: 7462 - RNA, 27 nt, Artificial Sequence
  Synthetic oligonucleotide
ccauuuucuauuugucuauuuuauaac

SEQ ID NO: 7463 - RNA, 27 nt, Artificial Sequence
  Synthetic oligonucleotide
ggaccauuuucuauuugucuauuuucc

SEQ ID NO: 7464 - RNA, 27 nt, Artificial Sequence
  Synthetic oligonucleotide
uggaccauuuucuauuugucuauuucc

SEQ ID NO: 7465 - RNA, 27 nt, Artificial Sequence
  Synthetic oligonucleotide
uuggaccauuuucuauuugucuauucc

SEQ ID NO: 7466 - RNA, 27 nt, Artificial Sequence
  Synthetic oligonucleotide
aaacuaauuggaccauuuucuauuuac

SEQ ID NO: 7467 - RNA, 27 nt, Artificial Sequence
  Synthetic oligonucleotide
gaaacuaauuggaccauuuucuauuca

SEQ ID NO: 7468 - RNA, 27 nt, Artificial Sequence
  Synthetic oligonucleotide
ggaaacuaauuggaccauuuucuaucc

SEQ ID NO: 7469 - RNA, 27 nt, Artificial Sequence
  Synthetic oligonucleotide
aggaaacuaauuggaccauuuucuacc

SEQ ID NO: 7470 - RNA, 27 nt, Artificial Sequence
  Synthetic oligonucleotide
uuaaaaaggaaacuaauuggaccaucc

SEQ ID NO: 7471 - RNA, 27 nt, Artificial Sequence
  Synthetic oligonucleotide
auuaaaaaggaaacuaauuggaccacc

SEQ ID NO: 7472 - RNA, 27 nt, Artificial Sequence
  Synthetic oligonucleotide
aagcauauuaaaaaggaaacuaauuaa

SEQ ID NO: 7473 - RNA, 27 nt, Artificial Sequence
  Synthetic oligonucleotide
uaagcauauuaaaaaggaaacuaauca

SEQ ID NO: 7474 - RNA, 27 nt, Artificial Sequence
  Synthetic oligonucleotide
auuuuaagcauauuaaaaaggaaaccc

SEQ ID NO: 7475 - RNA, 27 nt, Artificial Sequence
  Synthetic oligonucleotide
cugcuuauuuuaagcauauuaaaaaaa

SEQ ID NO: 7476 - RNA, 27 nt, Artificial Sequence
  Synthetic oligonucleotide
ccugcuuauuuuaagcauauuaaaaca

SEQ ID NO: 7477 - RNA, 27 nt, Artificial Sequence
  Synthetic oligonucleotide
gauccaccugcuuauuuuaagcauacc

SEQ ID NO: 7478 - RNA, 27 nt, Artificial Sequence
  Synthetic oligonucleotide
caaaaacaugaaauagauccaccugac

SEQ ID NO: 7479 - RNA, 27 nt, Artificial Sequence
  Synthetic oligonucleotide
ucaaaaacaugaaauagauccaccuaa

SEQ ID NO: 7480 - RNA, 27 nt, Artificial Sequence
  Synthetic oligonucleotide
gaucaaaaacaugaaauagauccacac

SEQ ID NO: 7481 - RNA, 27 nt, Artificial Sequence
  Synthetic oligonucleotide
ugaucaaaaacaugaaauagauccaaa

SEQ ID NO: 7482 - RNA, 27 nt, Artificial Sequence
  Synthetic oligonucleotide
uugaucaaaaacaugaaauagauccca

SEQ ID NO: 7483 - RNA, 27 nt, Artificial Sequence
  Synthetic oligonucleotide
aguuuuugaucaaaaacaugaaauaac

SEQ ID NO: 7484 - RNA, 27 nt, Artificial Sequence
  Synthetic oligonucleotide
ccaaauaguuuuugaucaaaaacauac

SEQ ID NO: 7485 - RNA, 27 nt, Artificial Sequence
  Synthetic oligonucleotide
uaucccaaauaguuuuugaucaaaaca

SEQ ID NO: 7486 - RNA, 27 nt, Artificial Sequence
  Synthetic oligonucleotide
auaucccaaauaguuuuugaucaaacc

SEQ ID NO: 7487 - RNA, 27 nt, Artificial Sequence
  Synthetic oligonucleotide
cauaucccaaauaguuuuugaucaacc

SEQ ID NO: 7488 - RNA, 27 nt, Artificial Sequence
  Synthetic oligonucleotide
acauaucccaaauaguuuuugaucacc

SEQ ID NO: 7489 - RNA, 27 nt, Artificial Sequence
  Synthetic oligonucleotide
ccauacauaucccaaauaguuuuugcc

SEQ ID NO: 7490 - RNA, 27 nt, Artificial Sequence
  Synthetic oligonucleotide
uuacccuacccauacauaucccaaacc

SEQ ID NO: 7491 - RNA, 27 nt, Artificial Sequence
  Synthetic oligonucleotide
uuuacccuacccauacauaucccaacc

SEQ ID NO: 7492 - RNA, 27 nt, Artificial Sequence
  Synthetic oligonucleotide
auuuacccuacccauacauaucccacc

SEQ ID NO: 7493 - RNA, 27 nt, Artificial Sequence
  Synthetic oligonucleotide
acaccucuuacugauuuacccuaccac

SEQ ID NO: 7494 - RNA, 27 nt, Artificial Sequence
  Synthetic oligonucleotide
uaacaccucuuacugauuuacccuaaa

SEQ ID NO: 7495 - RNA, 27 nt, Artificial Sequence
  Synthetic oligonucleotide
auaacaccucuuacugauuuacccuca

SEQ ID NO: 7496 - RNA, 27 nt, Artificial Sequence
  Synthetic oligonucleotide
aauaacaccucuuacugauuuaccccc

SEQ ID NO: 7497 - RNA, 27 nt, Artificial Sequence
  Synthetic oligonucleotide
aaauaacaccucuuacugauuuaccac

SEQ ID NO: 7498 - RNA, 27 nt, Artificial Sequence
  Synthetic oligonucleotide
caaauaacaccucuuacugauuuacaa

SEQ ID NO: 7499 - RNA, 27 nt, Artificial Sequence
  Synthetic oligonucleotide
agguuccaaauaacaccucuuacugcc

SEQ ID NO: 7500 - RNA, 27 nt, Artificial Sequence
  Synthetic oligonucleotide
aaaacaagguuccaaauaacaccuccc

SEQ ID NO: 7501 - RNA, 27 nt, Artificial Sequence
  Synthetic oligonucleotide
caaaacaagguuccaaauaacaccuac

SEQ ID NO: 7502 - RNA, 27 nt, Artificial Sequence
  Synthetic oligonucleotide
ccaaaacaagguuccaaauaacaccca

SEQ ID NO: 7503 - RNA, 27 nt, Artificial Sequence
  Synthetic oligonucleotide
acuguccaaaacaagguuccaaauaca

SEQ ID NO: 7504 - RNA, 27 nt, Artificial Sequence
  Synthetic oligonucleotide
guaaacuguccaaaacaagguuccacc

SEQ ID NO: 7505 - RNA, 27 nt, Artificial Sequence
  Synthetic oligonucleotide
gguaaacuguccaaaacaagguucccc

SEQ ID NO: 7506 - RNA, 27 nt, Artificial Sequence
  Synthetic oligonucleotide
aggcaacugguaaacuguccaaaaccc

SEQ ID NO: 7507 - RNA, 27 nt, Artificial Sequence
  Synthetic oligonucleotide
gggauaaaaggcaacugguaaacugca

SEQ ID NO: 7508 - RNA, 27 nt, Artificial Sequence
  Synthetic oligonucleotide
ugggauaaaaggcaacugguaaacuac

SEQ ID NO: 7509 - RNA, 27 nt, Artificial Sequence
  Synthetic oligonucleotide
acaacuuugggauaaaaggcaacugac

SEQ ID NO: 7510 - RNA, 27 nt, Artificial Sequence
  Synthetic oligonucleotide
caacaacuuugggauaaaaggcaacca

SEQ ID NO: 7511 - RNA, 27 nt, Artificial Sequence
  Synthetic oligonucleotide
gguuacaacaacuuugggauaaaagaa

SEQ ID NO: 7512 - RNA, 27 nt, Artificial Sequence
  Synthetic oligonucleotide
agguuacaacaacuuugggauaaaaaa

SEQ ID NO: 7513 - RNA, 27 nt, Artificial Sequence
  Synthetic oligonucleotide
cagguuacaacaacuuugggauaaaca

SEQ ID NO: 7514 - RNA, 27 nt, Artificial Sequence
  Synthetic oligonucleotide
uaucacagcagguuacaacaacuuuaa

SEQ ID NO: 7515 - RNA, 27 nt, Artificial Sequence
  Synthetic oligonucleotide
guaucacagcagguuacaacaacuuca

SEQ ID NO: 7516 - RNA, 27 nt, Artificial Sequence
  Synthetic oligonucleotide
ucguaucacagcagguuacaacaaccc

SEQ ID NO: 7517 - RNA, 27 nt, Artificial Sequence
  Synthetic oligonucleotide
uuucucuugaagcaucguaucacagac

SEQ ID NO: 7518 - RNA, 27 nt, Artificial Sequence
  Synthetic oligonucleotide
uuuucucuugaagcaucguaucacaaa

SEQ ID NO: 7519 - RNA, 27 nt, Artificial Sequence
  Synthetic oligonucleotide
cauuuucucuugaagcaucguaucaac

SEQ ID NO: 7520 - RNA, 27 nt, Artificial Sequence
  Synthetic oligonucleotide
uuuuuuauaaccgcauuuucucuugcc

SEQ ID NO: 7521 - RNA, 27 nt, Artificial Sequence
  Synthetic oligonucleotide
auuuuuuauaaccgcauuuucucuuac

SEQ ID NO: 7522 - RNA, 27 nt, Artificial Sequence
  Synthetic oligonucleotide
cauuuuuuauaaccgcauuuucucuca

SEQ ID NO: 7523 - RNA, 27 nt, Artificial Sequence
  Synthetic oligonucleotide
ccauuuuuuauaaccgcauuuucuccc

SEQ ID NO: 7524 - RNA, 27 nt, Artificial Sequence
  Synthetic oligonucleotide
cugaaccauuuuuuauaaccgcauucc

SEQ ID NO: 7525 - RNA, 27 nt, Artificial Sequence
  Synthetic oligonucleotide
uaauucugaaccauuuuuuauaaccaa

SEQ ID NO: 7526 - RNA, 27 nt, Artificial Sequence
  Synthetic oligonucleotide
uuaauucugaaccauuuuuuauaacaa

SEQ ID NO: 7527 - RNA, 27 nt, Artificial Sequence
  Synthetic oligonucleotide
uuuaauucugaaccauuuuuuauaaaa

SEQ ID NO: 7528 - RNA, 27 nt, Artificial Sequence
  Synthetic oligonucleotide
guuuaauucugaaccauuuuuuauaca

SEQ ID NO: 7529 - RNA, 27 nt, Artificial Sequence
  Synthetic oligonucleotide
aguuuaauucugaaccauuuuuuaucc

SEQ ID NO: 7530 - RNA, 27 nt, Artificial Sequence
  Synthetic oligonucleotide
aaguuuaauucugaaccauuuuuuacc

SEQ ID NO: 7531 - RNA, 27 nt, Artificial Sequence
  Synthetic oligonucleotide
auuaaaaguuuaauucugaaccauucc

SEQ ID NO: 7532 - RNA, 27 nt, Artificial Sequence
  Synthetic oligonucleotide
aauuaaaaguuuaauucugaaccaucc

SEQ ID NO: 7533 - RNA, 27 nt, Artificial Sequence
  Synthetic oligonucleotide
ugaauuaaaaguuuaauucugaacccc

SEQ ID NO: 7534 - RNA, 27 nt, Artificial Sequence
  Synthetic oligonucleotide
caauacagcuaaaggaugauuuacagg

SEQ ID NO: 7535 - RNA, 27 nt, Artificial Sequence
  Synthetic oligonucleotide
acaauacagcuaaaggaugauuuacag

SEQ ID NO: 7536 - RNA, 27 nt, Artificial Sequence
  Synthetic oligonucleotide
agacaauacagcuaaaggaugauuuac

SEQ ID NO: 7537 - RNA, 27 nt, Artificial Sequence
  Synthetic oligonucleotide
guuacuccuaaaggaugauuuacaggu

SEQ ID NO: 7538 - RNA, 27 nt, Artificial Sequence
  Synthetic oligonucleotide
uguuacuccuaaaggaugauuuacagg

SEQ ID NO: 7539 - RNA, 27 nt, Artificial Sequence
  Synthetic oligonucleotide
uuguuacuccuaaaggaugauuuacag

SEQ ID NO: 7540 - RNA, 27 nt, Artificial Sequence
  Synthetic oligonucleotide
auuguuacuccuaaaggaugauuuaca

SEQ ID NO: 7541 - RNA, 27 nt, Artificial Sequence
  Synthetic oligonucleotide
ggauuccagaauccaaguaagacugcu

SEQ ID NO: 7542 - RNA, 27 nt, Artificial Sequence
  Synthetic oligonucleotide
cuugcucccauucauaaaggacuuggg

SEQ ID NO: 7543 - RNA, 27 nt, Artificial Sequence
  Synthetic oligonucleotide
cgucaauaucagcuacuugcucuugcg

SEQ ID NO: 7544 - RNA, 27 nt, Artificial Sequence
  Synthetic oligonucleotide
ccgucaauaucagcuacuugcucuugc

SEQ ID NO: 7545 - RNA, 27 nt, Artificial Sequence
  Synthetic oligonucleotide
acugcccgucaauaucagcuacuugcu

SEQ ID NO: 7546 - RNA, 27 nt, Artificial Sequence
  Synthetic oligonucleotide
uguuucaacaucugugaugguucagcc

SEQ ID NO: 7547 - RNA, 27 nt, Artificial Sequence
  Synthetic oligonucleotide
auguuucaacaucugugaugguucagc

SEQ ID NO: 7548 - RNA, 27 nt, Artificial Sequence
  Synthetic oligonucleotide
ugacaacugcauguuucaacaucugug

SEQ ID NO: 7549 - RNA, 27 nt, Artificial Sequence
  Synthetic oligonucleotide
auugacaacugcauguuucaacaucug

SEQ ID NO: 7550 - RNA, 27 nt, Artificial Sequence
  Synthetic oligonucleotide
ucaaauugacaacugcauguuucaaca

SEQ ID NO: 7551 - RNA, 27 nt, Artificial Sequence
  Synthetic oligonucleotide
aguuaaucaaauugacaacugcauguu

SEQ ID NO: 7552 - RNA, 27 nt, Artificial Sequence
  Synthetic oligonucleotide
ccugauaguuaaucaaauugacaacug

SEQ ID NO: 7553 - RNA, 27 nt, Artificial Sequence
  Synthetic oligonucleotide
cgucauccugauaguuaaucaaauuga

SEQ ID NO: 7554 - RNA, 27 nt, Artificial Sequence
  Synthetic oligonucleotide
gcgucauccugauaguuaaucaaauug

SEQ ID NO: 7555 - RNA, 27 nt, Artificial Sequence
  Synthetic oligonucleotide
ccucaucguuuagcaguuuugucagcu

SEQ ID NO: 7556 - RNA, 27 nt, Artificial Sequence
  Synthetic oligonucleotide
cugguccucaucguuuagcaguuuugu

SEQ ID NO: 7557 - RNA, 27 nt, Artificial Sequence
  Synthetic oligonucleotide
cauaacagcagcuuuauuaacuaccac

SEQ ID NO: 7558 - RNA, 27 nt, Artificial Sequence
  Synthetic oligonucleotide
ccauaacagcagcuuuauuaacuacca

SEQ ID NO: 7559 - RNA, 27 nt, Artificial Sequence
  Synthetic oligonucleotide
ggaccauaacagcagcuuuauuaacua

SEQ ID NO: 7560 - RNA, 27 nt, Artificial Sequence
  Synthetic oligonucleotide
uggaccauaacagcagcuuuauuaacu

SEQ ID NO: 7561 - RNA, 27 nt, Artificial Sequence
  Synthetic oligonucleotide
cugucucuacaucauuuguauucugca

SEQ ID NO: 7562 - RNA, 27 nt, Artificial Sequence
  Synthetic oligonucleotide
gcugucucuacaucauuuguauucugc

SEQ ID NO: 7563 - RNA, 27 nt, Artificial Sequence
  Synthetic oligonucleotide
gcaaccauuuucugcaguccaccagcu

SEQ ID NO: 7564 - RNA, 27 nt, Artificial Sequence
  Synthetic oligonucleotide
aagcaaccauuuucugcaguccaccag

SEQ ID NO: 7565 - RNA, 27 nt, Artificial Sequence
  Synthetic oligonucleotide
uuguuuuguugagcaaagcaaccauuu

SEQ ID NO: 7566 - RNA, 27 nt, Artificial Sequence
  Synthetic oligonucleotide
uuuguuuuguugagcaaagcaaccauu

SEQ ID NO: 7567 - RNA, 27 nt, Artificial Sequence
  Synthetic oligonucleotide
uagccaagaauuucacguuuguuuugu

SEQ ID NO: 7568 - RNA, 27 nt, Artificial Sequence
  Synthetic oligonucleotide
cuugauugccauaagcuaagaucugaa

SEQ ID NO: 7569 - RNA, 27 nt, Artificial Sequence
  Synthetic oligonucleotide
gcucucuugauugccauaagcuaagau

SEQ ID NO: 7570 - RNA, 27 nt, Artificial Sequence
  Synthetic oligonucleotide
cuucucauaaguguagguccucauuau

SEQ ID NO: 7571 - RNA, 27 nt, Artificial Sequence
  Synthetic oligonucleotide
gcuucucauaaguguagguccucauua

SEQ ID NO: 7572 - RNA, 27 nt, Artificial Sequence
  Synthetic oligonucleotide
aagcuucucauaaguguagguccucau

SEQ ID NO: 7573 - RNA, 27 nt, Artificial Sequence
  Synthetic oligonucleotide
gaagcuucucauaaguguagguccuca

SEQ ID NO: 7574 - RNA, 27 nt, Artificial Sequence
  Synthetic oligonucleotide
gaguccaaagacaguuuugaacaaguc

SEQ ID NO: 7575 - RNA, 27 nt, Artificial Sequence
  Synthetic oligonucleotide
agaguccaaagacaguuuugaacaagu

SEQ ID NO: 7576 - RNA, 27 nt, Artificial Sequence
  Synthetic oligonucleotide
ccacauuuauaucaucggaacccagaa

SEQ ID NO: 7577 - RNA, 27 nt, Artificial Sequence
  Synthetic oligonucleotide
ugaccacauuuauaucaucggaaccca

SEQ ID NO: 7578 - RNA, 27 nt, Artificial Sequence
  Synthetic oligonucleotide
cugcacaggugaccacauuuauaucau

SEQ ID NO: 7579 - RNA, 27 nt, Artificial Sequence
  Synthetic oligonucleotide
gcugcacaggugaccacauuuauauca

SEQ ID NO: 7580 - RNA, 27 nt, Artificial Sequence
  Synthetic oligonucleotide
uuguaauuauugcaagugagguuagag

SEQ ID NO: 7581 - RNA, 27 nt, Artificial Sequence
  Synthetic oligonucleotide
caucaucuuguuuuuguaauuauugca

SEQ ID NO: 7582 - RNA, 27 nt, Artificial Sequence
  Synthetic oligonucleotide
ccaucaucuuguuuuuguaauuauugc

SEQ ID NO: 7583 - RNA, 27 nt, Artificial Sequence
  Synthetic oligonucleotide
acaccaucaucuuguuuuuguaauuau

SEQ ID NO: 7584 - RNA, 27 nt, Artificial Sequence
  Synthetic oligonucleotide
uuggcacaccaucaucuuguuuuugua

SEQ ID NO: 7585 - RNA, 27 nt, Artificial Sequence
  Synthetic oligonucleotide
ucaauccaacaguugccuuuaucagag

SEQ ID NO: 7586 - RNA, 27 nt, Artificial Sequence
  Synthetic oligonucleotide
ucgaaucaauccaacaguugccuuuau

SEQ ID NO: 7587 - RNA, 27 nt, Artificial Sequence
  Synthetic oligonucleotide
gcugaacuagucguggaauagcacccu

SEQ ID NO: 7588 - RNA, 27 nt, Artificial Sequence
  Synthetic oligonucleotide
aguacacccuucuacuaucuccuccau

SEQ ID NO: 7589 - RNA, 27 nt, Artificial Sequence
  Synthetic oligonucleotide
caguacacccuucuacuaucuccucca

SEQ ID NO: 7590 - RNA, 27 nt, Artificial Sequence
  Synthetic oligonucleotide
ccaguacacccuucuacuaucuccucc

SEQ ID NO: 7591 - RNA, 27 nt, Artificial Sequence
  Synthetic oligonucleotide
gagcuccaguacacccuucuacuaucu

SEQ ID NO: 7592 - RNA, 27 nt, Artificial Sequence
  Synthetic oligonucleotide
aaacaauggaaugguauugaguccucg

SEQ ID NO: 7593 - RNA, 27 nt, Artificial Sequence
  Synthetic oligonucleotide
cugcacaaacaauggaaugguauugag

SEQ ID NO: 7594 - RNA, 27 nt, Artificial Sequence
  Synthetic oligonucleotide
acugcacaaacaauggaaugguauuga

SEQ ID NO: 7595 - RNA, 27 nt, Artificial Sequence
  Synthetic oligonucleotide
aagcaacugcacaaacaauggaauggu

SEQ ID NO: 7596 - RNA, 27 nt, Artificial Sequence
  Synthetic oligonucleotide
gagaauaaagcaacugcacaaacaaug

SEQ ID NO: 7597 - RNA, 27 nt, Artificial Sequence
  Synthetic oligonucleotide
uuucaaugggagaauaaagcaacugca

SEQ ID NO: 7598 - RNA, 27 nt, Artificial Sequence
  Synthetic oligonucleotide
uuuucaaugggagaauaaagcaacugc

SEQ ID NO: 7599 - RNA, 27 nt, Artificial Sequence
  Synthetic oligonucleotide
auuuucaaugggagaauaaagcaacug

SEQ ID NO: 7600 - RNA, 27 nt, Artificial Sequence
  Synthetic oligonucleotide
ggauauuuucaaugggagaauaaagca

SEQ ID NO: 7601 - RNA, 27 nt, Artificial Sequence
  Synthetic oligonucleotide
uggauauuuucaaugggagaauaaagc

SEQ ID NO: 7602 - RNA, 27 nt, Artificial Sequence
  Synthetic oligonucleotide
uuggauauuuucaaugggagaauaaag

SEQ ID NO: 7603 - RNA, 27 nt, Artificial Sequence
  Synthetic oligonucleotide
cagcuacucuuuggauauuuucaaugg

SEQ ID NO: 7604 - RNA, 27 nt, Artificial Sequence
  Synthetic oligonucleotide
gcagcuacucuuuggauauuuucaaug

SEQ ID NO: 7605 - RNA, 27 nt, Artificial Sequence
  Synthetic oligonucleotide
ccgcuucuuguaauccuguggcuuguc

SEQ ID NO: 7606 - RNA, 27 nt, Artificial Sequence
  Synthetic oligonucleotide
ccaguccaagaucugcagucucauucc

SEQ ID NO: 7607 - RNA, 27 nt, Artificial Sequence
  Synthetic oligonucleotide
cguauccaccagagugaaaagaacggu

SEQ ID NO: 7608 - RNA, 27 nt, Artificial Sequence
  Synthetic oligonucleotide
caggccagcugauugcuaucaccuggg

SEQ ID NO: 7609 - RNA, 27 nt, Artificial Sequence
  Synthetic oligonucleotide
cgauuuacaggucaguaucaaaccagg

SEQ ID NO: 7610 - RNA, 27 nt, Artificial Sequence
  Synthetic oligonucleotide
acgauuuacaggucaguaucaaaccag

SEQ ID NO: 7611 - RNA, 27 nt, Artificial Sequence
  Synthetic oligonucleotide
uuucuuaccuaaaggacgauuuacagg

SEQ ID NO: 7612 - RNA, 27 nt, Artificial Sequence
  Synthetic oligonucleotide
gcuuucuuaccuaaaggacgauuuaca

SEQ ID NO: 7613 - RNA, 27 nt, Artificial Sequence
  Synthetic oligonucleotide
cuuuuauaagcuuucuuaccuaaagga

SEQ ID NO: 7614 - RNA, 27 nt, Artificial Sequence
  Synthetic oligonucleotide
gcuuuuauaagcuuucuuaccuaaagg

SEQ ID NO: 7615 - RNA, 27 nt, Artificial Sequence
  Synthetic oligonucleotide
cuggcuuuuauaagcuuucuuaccuaa

SEQ ID NO: 7616 - RNA, 27 nt, Artificial Sequence
  Synthetic oligonucleotide
ccacacuggcuuuuauaagcuuucuua

SEQ ID NO: 7617 - RNA, 27 nt, Artificial Sequence
  Synthetic oligonucleotide
auucacccacacuggcuuuuauaagcu

SEQ ID NO: 7618 - RNA, 27 nt, Artificial Sequence
  Synthetic oligonucleotide
ccuaccaagucuuucuggaguucugca

SEQ ID NO: 7619 - RNA, 27 nt, Artificial Sequence
  Synthetic oligonucleotide
auuuacaaacaggccuaaaaccauucc

SEQ ID NO: 7620 - RNA, 27 nt, Artificial Sequence
  Synthetic oligonucleotide
gauuuacaaacaggccuaaaaccauuc

SEQ ID NO: 7621 - RNA, 27 nt, Artificial Sequence
  Synthetic oligonucleotide
agauuuacaaacaggccuaaaaccauu

SEQ ID NO: 7622 - RNA, 27 nt, Artificial Sequence
  Synthetic oligonucleotide
caucuccuuccaagguauguaucuguu

SEQ ID NO: 7623 - RNA, 27 nt, Artificial Sequence
  Synthetic oligonucleotide
acaucuccuuccaagguauguaucugu

SEQ ID NO: 7624 - RNA, 27 nt, Artificial Sequence
  Synthetic oligonucleotide
acuuccacacaugaacaucuccuucca

SEQ ID NO: 7625 - RNA, 27 nt, Artificial Sequence
  Synthetic oligonucleotide
gaaacuuccacacaugaacaucuccuu

SEQ ID NO: 7626 - RNA, 27 nt, Artificial Sequence
  Synthetic oligonucleotide
agaaacuuccacacaugaacaucuccu

SEQ ID NO: 7627 - RNA, 27 nt, Artificial Sequence
  Synthetic oligonucleotide
gagaaacuuccacacaugaacaucucc

SEQ ID NO: 7628 - RNA, 27 nt, Artificial Sequence
  Synthetic oligonucleotide
ugagaaacuuccacacaugaacaucuc

SEQ ID NO: 7629 - RNA, 27 nt, Artificial Sequence
  Synthetic oligonucleotide
caucaacgugagaaacuuccacacaug

SEQ ID NO: 7630 - RNA, 27 nt, Artificial Sequence
  Synthetic oligonucleotide
aaacaucaacgugagaaacuuccacac

SEQ ID NO: 7631 - RNA, 27 nt, Artificial Sequence
  Synthetic oligonucleotide
aaaacaucaacgugagaaacuuccaca

SEQ ID NO: 7632 - RNA, 27 nt, Artificial Sequence
  Synthetic oligonucleotide
aaaaacaucaacgugagaaacuuccac

SEQ ID NO: 7633 - RNA, 27 nt, Artificial Sequence
  Synthetic oligonucleotide
caaaaacaucaacgugagaaacuucca

SEQ ID NO: 7634 - RNA, 27 nt, Artificial Sequence
  Synthetic oligonucleotide
gcaaaaacaucaacgugagaaacuucc

SEQ ID NO: 7635 - RNA, 27 nt, Artificial Sequence
  Synthetic oligonucleotide
uggcaaaaacaucaacgugagaaacuu

SEQ ID NO: 7636 - RNA, 27 nt, Artificial Sequence
  Synthetic oligonucleotide
cugcaaaagcuguggcaaaaacaucaa

SEQ ID NO: 7637 - RNA, 27 nt, Artificial Sequence
  Synthetic oligonucleotide
gcugcaaaagcuguggcaaaaacauca

SEQ ID NO: 7638 - RNA, 27 nt, Artificial Sequence
  Synthetic oligonucleotide
acucaucugaguauaacgcugcaaaag

SEQ ID NO: 7639 - RNA, 27 nt, Artificial Sequence
  Synthetic oligonucleotide
ugaaaacagcaaauguuacucaucuga

SEQ ID NO: 7640 - RNA, 27 nt, Artificial Sequence
  Synthetic oligonucleotide
uugaaaacagcaaauguuacucaucug

SEQ ID NO: 7641 - RNA, 27 nt, Artificial Sequence
  Synthetic oligonucleotide
guugaaaacagcaaauguuacucaucu

SEQ ID NO: 7642 - RNA, 27 nt, Artificial Sequence
  Synthetic oligonucleotide
cuauuaauguugaaaacagcaaauguu

SEQ ID NO: 7643 - RNA, 27 nt, Artificial Sequence
  Synthetic oligonucleotide
acacuacagcuguauagagagaaaggc

SEQ ID NO: 7644 - RNA, 27 nt, Artificial Sequence
  Synthetic oligonucleotide
caggccaaucacaaugcacguucagac

SEQ ID NO: 7645 - RNA, 27 nt, Artificial Sequence
  Synthetic oligonucleotide
cuguucccauaggaaacucagcuuggu

SEQ ID NO: 7646 - RNA, 27 nt, Artificial Sequence
  Synthetic oligonucleotide
cagaacaaaaagcguacuucgacuguu

SEQ ID NO: 7647 - RNA, 27 nt, Artificial Sequence
  Synthetic oligonucleotide
aaggaccagaacaaaaagcguacuucg

SEQ ID NO: 7648 - RNA, 27 nt, Artificial Sequence
  Synthetic oligonucleotide
cgaccaaaaaggaccagaacaaaaagc

SEQ ID NO: 7649 - RNA, 27 nt, Artificial Sequence
  Synthetic oligonucleotide
ucgaccaaaaaggaccagaacaaaaag

SEQ ID NO: 7650 - RNA, 27 nt, Artificial Sequence
  Synthetic oligonucleotide
uuacuccucgaccaaaaaggaccagaa

SEQ ID NO: 7651 - RNA, 27 nt, Artificial Sequence
  Synthetic oligonucleotide
aauccauuuguauuguuacuccucgac

SEQ ID NO: 7652 - RNA, 27 nt, Artificial Sequence
  Synthetic oligonucleotide
aaauccauuuguauuguuacuccucga

SEQ ID NO: 7653 - RNA, 27 nt, Artificial Sequence
  Synthetic oligonucleotide
caaauccauuuguauuguuacuccucg

SEQ ID NO: 7654 - RNA, 27 nt, Artificial Sequence
  Synthetic oligonucleotide
ccaaauccauuuguauuguuacuccuc

SEQ ID NO: 7655 - RNA, 27 nt, Artificial Sequence
  Synthetic oligonucleotide
ucacuccccaaauccauuuguauuguu

SEQ ID NO: 7656 - RNA, 27 nt, Artificial Sequence
  Synthetic oligonucleotide
gauccauucgugugcauucuucacugc

SEQ ID NO: 7657 - RNA, 27 nt, Artificial Sequence
  Synthetic oligonucleotide
ugauccauucgugugcauucuucacug

SEQ ID NO: 7658 - RNA, 27 nt, Artificial Sequence
  Synthetic oligonucleotide
gugauccauucgugugcauucuucacu

SEQ ID NO: 7659 - RNA, 27 nt, Artificial Sequence
  Synthetic oligonucleotide
uaaaacaaagaacaagcaaggcuaggg

SEQ ID NO: 7660 - RNA, 27 nt, Artificial Sequence
  Synthetic oligonucleotide
gcaccacuacagauauuaaaacaaaga

SEQ ID NO: 7661 - RNA, 27 nt, Artificial Sequence
  Synthetic oligonucleotide
cagcaccacuacagauauuaaaacaaa

SEQ ID NO: 7662 - RNA, 27 nt, Artificial Sequence
  Synthetic oligonucleotide
ucagcaccacuacagauauuaaaacaa

SEQ ID NO: 7663 - RNA, 27 nt, Artificial Sequence
  Synthetic oligonucleotide
aaaaaauaaaagcaagcaaagucagca

SEQ ID NO: 7664 - RNA, 27 nt, Artificial Sequence
  Synthetic oligonucleotide
cugcaaaaaauaaaagcaagcaaaguc

SEQ ID NO: 7665 - RNA, 27 nt, Artificial Sequence
  Synthetic oligonucleotide
aguuacugcaaaaaauaaaagcaagca

SEQ ID NO: 7666 - RNA, 27 nt, Artificial Sequence
  Synthetic oligonucleotide
acuaacaguuacugcaaaaaauaaaag

SEQ ID NO: 7667 - RNA, 27 nt, Artificial Sequence
  Synthetic oligonucleotide
aaacuaacaguuacugcaaaaaauaaa

SEQ ID NO: 7668 - RNA, 27 nt, Artificial Sequence
  Synthetic oligonucleotide
aaaaacuaacaguuacugcaaaaaaua

SEQ ID NO: 7669 - RNA, 27 nt, Artificial Sequence
  Synthetic oligonucleotide
uaaaaacuaacaguuacugcaaaaaau

SEQ ID NO: 7670 - RNA, 27 nt, Artificial Sequence
  Synthetic oligonucleotide
cuuaaaaacuaacaguuacugcaaaaa

SEQ ID NO: 7671 - RNA, 27 nt, Artificial Sequence
  Synthetic oligonucleotide
acuacuuaaaaacuaacaguuacugca

SEQ ID NO: 7672 - RNA, 27 nt, Artificial Sequence
  Synthetic oligonucleotide
acacuacuuaaaaacuaacaguuacug

SEQ ID NO: 7673 - RNA, 27 nt, Artificial Sequence
  Synthetic oligonucleotide
cauaacacuacuuaaaaacuaacaguu

SEQ ID NO: 7674 - RNA, 27 nt, Artificial Sequence
  Synthetic oligonucleotide
acauaacacuacuuaaaaacuaacagu

SEQ ID NO: 7675 - RNA, 27 nt, Artificial Sequence
  Synthetic oligonucleotide
gaacauaacacuacuuaaaaacuaaca

SEQ ID NO: 7676 - RNA, 27 nt, Artificial Sequence
  Synthetic oligonucleotide
agaacauaacacuacuuaaaaacuaac

SEQ ID NO: 7677 - RNA, 27 nt, Artificial Sequence
  Synthetic oligonucleotide
uagaacauaacacuacuuaaaaacuaa

SEQ ID NO: 7678 - RNA, 27 nt, Artificial Sequence
  Synthetic oligonucleotide
cuagaacauaacacuacuuaaaaacua

SEQ ID NO: 7679 - RNA, 27 nt, Artificial Sequence
  Synthetic oligonucleotide
guucacuagaacauaacacuacuuaaa

SEQ ID NO: 7680 - RNA, 27 nt, Artificial Sequence
  Synthetic oligonucleotide
agguucacuagaacauaacacuacuua

SEQ ID NO: 7681 - RNA, 27 nt, Artificial Sequence
  Synthetic oligonucleotide
cagguucacuagaacauaacacuacuu

SEQ ID NO: 7682 - RNA, 27 nt, Artificial Sequence
  Synthetic oligonucleotide
ccauuacucgguucuuagaaaucagaa

SEQ ID NO: 7683 - RNA, 27 nt, Artificial Sequence
  Synthetic oligonucleotide
acaccauuacucgguucuuagaaauca

SEQ ID NO: 7684 - RNA, 27 nt, Artificial Sequence
  Synthetic oligonucleotide
guucuacaccauuacucgguucuuaga

SEQ ID NO: 7685 - RNA, 27 nt, Artificial Sequence
  Synthetic oligonucleotide
augaauuaguguucuacaccauuacuc

SEQ ID NO: 7686 - RNA, 27 nt, Artificial Sequence
  Synthetic oligonucleotide
ugauuaugaauuaguguucuacaccau

SEQ ID NO: 7687 - RNA, 27 nt, Artificial Sequence
  Synthetic oligonucleotide
gugauuaugaauuaguguucuacacca

SEQ ID NO: 7688 - RNA, 27 nt, Artificial Sequence
  Synthetic oligonucleotide
cgugauuaugaauuaguguucuacacc

SEQ ID NO: 7689 - RNA, 27 nt, Artificial Sequence
  Synthetic oligonucleotide
uuacaauuagcgugauuaugaauuagu

SEQ ID NO: 7690 - RNA, 27 nt, Artificial Sequence
  Synthetic oligonucleotide
auuacaauuagcgugauuaugaauuag

SEQ ID NO: 7691 - RNA, 27 nt, Artificial Sequence
  Synthetic oligonucleotide
ccagauuacaauuagcgugauuaugaa

SEQ ID NO: 7692 - RNA, 27 nt, Artificial Sequence
  Synthetic oligonucleotide
guuacacgucuccagauuacaauuagc

SEQ ID NO: 7693 - RNA, 27 nt, Artificial Sequence
  Synthetic oligonucleotide
auguuacacgucuccagauuacaauua

SEQ ID NO: 7694 - RNA, 27 nt, Artificial Sequence
  Synthetic oligonucleotide
gcuacacaauguuacacgucuccagau

SEQ ID NO: 7695 - RNA, 27 nt, Artificial Sequence
  Synthetic oligonucleotide
aggcuacacaauguuacacgucuccag

SEQ ID NO: 7696 - RNA, 27 nt, Artificial Sequence
  Synthetic oligonucleotide
auacaaaaggcuacacaauguuacacg

SEQ ID NO: 7697 - RNA, 27 nt, Artificial Sequence
  Synthetic oligonucleotide
uauacaaaaggcuacacaauguuacac

SEQ ID NO: 7698 - RNA, 27 nt, Artificial Sequence
  Synthetic oligonucleotide
uauuuauacaaaaggcuacacaauguu

SEQ ID NO: 7699 - RNA, 27 nt, Artificial Sequence
  Synthetic oligonucleotide
cuauuuauacaaaaggcuacacaaugu

SEQ ID NO: 7700 - RNA, 27 nt, Artificial Sequence
  Synthetic oligonucleotide
ugucuauuuauacaaaaggcuacacaa

SEQ ID NO: 7701 - RNA, 27 nt, Artificial Sequence
  Synthetic oligonucleotide
cugucuauuuauacaaaaggcuacaca

SEQ ID NO: 7702 - RNA, 27 nt, Artificial Sequence
  Synthetic oligonucleotide
ucugucuauuuauacaaaaggcuacac

SEQ ID NO: 7703 - RNA, 27 nt, Artificial Sequence
  Synthetic oligonucleotide
uuucuaucugucuauuuauacaaaagg

SEQ ID NO: 7704 - RNA, 27 nt, Artificial Sequence
  Synthetic oligonucleotide
auuucuaucugucuauuuauacaaaag

SEQ ID NO: 7705 - RNA, 27 nt, Artificial Sequence
  Synthetic oligonucleotide
cauuucuaucugucuauuuauacaaaa

SEQ ID NO: 7706 - RNA, 27 nt, Artificial Sequence
  Synthetic oligonucleotide
ccauuucuaucugucuauuuauacaaa

SEQ ID NO: 7707 - RNA, 27 nt, Artificial Sequence
  Synthetic oligonucleotide
cggaccauuucuaucugucuauuuaua

SEQ ID NO: 7708 - RNA, 27 nt, Artificial Sequence
  Synthetic oligonucleotide
ucggaccauuucuaucugucuauuuau

SEQ ID NO: 7709 - RNA, 27 nt, Artificial Sequence
  Synthetic oligonucleotide
aaacuaaucggaccauuucuaucuguc

SEQ ID NO: 7710 - RNA, 27 nt, Artificial Sequence
  Synthetic oligonucleotide
gaaacuaaucggaccauuucuaucugu

SEQ ID NO: 7711 - RNA, 27 nt, Artificial Sequence
  Synthetic oligonucleotide
ggaaacuaaucggaccauuucuaucug

SEQ ID NO: 7712 - RNA, 27 nt, Artificial Sequence
  Synthetic oligonucleotide
aggaaacuaaucggaccauuucuaucu

SEQ ID NO: 7713 - RNA, 27 nt, Artificial Sequence
  Synthetic oligonucleotide
auuaaaaaggaaacuaaucggaccauu

SEQ ID NO: 7714 - RNA, 27 nt, Artificial Sequence
  Synthetic oligonucleotide
aagcauauuaaaaaggaaacuaaucgg

SEQ ID NO: 7715 - RNA, 27 nt, Artificial Sequence
  Synthetic oligonucleotide
uaagcauauuaaaaaggaaacuaaucg

SEQ ID NO: 7716 - RNA, 27 nt, Artificial Sequence
  Synthetic oligonucleotide
auuuuaagcauauuaaaaaggaaacua

SEQ ID NO: 7717 - RNA, 27 nt, Artificial Sequence
  Synthetic oligonucleotide
cugcuuauuuuaagcauauuaaaaagg

SEQ ID NO: 7718 - RNA, 27 nt, Artificial Sequence
  Synthetic oligonucleotide
ccugcuuauuuuaagcauauuaaaaag

SEQ ID NO: 7719 - RNA, 27 nt, Artificial Sequence
  Synthetic oligonucleotide
gauccaccugcuuauuuuaagcauauu

SEQ ID NO: 7720 - RNA, 27 nt, Artificial Sequence
  Synthetic oligonucleotide
caaaaacaugaaauagauccaccugcu

SEQ ID NO: 7721 - RNA, 27 nt, Artificial Sequence
  Synthetic oligonucleotide
ucaaaaacaugaaauagauccaccugc

SEQ ID NO: 7722 - RNA, 27 nt, Artificial Sequence
  Synthetic oligonucleotide
guucaaaaacaugaaauagauccaccu

SEQ ID NO: 7723 - RNA, 27 nt, Artificial Sequence
  Synthetic oligonucleotide
uguucaaaaacaugaaauagauccacc

SEQ ID NO: 7724 - RNA, 27 nt, Artificial Sequence
  Synthetic oligonucleotide
uuguucaaaaacaugaaauagauccac

SEQ ID NO: 7725 - RNA, 27 nt, Artificial Sequence
  Synthetic oligonucleotide
aguuuuuguucaaaaacaugaaauaga

SEQ ID NO: 7726 - RNA, 27 nt, Artificial Sequence
  Synthetic oligonucleotide
cgauaaaguuuuuguucaaaaacauga

SEQ ID NO: 7727 - RNA, 27 nt, Artificial Sequence
  Synthetic oligonucleotide
uauccccgauaaaguuuuuguucaaaa

SEQ ID NO: 7728 - RNA, 27 nt, Artificial Sequence
  Synthetic oligonucleotide
guauccccgauaaaguuuuuguucaaa

SEQ ID NO: 7729 - RNA, 27 nt, Artificial Sequence
  Synthetic oligonucleotide
acaccucuuacugauuuacccuaccgc

SEQ ID NO: 7730 - RNA, 27 nt, Artificial Sequence
  Synthetic oligonucleotide
uaacaccucuuacugauuuacccuacc

SEQ ID NO: 7731 - RNA, 27 nt, Artificial Sequence
  Synthetic oligonucleotide
auaacaccucuuacugauuuacccuac

SEQ ID NO: 7732 - RNA, 27 nt, Artificial Sequence
  Synthetic oligonucleotide
aauaacaccucuuacugauuuacccua

SEQ ID NO: 7733 - RNA, 27 nt, Artificial Sequence
  Synthetic oligonucleotide
aaauaacaccucuuacugauuuacccu

SEQ ID NO: 7734 - RNA, 27 nt, Artificial Sequence
  Synthetic oligonucleotide
caaauaacaccucuuacugauuuaccc

SEQ ID NO: 7735 - RNA, 27 nt, Artificial Sequence
  Synthetic oligonucleotide
aaggcucaaauaacaccucuuacugau

SEQ ID NO: 7736 - RNA, 27 nt, Artificial Sequence
  Synthetic oligonucleotide
aaaacaaggcucaaauaacaccucuua

SEQ ID NO: 7737 - RNA, 27 nt, Artificial Sequence
  Synthetic oligonucleotide
caaaacaaggcucaaauaacaccucuu

SEQ ID NO: 7738 - RNA, 27 nt, Artificial Sequence
  Synthetic oligonucleotide
ccaaaacaaggcucaaauaacaccucu

SEQ ID NO: 7739 - RNA, 27 nt, Artificial Sequence
  Synthetic oligonucleotide
uguccaaaacaaggcucaaauaacacc

SEQ ID NO: 7740 - RNA, 27 nt, Artificial Sequence
  Synthetic oligonucleotide
acuguccaaaacaaggcucaaauaaca

SEQ ID NO: 7741 - RNA, 27 nt, Artificial Sequence
  Synthetic oligonucleotide
gguauacuguccaaaacaaggcucaaa

SEQ ID NO: 7742 - RNA, 27 nt, Artificial Sequence
  Synthetic oligonucleotide
aggcaacugguauacuguccaaaacaa

SEQ ID NO: 7743 - RNA, 27 nt, Artificial Sequence
  Synthetic oligonucleotide
gggauaaaaggcaacugguauacuguc

SEQ ID NO: 7744 - RNA, 27 nt, Artificial Sequence
  Synthetic oligonucleotide
ugggauaaaaggcaacugguauacugu

SEQ ID NO: 7745 - RNA, 27 nt, Artificial Sequence
  Synthetic oligonucleotide
acaacuuugggauaaaaggcaacuggu

SEQ ID NO: 7746 - RNA, 27 nt, Artificial Sequence
  Synthetic oligonucleotide
caacaacuuugggauaaaaggcaacug

SEQ ID NO: 7747 - RNA, 27 nt, Artificial Sequence
  Synthetic oligonucleotide
gguuacaacaacuuugggauaaaaggc

SEQ ID NO: 7748 - RNA, 27 nt, Artificial Sequence
  Synthetic oligonucleotide
agguuacaacaacuuugggauaaaagg

SEQ ID NO: 7749 - RNA, 27 nt, Artificial Sequence
  Synthetic oligonucleotide
cagguuacaacaacuuugggauaaaag

SEQ ID NO: 7750 - RNA, 27 nt, Artificial Sequence
  Synthetic oligonucleotide
uaucacagcagguuacaacaacuuugg

SEQ ID NO: 7751 - RNA, 27 nt, Artificial Sequence
  Synthetic oligonucleotide
guaucacagcagguuacaacaacuuug

SEQ ID NO: 7752 - RNA, 27 nt, Artificial Sequence
  Synthetic oligonucleotide
uuguaucacagcagguuacaacaacuu

SEQ ID NO: 7753 - RNA, 27 nt, Artificial Sequence
  Synthetic oligonucleotide
ccgcaucuguugaagcauuguaucaca

SEQ ID NO: 7754 - RNA, 27 nt, Artificial Sequence
  Synthetic oligonucleotide
ucugaaccauuucuauaaccgcaucug

SEQ ID NO: 7755 - RNA, 27 nt, Artificial Sequence
  Synthetic oligonucleotide
uaauucugaaccauuucuauaaccgca

SEQ ID NO: 7756 - RNA, 27 nt, Artificial Sequence
  Synthetic oligonucleotide
uuuaauucugaaccauuucuauaaccg

SEQ ID NO: 7757 - RNA, 27 nt, Artificial Sequence
  Synthetic oligonucleotide
guuuaauucugaaccauuucuauaacc

SEQ ID NO: 7758 - RNA, 27 nt, Artificial Sequence
  Synthetic oligonucleotide
aguuuaauucugaaccauuucuauaac

SEQ ID NO: 7759 - RNA, 27 nt, Artificial Sequence
  Synthetic oligonucleotide
aaguuuaauucugaaccauuucuauaa

SEQ ID NO: 7760 - RNA, 27 nt, Artificial Sequence
  Synthetic oligonucleotide
auuaaaaguuuaauucugaaccauuuc

SEQ ID NO: 7761 - RNA, 27 nt, Artificial Sequence
  Synthetic oligonucleotide
aauuaaaaguuuaauucugaaccauuu

SEQ ID NO: 7762 - RNA, 27 nt, Artificial Sequence
  Synthetic oligonucleotide
ugaauuaaaaguuuaauucugaaccau

SEQ ID NO: 7763 - RNA, 27 nt, Artificial Sequence
  Synthetic oligonucleotide
uuugaaugaauuaaaaguuuaauucug

SEQ ID NO: 7764 - RNA, 27 nt, Artificial Sequence
  Synthetic oligonucleotide
uuuuuuugaaugaauuaaaaguuuaau

SEQ ID NO: 7765 - RNA, 27 nt, Artificial Sequence
  Synthetic oligonucleotide
uuuuuuuuuuugaaugaauuaaaaguu

SEQ ID NO: 7766 - RNA, 27 nt, Artificial Sequence
  Synthetic oligonucleotide
uuuuuuuuuuuugaaugaauuaaaagu

SEQ ID NO: 7767 - RNA, 27 nt, Artificial Sequence
  Synthetic oligonucleotide
uuuuuuuuuuuuugaaugaauuaaaag

SEQ ID NO: 7768 - RNA, 27 nt, Artificial Sequence
  Synthetic oligonucleotide
uuuuuuuuuuuuuugaaugaauuaaaa

SEQ ID NO: 7769 - RNA, 27 nt, Artificial Sequence
  Synthetic oligonucleotide
uuuuuuuuuuuuuuugaaugaauuaaa

SEQ ID NO: 7770 - RNA, 27 nt, Artificial Sequence
  Synthetic oligonucleotide
uuuuuuuuuuuuuuuugaaugaauuaa

SEQ ID NO: 7771 - RNA, 21 nt, Artificial Sequence
  Synthetic oligonucleotide
accucacuugcaauaauuaua

SEQ ID NO: 7772 - RNA, 21 nt, Artificial Sequence
  Synthetic oligonucleotide
uaauuauugcaagugagguua

SEQ ID NO: 7773 - RNA, 21 nt, Artificial Sequence
  Synthetic oligonucleotide
uaaccucacuugcaauaauua

SEQ ID NO: 7774 - RNA, 21 nt, Artificial Sequence
  Synthetic oligonucleotide
uaaccucacuugcaauaaucc

SEQ ID NO: 7775 - DNA, 25 bp, Artificial Sequence
  Synthetic oligonucleotide
accucacuugcaauaauuauacgaa

SEQ ID NO: 7776 - DNA, 25 bp, Artificial Sequence
  Synthetic oligonucleotide
accucacuugcaauaauuauaauaa

SEQ ID NO: 7777 - DNA, 25 bp, Artificial Sequence
  Synthetic oligonucleotide
accucacuugcaauaauuauaagca

SEQ ID NO: 7778 - DNA, 25 bp, Artificial Sequence
  Synthetic oligonucleotide
accucacuugcaauaauuauaagac

SEQ ID NO: 7779 - RNA, 27 nt, Artificial Sequence
  Synthetic oligonucleotide
gucuuauaauuauugcaagugagguua

SEQ ID NO: 7780 - RNA, 27 nt, Artificial Sequence
  Synthetic oligonucleotide
ugcuuauaauuauugcaagugagguua

SEQ ID NO: 7781 - RNA, 27 nt, Artificial Sequence
  Synthetic oligonucleotide
uuauuauaauuauugcaagugagguua

SEQ ID NO: 7782 - RNA, 27 nt, Artificial Sequence
  Synthetic oligonucleotide
uucguauaauuauugcaagugagguua

SEQ ID NO: 7783 - RNA, 25 nt, Artificial Sequence
  Synthetic oligonucleotide
  misc_feature (22)..(25): n is a, c, g, or u
accucacuugcaauaauuauannnn

SEQ ID NO: 7784 - RNA, 27 nt, Artificial Sequence
  Synthetic oligonucleotide
  misc_feature (1)..(6): n is a, c, g, or u
nnnnnnuaauuauugcaagugagguua

SEQ ID NO: 7785 - DNA, 27 bp, Artificial Sequence
  Synthetic oligonucleotide
  misc_feature (22)..(27): n is a, c, g, or t
taacctcacttgcaataattannnnnn

SEQ ID NO: 7786 - DNA, 34 bp, Artificial Sequence
  Synthetic oligonucleotide
cagcgtggacaatggctactcaagctgatttgat

SEQ ID NO: 7787 - DNA, 25 bp, Artificial Sequence
  Synthetic oligonucleotide
ugguguagaacacuaauucaucatc

SEQ ID NO: 7788 - DNA, 25 bp, Artificial Sequence
  Synthetic oligonucleotide
ugguguagaacacuaauucauactc

SEQ ID NO: 7789 - DNA, 25 bp, Artificial Sequence
  Synthetic oligonucleotide
ugguguagaacacuaauucauaacc

SEQ ID NO: 7790 - DNA, 25 bp, Artificial Sequence
  Synthetic oligonucleotide
ugguguagaacacuaauucauaata

SEQ ID NO: 7791 - RNA, 27 nt, Artificial Sequence
  Synthetic oligonucleotide
aauuaugaauuaguguucuacaccauu

SEQ ID NO: 7792 - RNA, 27 nt, Artificial Sequence
  Synthetic oligonucleotide
gcuuaugaauuaguguucuacaccauu

SEQ ID NO: 7793 - RNA, 27 nt, Artificial Sequence
  Synthetic oligonucleotide
gacuaugaauuaguguucuacaccauu

SEQ ID NO: 7794 - RNA, 27 nt, Artificial Sequence
  Synthetic oligonucleotide
gaucaugaauuaguguucuacaccauu

We claim:

1. A synthetic double-stranded RNA (dsRNA) comprising first and second nucleic acid strands and a duplex region of at least 25 base pairs, wherein said first strand is 25-34 nucleotides in length and said second strand of said dsRNA consists of 5'-GCUGUUUCUACAUCAUUUGUAUUCUGC-3' (SEQ ID NO: 1239) and said dsRNA reduces β-catenin target gene expression when said double stranded nucleic acid is introduced into a mammalian cell.

2. The synthetic dsRNA of claim 1, wherein said second oligonucleotide strand is modified as follows to include a 2'-O-methyl ribonucleotide as indicated by a lower case letter: 5'-gcugUUUCUAcAuCAUUUGUAUuCuGc-3' (SEQ ID NO: 1239).

3. The synthetic dsRNA of claim 1, wherein starting from the first nucleotide (position 1) at the 3' terminus of the first oligonucleotide strand, position 1, 2 and/or 3 is substituted with a modified nucleotide.

4. The synthetic dsRNA of claim 1, wherein the 3' terminus of said first strand and the 5' terminus of said second strand form a blunt end.

5. The synthetic dsRNA of claim 1, wherein said first strand is 25 nucleotides in length.

6. The synthetic dsRNA of claim 1, wherein said first strand comprises 5'-AGAAUACAAAUGAUGUAGAAACAGC-3' (SEQ ID NO: 130).

7. The synthetic dsRNA of claim 1, wherein said first strand consists of 5'-AGAAUACAAAUGAUGUAGAAACAGC-3' (SEQ ID NO: 130).

8. The synthetic dsRNA of claim 7, wherein said first strand is modified as follows to include a 2'-O-methyl ribonucleotide as indicated by a lower case letter:

(SEQ ID NO: 130)
5'-AgAaUaCaAAUgAuGuAgAAACAGC-3'.

9. The synthetic dsRNA of claim 7, wherein said first strand is modified as follows to include a 2'-O-methyl ribonucleotide as indicated by a lower case letter and deoxyribonucleotides as indicated by "dG" and "dC": 5'-AgAaUa-CaAAUgAuGuAgAAACAdGdC-3' (SEQ ID NO: 130).

10. The synthetic dsRNA of claim 3, wherein said modified nucleotide residue of said 3' terminus of said first strand is selected from the group consisting of a deoxyribonucleotide, an acyclonucleotide and a fluorescent molecule.

11. The synthetic dsRNA of claim 1, wherein the first and second strands are joined by a chemical linker.

12. The synthetic dsRNA of claim 1, wherein said first strand consists of a sequence modified as follows to include a 2'-O-methyl ribonucleotide as indicated by a lower case letter and deoxyribonucleotides as indicated by "dG" and "dC":

(SEQ ID NO: 130)
5'-AgAaUaCaAAUgAuGuAgAAACAdGdC-3' and wherein said second oligonucleotide strand is modified as follows to include a 2'-O-methyl ribonucleotide as indicated by a lower case letter:

(SEQ ID NO: 1239)
5'-gcugUUUCUAcAuCAUUUGUAUuCuGc-3'.

* * * * *